US011242525B2

(12) United States Patent
Friedland et al.

(10) Patent No.: US 11,242,525 B2
(45) Date of Patent: Feb. 8, 2022

(54) CRISPR/CAS-RELATED METHODS AND COMPOSITIONS FOR TREATING SICKLE CELL DISEASE

(71) Applicant: EDITAS MEDICINE, INC., Cambridge, MA (US)

(72) Inventors: Ari E. Friedland, Boston, MA (US); Morgan L. Maeder, Jamaica Plain, MA (US); G. Grant Welstead, Cambridge, MA (US); David A. Bumcrot, Belmont, MA (US)

(73) Assignee: EDITAS MEDICINE, INC., Cambridge, MA (US)

( * ) Notice: Subject to any disclaimer, the term of this patent is extended or adjusted under 35 U.S.C. 154(b) by 383 days.

(21) Appl. No.: 15/129,367

(22) PCT Filed: Mar. 26, 2015

(86) PCT No.: PCT/US2015/022856
§ 371 (c)(1),
(2) Date: Sep. 26, 2016

(87) PCT Pub. No.: WO2015/148863
PCT Pub. Date: Oct. 1, 2015

(65) Prior Publication Data
US 2017/0314015 A1 Nov. 2, 2017

Related U.S. Application Data

(60) Provisional application No. 61/970,588, filed on Mar. 26, 2014, provisional application No. 62/084,487, filed on Nov. 25, 2014.

(51) Int. Cl.
| | |
|---|---|
| *C12N 15/11* | (2006.01) |
| *C12N 9/22* | (2006.01) |
| *C12N 15/10* | (2006.01) |
| *A61K 48/00* | (2006.01) |
| *C12N 15/113* | (2010.01) |

(52) U.S. Cl.
CPC ............ *C12N 15/11* (2013.01); *A61K 48/005* (2013.01); *C12N 9/22* (2013.01); *C12N 15/1024* (2013.01); *C12N 15/113* (2013.01); *C12N 2310/10* (2013.01); *C12N 2310/20* (2017.05); *C12N 2320/34* (2013.01)

(58) Field of Classification Search
CPC ........ C12N 15/907; C12N 15/63; C12N 9/22; C12N 2310/20; A61K 48/00
See application file for complete search history.

(56) References Cited

U.S. PATENT DOCUMENTS

| | | | |
|---|---|---|---|
| 6,413,540 B1 | 7/2002 | Yaacobi | |
| 6,586,240 B1 | 7/2003 | Singer et al. | |
| 8,697,359 B1 * | 4/2014 | Zhang | C12N 15/63 435/6.1 |
| 8,771,945 B1 | 7/2014 | Zhang | |
| 8,795,965 B2 | 8/2014 | Zhang | |
| 8,865,406 B2 | 10/2014 | Zhang et al. | |
| 8,871,445 B2 | 10/2014 | Cong et al. | |
| 8,889,356 B2 | 11/2014 | Zhang | |
| 8,889,394 B2 | 11/2014 | Chalasani et al. | |
| 8,889,418 B2 | 11/2014 | Zhang et al. | |
| 8,895,308 B1 | 11/2014 | Zhang et al. | |
| 8,906,616 B2 | 12/2014 | Zhang et al. | |
| 8,932,814 B2 | 1/2015 | Cong et al. | |
| 8,945,839 B2 | 2/2015 | Zhang | |
| 8,993,233 B2 | 3/2015 | Zhang et al. | |
| 8,999,641 B2 | 4/2015 | Zhang et al. | |
| 9,322,037 B2 | 4/2016 | Liu et al. | |
| 9,499,847 B2 | 11/2016 | Porter et al. | |
| 2003/0186238 A1 | 10/2003 | Allawi et al. | |
| 2007/0020627 A1 | 1/2007 | Barbas | |
| 2010/0055793 A1 | 3/2010 | Chandrasegaran et al. | |
| 2010/0055798 A1 | 3/2010 | Battersby | |
| 2010/0076057 A1 | 3/2010 | Sontheimer et al. | |
| 2011/0059502 A1 | 3/2011 | Chalasani | |
| 2011/0189776 A1 | 8/2011 | Terns et al. | |
| 2011/0223638 A1 | 9/2011 | Wiedenheft et al. | |
| 2011/0236894 A1 | 9/2011 | Rao et al. | |
| 2011/0301073 A1 | 12/2011 | Gregory et al. | |
| 2012/0270273 A1 | 10/2012 | Zhang et al. | |
| 2013/0130248 A1 | 5/2013 | Haurwitz et al. | |
| 2013/0253040 A1 | 9/2013 | Miller et al. | |
| 2014/0068797 A1 | 3/2014 | Doudna et al. | |
| 2014/0179770 A1 | 6/2014 | Zhang et al. | |
| 2014/0242699 A1 | 8/2014 | Zhang | |
| 2014/0309177 A1 | 10/2014 | Perez-Pinera et al. | |

(Continued)

FOREIGN PATENT DOCUMENTS

| | | | |
|---|---|---|---|
| WO | 2002/089767 A1 | 11/2002 | |
| WO | 2003/072788 A1 | 9/2003 | |

(Continued)

OTHER PUBLICATIONS

Bauer et al.; An Erythroid Enhancer of BCL11A Subject to Genetic Variation Determines Fetal Hemoglobin Level; Science; vol. 342, pp. 253-257, published Oct. 11, 2013 (Year: 2013).*
U.S. Appl. No. 61/652,086, filed May 25, 2012, Jinek et al.
U.S. Appl. No. 61/716,256, filed Oct. 19, 2012, Jinek et al.
U.S. Appl. No. 61/734,256, filed Dec. 6, 2012, Chen et al.
U.S. Appl. No. 61/736,527, filed Dec. 12, 2012, Zhang et al.
U.S. Appl. No. 61/738,355, filed Dec. 17, 2012, Church et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/779,169, filed Mar. 13, 2013, Mali et al.

(Continued)

Primary Examiner — Antonio Galisteo Gonzalez
(74) Attorney, Agent, or Firm — Perkins Coie LLP; Patrick D. Morris; Courtney Prochnow

(57) ABSTRACT

CRISPR/CAS-related compositions and methods for treatment of Sickle Cell Disease (SCD) are disclosed.

28 Claims, 45 Drawing Sheets

Specification includes a Sequence Listing.

(56) References Cited

U.S. PATENT DOCUMENTS

| | | |
|---|---|---|
| 2014/0315985 A1 | 10/2014 | May et al. |
| 2014/0335620 A1 | 11/2014 | Zhang et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0356958 A1 | 12/2014 | Mali et al. |
| 2015/0056705 A1* | 2/2015 | Conway ............ C12N 15/11 435/462 |
| 2015/0232833 A1 | 8/2015 | Mali et al. |
| 2015/0259704 A1 | 9/2015 | Church et al. |
| 2016/0281111 A1 | 9/2016 | Cotta-Ramusino et al. |
| 2016/0324987 A1 | 11/2016 | Wang et al. |
| 2016/0340661 A1* | 11/2016 | Cong ................ A61P 27/02 |
| 2017/0058298 A1 | 3/2017 | Kennedy et al. |
| 2018/0291370 A1 | 10/2018 | Gersbach et al. |

FOREIGN PATENT DOCUMENTS

| | | |
|---|---|---|
| WO | 2008/108989 A2 | 9/2008 |
| WO | 2010/054108 A9 | 5/2010 |
| WO | 2011/143124 A2 | 11/2011 |
| WO | 2011/146121 A1 | 11/2011 |
| WO | 2012/145601 A2 | 10/2012 |
| WO | 2012/164565 A8 | 12/2012 |
| WO | 2013/012674 A1 | 1/2013 |
| WO | 2013/066438 A2 | 5/2013 |
| WO | 2013/082519 A2 | 6/2013 |
| WO | 2013/098244 A1 | 7/2013 |
| WO | 2013/126794 A1 | 8/2013 |
| WO | 2013/141680 A1 | 9/2013 |
| WO | 2013/142578 A1 | 9/2013 |
| WO | 2013/163628 A2 | 10/2013 |
| WO | 2013/176772 A1 | 11/2013 |
| WO | 2013/181228 A1 | 12/2013 |
| WO | 2014/018423 A8 | 1/2014 |
| WO | 2014/022702 A2 | 2/2014 |
| WO | 2014/036219 A2 | 3/2014 |
| WO | 2014/059255 A1 | 4/2014 |
| WO | 2014/065596 A1 | 5/2014 |
| WO | 2014/089290 A1 | 6/2014 |
| WO | 2014/093479 A1 | 6/2014 |
| WO | 2014/093595 A1 | 6/2014 |
| WO | 2014/093622 A8 | 6/2014 |
| WO | 2014/093635 A9 | 6/2014 |
| WO | 2014/093655 A2 | 6/2014 |
| WO | 2014/093661 A2 | 6/2014 |
| WO | 2014/093694 A1 | 6/2014 |
| WO | 2014/093709 A1 | 6/2014 |
| WO | 2014/093712 A1 | 6/2014 |
| WO | 2014/093718 A1 | 6/2014 |
| WO | 2014/099744 A1 | 6/2014 |
| WO | 2014/099750 A2 | 8/2014 |
| WO | 2014/124284 A1 | 8/2014 |
| WO | 2014/144288 A1 | 9/2014 |
| WO | 2014/144592 A2 | 9/2014 |
| WO | 2014/144761 A2 | 9/2014 |
| WO | 2014/152432 A2 | 9/2014 |
| WO | 2014/186585 A2 | 11/2014 |
| WO | 2014/197568 A2 | 12/2014 |
| WO | 2014/197748 A2 | 12/2014 |
| WO | 2014/204578 A1 | 12/2014 |
| WO | 2014/204725 A8 | 12/2014 |
| WO | 2015/006290 A1 | 1/2015 |
| WO | 2015/006294 A2 | 1/2015 |
| WO | 2015/006498 A2 | 1/2015 |
| WO | 2015/013583 A8 | 1/2015 |
| WO | 2015/021353 A1 | 2/2015 |
| WO | 2015/027134 A1 | 2/2015 |
| WO | 2015/035136 A8 | 3/2015 |
| WO | 2015/035139 A2 | 3/2015 |
| WO | 2015/035162 A2 | 3/2015 |
| WO | 2015/048577 A2 | 4/2015 |
| WO | 2015/048680 A1 | 4/2015 |
| WO | 2015/070083 A1 | 5/2015 |
| WO | 2015/071474 A9 | 5/2015 |
| WO | 2015/077290 A2 | 5/2015 |
| WO | 2015/077318 A1 | 5/2015 |
| WO | 2015/089406 A1 | 6/2015 |
| WO | 2015/089462 A1 | 6/2015 |
| WO | 2015/099850 A1 | 7/2015 |
| WO | 2015/138510 A8 | 9/2015 |
| WO | 2015/148860 | 10/2015 |
| WO | 2015/148863 A2 | 10/2015 |
| WO | 2015/188056 A1 | 12/2015 |
| WO | 2015/195621 A1 | 12/2015 |
| WO | 2016/011080 A2 | 1/2016 |
| WO | 2016/022363 A9 | 2/2016 |
| WO | 2016/073990 A2 | 5/2016 |
| WO | 2016/135557 A2 | 9/2016 |
| WO | 2016/135558 A2 | 9/2016 |
| WO | 2016/182959 A1 | 11/2016 |
| WO | 2016/186772 A2 | 11/2016 |
| WO | 2016/205749 A1 | 12/2016 |
| WO | 2017/035416 A2 | 3/2017 |
| WO | 2017/077394 A2 | 5/2017 |
| WO | 2017/060890 A1 | 9/2017 |
| WO | 2017/184768 | 10/2017 |
| WO | 2017/191503 A1 | 11/2017 |
| WO | 2018/009562 A1 | 1/2018 |
| WO | 2018/017754 A1 | 1/2018 |
| WO | 2018/026976 A1 | 2/2018 |
| WO | 2018/126176 A1 | 7/2018 |
| WO | 2018/142364 A1 | 8/2018 |
| WO | 2018/170184 A1 | 9/2018 |
| WO | 2018/209158 A2 | 11/2018 |
| WO | 2019/178416 A1 | 9/2019 |
| WO | 2019/178426 A1 | 9/2019 |

OTHER PUBLICATIONS

Ahern, E.J., et al., "The Prevalence of the Rarer Inherited Haemoglobin Defects in Adult Jamaicans," Br. J. Haematol. 25(4):437-444 (1973).

Akinbami, A.O., et al., "Hereditary Persistence of Fetal Hemoglobin Caused by Single Nucleotide Promoter Mutations in Sickle Cell Trait and Hb SC Disease," Hemoglobin 40(1):64-65 (2016).

Al-Attar, S., et al., "Clustered Regularly Interspaced Short Palindromic Repeats (CRISPRs) The Hallmark of an Ingenious Antiviral Defense Mechanism in Prokaryotes," Biol. Chem. 392:277-289 (2011).

Aliyu, Z.Y., et al., "Sickle Cell Disease and Pulmonary Hypertension in Africa: A Global Perspective and Review of Epidemiology, Pathophysiology, and Management," Am. J. Hematol. 83(1):63-70 (2008).

Altschul, S. F., et al., "Gapped BLAST and PSI-BLAST: A New Generation of Protein Database Search Programs," Nucleic Acids Res. 25(17):3389-3402 (1997).

Altschul, S. F et al., "Basic Local Alignment Search Tool," J. Mol. Biol. 215(3):403-410 (1990).

Anders, C., et al., "Structural Basis of PAM-Dependent Target DNA Recognition by the Cas9 Endonuclease," Nature 513(7519):569-573 (2014).

Andreas, S., et al., "Enhanced Efficiency Through Nuclear Localization Signal Fusion on Phage PhiC31-Integrase: Activity Comparison with Cre and FLPe Recombinase in Mammalian Cells," Nucleic Acids Res. 30(11):2299-2306 (2002).

Angastiniotis, M., et al., "Global Epidemiology of Hemoglobin Disorders," Ann. N.Y. Acad. Sci. 850:251-269 (1998).

Anonymous, Third Party Observation for EP13818570.7, Oct. 1, 2014, 15 pages.

Anonymous, Third Party Observation for EP13824232.6, Sep. 8, 2014, 48 pages.

Anonymous, Third Party Observation for EP13824232.6, Sep. 22, 2014, 19 pages.

Anonymous, Third Party Observation for EP13824232.6, Oct. 22, 2014, 7 pages.

Bae, S., et al., "Cas-OFFinder: A Fast and Versatile Algorithm that Searches for Potential Off-Target Sites of Cas9 RNA-Guided Endonucleases," Bioinformatics 30(10):1473-1475 (2014).

Baker, M., "Gene Editing at CRISPR Speed," Nat. Biotechnol. 32(4):309-312 (2014).

(56) References Cited

OTHER PUBLICATIONS

Barbosa, C.G., et al., "Promoter Region Sequence Differences in the A and G Gamma Globin Genes of Brazilian Sickle Cell Anemia Patients," Braz. J. Med. Biol. Res. 43(8):705-711 (2010).
Barker, C. S., et al., "Increased DNA Microarray Hybridization Specificity Using sscDNA Targets," BMC Genomics 6:57 (2005).
Baron-Benhamou, J., et al., "Using the LambdaN Peptide to Tether Proteins to RNAs," Methods Mol. Biol. 257:135-153 (2004).
Barrangou, R., "RNA-Mediated Programmable DNA Cleavage," Nat. Biotechnol. 30(9):836-838 (2012).
Barretina, J., et al., "The Cancer Cell Line Encyclopedia Enables Predictive Modeling of Anticancer Drug Sensitivity," Nature 483(7391):603-607 (2012).
Bassett, A. R., et al., "CRISPR/Cas9 and Genome Editing in Drosophila," J. Genet. Genom. 41:7-19(2014).
Bauer, D. E., et al., "Blood Journal: Fine-Mapping and Genome Editing Reveal an Essential Erythroid Enhancer at the HbF-Associated BCL11A Locus," Blood 122(21):437 (2013).
Bauer, D. E., et al., "An Erythroid Enhancer of BCL11A Subject to Genetic Variation Determines Fetal Hemoglobin Level," Science 342(6155):253-257 (2013).
Beerli, R. R., et al., "Toward Controlling Gene Expresion at Will: Specific Regulation of the erbB-2/HER-2 Promoter by Using Polydactyl Zinc Finger Proteins Constructed from Modular Building Blocks," Proc. Natl. Acad. Sci. 95:14628-14633 (1998).
Bhaya, D., et al., "CRISPR-Cas Systems in Bacteria and Archaea: Versatile Small RNAs for Adaptive Defense and Regulation," Annu. Rev. Genet. 45:273-297 (2011).
Bikard, D., et al., "Programmable Repression and Activation of Bacterial Gene Expression Using an Engineered CRISPR-Cas System," Nucl. Acids Res. 41(15):7429-7437 (2013).
Bitinaite, J., et al., "FokI Dimerization is Required for DNA Cleavage," Proc. Natl. Acad. Sci. 95:10570-10575 (1998).
Boch, J., et al., "Breaking the Code of DNA Binding Specificity of TAL-Type III Effectors," Science 326(5959):1509-1512 (2009).
Boch, J., et al., "Xanthomonas AvrBs3 Family-Type III Effectors: Discovery and Function," Annu. Rev. Phytopathol. 48:419-436 (2010).
Bouva, M. J., et al., "Known and New Delta Globin Gene Mutations and Their Diagnostic Significance," Haematologica 91(1):129-132 (2006).
Briner, A.E., et al., "Guide RNA Functional Modules Direct Cas9 Activity and Orthogonality," Mol. Cell 56(2):333-339 (2014).
Broad Institute, Communication Forwarding Declaration of Feng Zhang for U.S. Appl. No. 14/256,912, filed Nov. 24, 2014, 5 pages.
Broad Institute, Information Disclosure Statement submitted for U.S. Appl. No. 14/256,912, citing Electronic Mail from T. Kowalski to Examiner N. Leith which references Briner et al., Nov. 3, 2014, 8 pages.
Broad Institute, Request for Oral Examination for EP13818570.7, Oct. 27, 2014, 3 pages.
Broad Institute, Response to EP Examination Report for EP13824232.6, dated Dec. 31, 2014, 44 pages.
Broad Institute, Response to Third Party Observations and Request for Oral Hearing for EP13824232.6, Oct. 27, 2014, 9 pages.
Broad Institute, Response to Third Party Observations, with redlined and clean amended claims, for EP13818570.7, Oct. 16, 2014, 30 pages.
Broad Institute, Response to Third Party Observations, with redlined and clean amended claims, for EP13824232.6, Oct. 2, 2014, 16 pages.
Brousseau, D.C., et al., "The Number of People with Sickle-Cell Disease in the United States: National and State Estimates," Am. J. Hematol. 85(1):77-78 (2010).
Brummelkamp, T. R., et al., "A System for Stable Expression of Short Interfering RNAs in Mammalian Cells," Science 296(5567):550-553 (2002).
Caldecott, K.W., "Single-Strand Break Repair and Genetic Disease," Nat. Rev. Genet. 9(8):619-631 (2008).

Canver, M. C., "Evaluation of the Clinical Success of Ex Vivo and In Vivo Gene Therapy," Journal of Young Investitgators, http://www.hyi.org/issue/evaluation-of-the-clinical-success-of-ex-vivo-and-in-vivo-gene-therapy/, 9 pages (2009).
Carroll, D., "A CRISPR Approach to Gene Targeting," Mol. Ther. 20(9):1658-1660 (2012).
Cathomen, T., et al., "Zinc-Finger Nucleases: The Next Generation Emerges," Mol. Ther. 16:1200-1207 (2008).
Cermak, T., et al., "Efficient Design and Assembly of Custom TALEN and Other TAL Effector-Based Constructs for DNA Targeting," Nucl. Acids Res. 39(12):e82 (2011).
Chassanidis, C., et al., "The Hellenic Type of Nondeletional Hereditary Persistence of Fetal Hemoglobin Results from a Novel Mutation (g.-109G>T) in the HBG2 Gene Promoter," Ann. Hematol. 88(6):549-555 (2009).
Chen, X., et al., "Fusion Protein Linkers: Property, Design and Functionality," Adv. Drug Deliv. Rev. 65(10):1357-1369 (2013).
Cho, S. W., et al., Supplementary Information: Targeted Genome Engineering in Human Cells With the Cas9 RNA-Guided Endonuclease, Nature Biotechnology (Mar. 2013) vol. 31, No. 3, 11 pages.
Cho, S. W., et al., "Targeted Genome Engineering in Human Cells with the Cas9 RNA-Guided Endonuclease," Nat. Biotechnol. 31(3):230-232 (2013).
Christian, M., et al., "Targeting DNA Double-Strand Breaks With TAL Effector Nucleases," Genetics 186:757-761 (2010).
Christian, M., et al., "Targeting DNA Double-Strand Breaks With TAL Effector Nucleases," Genetics Supporting Information, 1SI-8SI (2010).
Chylinski, K., et al., "The TrackRNA and Cas9 Families of Type II CRISPR-Cas Immunity Systems," RNA Biol. 10(5):726-737 (2013).
Cong, L., et al., "Multiplex Genome Engineering Using CRISPR/Cas Systems," Science 339(6121):819-823 (2013).
Cong, L., et al., "Supplementary Material: Multiplex Genome Engineering Using CRISPR-Cas Systems," Science Express (Jul. 5, 2012).
Cong, L., et al., "Supplementary Material: Multiplex Genome Engineering Using CRISPR-Cas Systems," Science Express (Jan. 3, 2013).
Cornish-Bowden, A., "Nomenclature for Incompletely Specified Bases in Nucleic Acid Sequences: Recommendations 1984," Nucleic Acids Res. 13(9):3021-3030 (1985).
Cradick, T. J., et al., "CRISPR/Cas9 Systems Targeting Beta-Globin and CCR5 Genes Have Substantial Off-Target Activity," Nucleic Acids Res. 41(20):9584-9592 (2013).
Datsenko, K. A., et al., "Molecular Memory of Prior Infections Activates the CRISPR/Cas Adaptive Bacterial Immunity System," Nat. Commun. 3:945 (2012).
Davis, L., et al., "Homology-Directed Repair of DNA Nicks Via Pathways Distinct from Canonical Double-Strand Break Repair," PNAS 111(10):E924-932 (2014).
Deltcheva, E., et al., CRISPR RNA Maturation by Trans-Encoded Small RNA and Host Factor RNase III, Nature 471:602-607 (2011).
Deltcheva, E., et al., Supplementary Figures: CRISPR RNA Maturation by Trans-Encoded Small RNA and Host Factor RNase III. Downloaded from www.nature.com/nature, p. 1-35, 2011.
Deveau, H., et al., "Phage Response to CRISPR-Encoded Resistance in Streptococcus thermophilus," J. Bacteriol. 190(4):1390-1400 (2008).
Dicarlo, J. E., et al., "Genome Engineering in Saccharomyces cerevisiae Using CRISPR-Cas Systems," Nucl. Acids Res. 41(7):4336-43 (2013).
Dingwall, C., et al., "A Polypeptide Domain That Specifies Migration of Nucleoplasmin Into the Nucleus," Cell 30:449-458 (1982).
Dreszer, T. R., et al., "The UCSC Genome Browser Database: Extensions and Updates 2011," Nucl. Acids Res. 40:D918-D923 (2012).
Esvelt, K.M., et al., "A System for the Continuous Directed Evolution of Biomolecules," Nature 472(7344):499-503 (2011).
Esvelt, K. M., et al., "Orthogonal Cas9 Proteins for RNA-Guided Gene Regulation and Editing," Nat. Methods 10(11):1116-1121 (2013).

(56) References Cited

OTHER PUBLICATIONS

Fine, E.J., et al., "Trans-Spliced Cas9 Allows Cleavage of HBB and CCR5 Genes in Human Cells Using Compact Expression Cassettes," Sci. Rep. 5:10777 (2015).
Fonfara, I., et al., "Phylogeny of Cas9 Determines Functional Exchangeability of Dual-RNA and Cas9 Among Orthologous Type II CRISPR-Cas Systems," Nucl. Acids Res.42(4):2577-2590 (2014).
Friedland, A.E., et al., "Characterization of *Staphylococcus aureus* Cas9: A Smaller Cas9 for All-in-One Adeno-Associated Virus Delivery and Paired Nickase Applications," Genome Biol. 16:257 (2015).
Frit, P., et al., "Alternative End-Joining Pathway(s): Bricolage at DNA Breaks," DNA Repair (Amst) 17:81-97 (2014).
Fu, Y., et al., "High-Frequency Off-Target Mutagenesis Induced by CRISPR-Cas Nucleases in Human Cells," Nat. Biotechnol. 31:822-826 (2013).
Fu, Y., et al., "Improving CRISPR-Cas Nuclease Specificity Using Truncated Guide RNAs," Nat. Biotechnol. 32(3):279-284 (2014).
Gabriel, R., et al., "An Unbiased Genome-Wide Analysis of Zinc-Finger Nuclease Specificity," Nat. Biotechnol. 29:816-823 (2011).
Garneau, J. E., et al., "The CRISPR-Cas Bacterial Immune Systems Cleaves Bacteriophage and Plasmid DNA," Nature 468:67-71 (2010).
Gasiunas, G., et al., "Cas9-crRNA Ribonucleoprotein Complex Mediates Specific DNA Cleavage for Adaptive Immunity in Bacteria," Proc. Natl. Acad. Sci. 109(39):E2579-E2586 (2012).
Gilbert, L. A., et al., "CRISPR-Mediated Modular RNA-Guided Regulation of Transcription in Eukaryotes," Cell 154(2):442-451 (2013).
Goldfarb, D. S., et al., "Synthetic Peptides as Nuclear Localization Signals," Nature 322:641-644 (1986).
Gratz, S. J., et al., "Genome Engineering of *Drosophila* with the CRISPR RNA-Guided Cas9 Nuclease," Genetics 194(4):1029-1035 (2013).
Grieger, J. C., et al., "Production and Characterization of Adeno-Associated Viral Vectors," Nat. Protoc. 1(3):1412-1428 (2006).
Guilinger, J. P., et al., "Fusion of Catalytically Inactive Cas9 to FokI Nuclease Improves the Specificity of Genome Modification," Nat Biotechnol. 32(6):577-583 (2014).
Guo, X., et al., "RNA-Dependent Folding and Stabilization of C5 Protein During Assembly of the *E. coli* Rnase P Holoenzyme," J. Mol. Biol. 360:190-203 (2006).
Gustafsson, C., et al., "Codon Bias and Heterologous Protein Expression," Trends Biotechnol. 22(7):346-353 (2004).
Haft, D. H., et al., "A Guild of 45 CRISPR-Associated (Cas) Protein Families and Multiple CRISPR/Cas Subtypes Exist in Prokaryotic Genomes," PLoS Comput. Biol. 1(6):e60 (2005).
Hale, C. R., et al., "Essential Features and Rational Design of CRISPR RNAs That Function With the Cas RAMP Module Complex to Cleave RNAs," Mol. Cell 45(3):292-302 (2012).
Hatoum-Aslan, A., et al. "Mature Clustered Regularly Interspaced, Short Palindromic Repeats RNA 5,9,14 (crRNA) Length is Measured by a Ruler Mechanism Anchored at the Precursor Processing Site," Proc. Natl. Acad. Sci. 108(52):21218-21222 (2011).
Heigwer, F., et al., "E-CRISP: Fast CRISPR Target Site Identification," Nat. Methods 11(2):122-123 (2014).
Hockemeyer, D., et al., "Efficient Targeting of Expressed and Silent Genes in Human ESCs and iPSCs Using Zinc-Finger Nucleases," Nat. Biotechnol. 27(9):851-857 (2009).
Hockemeyer, D., et al., "Genetic Engineering of Human luripotent Cells Using TALE Nucleases," Nat. Biotechnol. 29:731-734 (2011).
Holt, N, et al., "Zinc Finger Nuclease-Mediated CCR5 Konockout Hematopoietic Stem Cell Transplantation Controls HIV-1 In Vivo," Nat. Biotechnol. 28(8):839-847 (2010).
Horvath, P., et al., "CRISPR/Cas, The Immune System of Bacteria and Archaea," Science 327(5962):167-170 (2010).
Horvath, P., et al., "RNA-Guided Genome Editing A La Carte," Cell Res. 23:733-734 (2013).
Hou, Z., et al., "Efficient Genome Engineering in Human Pluripotent Stem Cells Using Cas9 from Neisseria Meningitidis," Proc. Natl. Acad. Sci. U.S.A. 110(39):15644-15649 (2013).

Hsu, P.D., et al., "DNA Targeting Specificity of RNA-Guided Cas9 Nucleases," Nat. Biotechnol. 31(9): 827-832 (2013).
Hwang, W. Y., et al., "Heritable and Precise Zebrafish Genome Editing Using a CRISPR-Cas System," PLoS One 8(7):e68708 (2013).
Hwang, W. Y., et al., "Efficient Genome Editing in Zebrafish Using a CRISPR-Cas System," Nat. Biotechnol. 31(3):227-229 (2013).
Iyama, T., et al., "DNA Repair Mechanisms in Dividing and Non-Dividing Cells," DNA Repair (Amst.) 12(8):620-636 (2013).
Iyer, L. M., et al., "Prediction of Novel Families of Enzymes Involved in Oxidative and Other Complex Modifications of Bases in Nucleic Acids," Cell Cycle 8(11):1698-1710 (2009).
Jiang, W., et al., "RNA-Guided Editing of Bacterial Genomes Using CRISPR-Cas Systems," Nat. Biotechnol. 31(3):233-239 (2013).
Jinek, M., et al., "A Programmable Dual-RNA-Guided DNA Endonuclease in Adaptive Bacterial Immunity," Science 337(6096):816-821 (2012).
Jinek, M., et al., "Structures of Cas9 Endonucleases Reveal RNA-Mediated Conformational Activation," Science 343(6176):1247997 (2014).
Jinek, M., et al., "RNA-Programmed Genome Editing in Human Cells," eLife 2:e00471 (2013).
Kaiser, J., "The Gene Editor CRISPR Won't Fully Fix Sick People Anytime Soon. Here's Why," (May 3, 2016), Biol., Technol, CRISPR, DOI: 10.1126/science.aaf5689, 5 pages.
Karolchik, D., et al., "The UCSC Table Browser Data Retrieval Tool," Nucleic Acids Research 32:D493-496 (2004).
Kent, W. J., et al., "The Human Genome Browserat UCSC," Genome Research 12:996-1006 (2002).
Keryer-Bibens, C., et al., "Tethering of Proteins to RNAs by Bacteriophage Proteins," Biol. Cell, 100:125-138 (2008).
Khalil, A. S., et al., "Synthetic Biology: Applications Come of Age," Nat. Rev. Genet. 11(5):367-379 (2010).
Kim, Y.G., et al., "Hybrid Restriction Enzymes: Zinc Finger Fusions to Fok I Cleavage Domain," Proc. Natl. Acad. Sci. USA 93:1156-1160 (1996).
King, N. M.P., et al., "En Route to Ethical Recommendations for Gene Transfer Clinical Trials," Mol. Ther. 16(3):432-438 (2008).
Kleinstiver, B.P., et al., "Broadening the Targeting Range of *Staphylococcus aureus* CRISPR-Cas9 by Modifying PAM Recognition," Nat. Biotechnol. 33(12):1293-1298 (2015).
Kleinstiver, B.P., et al., "Engineered CRISPR-Cas9 Nucleases with Altered PAM Specificities," Nature 523(7561):481-485 (2015).
Kleinstiver, B.P., et al., "High-Fidelity CRISPR-Cas9 Nucleases with No Detectable Genome-Wide Off-Target Effects," Nature 529(7587):490-495 (2016).
Komor, A.C., et al., "Programmable Editing of a Target Base in Genomic DNA Without Double-Stranded DNA Cleavage," Nature 533(7603):420-424 (2016).
Kosuri, S., et al., "A Scalable Gene Synthesis Platform Using High-Fidelity DNA Microchips," Nat. Biotechnol. 28(12):1295-1299 (2010).
Lambowitz, A. M., et al., "Group II Introns: Mobile Ribozymes that Invade DNA," Cold Spring Harb. Perspect. Biol. 3:a003616 (2011).
Langmead, B., et al., "Ultrafast and Memory-Efficient Alignment of Short DNA Sequences to the Human Genome," Genome Biology 10(3):R25 (2009).
Lee, J.H., et al., "A Robust Approach to Identifying Tissue-Specific Gene Expression Regulatory Variants Using Personalized Human Induced Pluripotent Stem Cells," PLoS Genetics 5(11):e1000718 (2009).
Lee, J., et al., "Non-Endocytic Delivery of Functional Engineered Nanoparticles into the Cytoplasm of Live Cells Using a Novel, High-Throughput Microfluidic Device," Nano Lett. 12(12):6322-6327 (2012).
Li, G.M., "Mechanisms and Functions of DNA Mismatch Repair," Cell Res. 18(1):85-98 (2008).
Li, T., et al., "TAL Nucleases (TALNs): Hybrid Proteins Composed of TAL Effectors and Fokl DNA-Cleavage Domain," Nucl. Acids Res.39(1): 359-372 (2011).
Li, H., et al., "In Vivo Genome Editing Restores Hemostasis in a Mouse Model of Hemophilia," Nature 475(7355):217-221 (2011).

(56) References Cited

OTHER PUBLICATIONS

Li, T., et al., "Modularly Assembled Designer TAL Effector Nucleases for Targeted Gene Knockout and Gene Replacement in Eukaryotes," Nucl. Acids Res. 39(14):6315-6325 (2011).
Lombardo, A., et al., "Gene Editing in Human Stem Cells Using Xinc Finger Nucleases and Integrase-Defective Lentiviral Vector Delivery," Nat. Biotechnol. 25(11):1298-1306 (2007).
Lorenz, R., et al., "ViennaRNA Package 2.0," Algorithms for Molecular Biology 6:26 (2011).
Maeder, M. L., et al., "CRISPR RNA-Guided Activation of Endogenous Human Genes," Nat. Methods 10:977-979 (2013).
Maeder, M. L., et al., "Rapid "Open-Source" Engineering of Customized Zinc-Finger Nucleases for Highly Efficient Gene Modification," Mol. Cell 31(2):294-301 (2008).
Makarova, K. S., et al., "A Putative RNA-lnterference-Based Immune System in Prokaryotes Computational Analysis of the Predicted Enzymatic Machinery, Functional Analogies with Eukaryotic RNAi, and Hypothetical Mechanisms of Action," Biol. Direct. 1:7 (2006).
Makarova, K. S., et al., "Unification of Cas Protein Families and a Simple Scenario for the Origin and Evolution of CRISPR-Cas Systems," Biol. Direct 6:38 (2011).
Makarova, K.S., et al., "Evolution and Classification of the CRISPR-Cas Systems," Nat. Rev. Microbiol. 9(6):467-477 (2011).
Mali, P., et al., "CAS9 Transcriptional Activators for Target Specificity Screening and Paired Nickases for Cooperative Genome Engineering," Nat. Biotechnol. 31:833-838 (2013).
Mali, P., et al., "Cas9 as a Versatile Tool for Engineering Biology," Nat. Methods 10(10):957-963 (2013).
Mali, P., et al., "RNA-Guided Human Genome Engineering Via Cas9," Science 339(6121):823-826 (2013).
Mantovani, R., et al., "The Effects of HPFH Mutations in the Human Gamma-Globin Promoter on Binding of Ubiquitous and Erythroid Specific Nuclear Factors," Nucleic Acids Res. 16(16):7783-7797 (1988).
Marteijn, J.A., et al., "Understanding Nucleotide Excision Repair and Its Role in Cancer and Ageing," Nat. Rev. Mol. Cell Biol. 15(7):465-481 (2014).
Mathews, D. H., et al., "Expanded Sequence Dependence of Thermodynamic Parameters Improves Prediction of RNA Secondary Structure," J. Mol. Biol. 288:911-940 (1999).
Miller, J. C., et al., "An Improved Zinc-Finger Nuclease Architecture for Highly Specific Genome Editing," Nat. Biotechnol. 25:778-785 (2007).
Miller, J. C., et al., "A TALE Nuclease Architecture for Efficient Genome Editing," Nat. Biotechnol. 29(2):143-150 (2011).
Miyagishim M., et al., "U6 Promoter-Driven siRNAs with Four Uridine 3' Overhangs Efficiently Suppress Targeted Gene Expression in Mammalian Cells," Nat. Biotechnol. 20(5):497-500 (2002).
Moscou, M. J., et al., "A Simple Cipher Governs DNA Recognition by TAL Effectors," Science 326(5959):1501 (2009).
Myers, E. W., et al., "Optimal Alignments in Linear Space," Comput. Appl. Biosci. 4(1):11-17 (1988).
Nakamura, Y., et al., "Codon Usage Tabulated From International DNA Sequence Databases: Status for the Year 2000," Nucl. Acids Res. 28(1):292 (2000).
Needleman, S. B., et al., "A General Method Applicable to the Search for Similarities in the Amino Acid Sequence of Two Proteins," J. Mol. Biol. 48(3):443-453 (1970).
Nishimasu, H., et al., "Crystal Structure of Cas9 in Complex with Guide RNA and Target DNA," Cell 156(5):935-949 (2014).
Nishimasu, H., et al., "Crystal Structure of *Staphylococcus aureus* Cas9," Cell 162:1113-1126 (2015).
Pattanayak, V., et al., "High-Throughput Profiling of Off-Target DNA Cleavage Reveals RNA-Programmed Cas9 Nuclease Specificity," Nat. Biotechnol. 31:839-843 (2013).
Pattanayak, V., et al., "Revealing Off-Target Cleavage Specificities of Zinc-Finger Nucleases by In Vitro Selection," Nat. Methods 8:765-770 (2011).
Patterson, S. S., et al., "Codon Optimization of Bacterial Luciferase (lux) for Expression in Mammalian Cells," J. Ind. Microbio. Biotechnology 32:115-123 (2005).
Pearson, W. R., et al., "Improved Tools for Biological Sequence Comparison," Proc. Natl. Acad. Sci. U.S.A. 85(8):2444-2448 (1988).
Perez, E. E., et al., "Establishment of HIV-1 Resistance in CD4+ T Cells by Genome Editing Using Zinc-Finger Nucleases," Nat. Biotechnol. 26:808-816 (2008).
Porteus, M. H., et al., "Gene Targeting Using Zinc Finger Nucleases," Nat. Biotechnol. 23(8):967-973 (2005).
Pougach, K., et al., "Transcription, Processing and Function of CRISPR Cassettes in *Escherichia coli*," Mol. Microbiol. 77(6):1367-1379 (2010).
Pride, D. T., et al., "Analysis of *Streptococcal* CRISPRs from Human Saliva Reveals Substantial Sequence Diversity Within and Between Subjects Over Time," Genome Res. 21:126-136 (2011).
Purnick, P. E. M., et al., "The Second Wave of Synthetic Biology: From Modules to Systems," Nat. Rev. Mol. Cell Biol. 10(6):410-422 (2009).
Qi, L. S., et al., "Repurposing CRISPR as an RNA-Guided Platform for Sequence-Specific Control of Gene Expression," Cell 152:1173-1183 (2013).
Qi, L., et al., "RNA Processing Enables Predictable Programming of Gene Expression," Nat. Biotechnol. 30(10):1002-1007 (2012).
Quinlan, A. R., et al., "BEDTools: A Flexible Suite of Utilities for Comparing Genomic Features," Bioinformatics 26(6):841-842 (2010).
Ran, F.A., et al., "Double Nicking by RNA-Guided CRISPR Cas9 for Enhanced Genome Editing Specificity," Cell 154(6):1380-1389 (2013).
Rand, T. A., et al., "Argonaute2 Cleaves the Anti-Guide Strand of siRNA During RISC Activation," Cell 123:621-629 (2005).
Raymond, C. S., et al., "High-Efficiency FLP and PhiC31 Site-Specific Recombination in Mammalian Cells," PLoS One 2(1):e162 (2007).
Rebar, E. J., et al., "Zinc Finger Phage: Affinity Selection of Fingers with New DNA-Binding Specificities," Science 263(5147):671-673 (1994).
Rebar, E. J., et al., "Induction of Angiogenesis in a Mouse Model Using Engineered Transcription Factors," Nat. Med. 8(12):1427-1432 (2008).
Recht, M. I., et al., "Monitoring Assembly of Ribonucleoprotein Complexes by Isothermal Titration Calorimetry," Methods in Mol. Biol. 488:117-127 (2008).
Regalado, A., "Who Owns the Biggest Biotech Discovery of the Century?," MIT Technology Review, Dec. 4, 2014, http://www.technologyreview.com/featuredstory/532796/who-owns-the-biggest--biotech-discovery-of-the-century/.
Reyon, D., et al., "FLASH Assembly of TALENs for High-Throughput Genome Editing," Nat. Biotech. 30:460-465 (2012).
Rho, M., et al. "Diverse CRISPRs Evolving in Human Microbiomes." PLoS Genetics 8(6):e1002441 (2012).
Sander, J. D., et al., "Zinc Finger Targeter (ZiFiT): An Engineered Zinc Finger/Target Site Design Tool," Nucleic Acids Res. 35:W599-W605 (2007).
Sander, J. D., et al., "ZiFiT (Zinc Finger Targeter): An Updated Zinc Finger Engineering Tool," Nucleic Acids Res. 38:W462-468 (2010).
Sander, J. D., et al., "CRISPR-Cas Systems for Editing, Regulating and Targeting Genomes," Nat. Biotechnol. 32(4):347-355 (2014).
Sanders, R., "Cheap and Easy Technique to Snip DNA Could Revolutionize Gene Therapy", Berkeley News Online, pp. 1-3 (Jan. 7, 2013).
Sanjana, N. E., et al., "A Transcription Activator-Like Effector (TALE) Toolbox for Genome Engineering," Nat. Protoc. 7(1):171-192 (2012).
Sankaran, V. G., et al., "Human Fetal Hemoglobin Expression is Regulated by the Developmental Stage-Specific Repressor BCL11 A," Science 322(5909):1839-1842 (2008).
Sapranauskas, R., et al., "The *Streptococcus thermophilus* CRISPR-Cas System Provides Immunity in *Escherichia coli*," Nucl. Acids Res.39:9275-9282 (2011).
Schramm, L., et al., "Recruitment of RNA Polymerase III to Its Target Promoters," Genes Devel. 16:2593-2620 (2002).

(56) References Cited

OTHER PUBLICATIONS

Selleck, W., et al., "Biophysical Characterization and Direct Delivery of S. Pyogenes Cas9 Ribonucleoprotein Complexes," Editas Medicine, Apr. 27, 2015, retrieved from URL"http://www.editasmedicine.com/documents/ASGCT_poster_2015_Will.pdf.
Shanks, P., "Crispr Opportunities . . . For What? And for Whom?," Biopolitical Times, Dec. 4, 2014, http://www.biopoliticaltimes.org/article.php?id=8235.
Sharma, R., et al., "In Vivo Genome Editing of the Albumin Locus as a Platform for Protein Replacement Therapy," Blood 126(15):1777-1784 (2015).
Shayakhmetov, D. M., et al., "Analysis of Adenovirus Sequestration in the Liver, Transduction of Hepatic Cells, and Innate Toxicity after Injection of Fiber-Modified Vectors," J. Virol. 78(10):5368-5381 (2004).
Shen, B., et al., "Generation of Gene-Modified Mice via Cas9/RNA-Mediated Gene Targeting," Cell Res. 23:720-723 (2013).
Smith, T. F., et al., "Comparison of Biosequences," Adv. Appl. Math. 2(4):482-489 (1981).
Sontheimer, E., "Project 7: Establishing RNA-Directed DNA Targeting in Eukaryotic Cells Project dates: Nov. 16, 2011 to Dec. 31, 2012," Physical Sciences—Oncology Center (Feb. 4, 2012).
Sternberg, S.H., et al., "DNA Interrogation by the CRISPR RNA-Guided Endonuclease Cas9," Nature 507(7490):62-67 (2014).
Sugimoto, N., et al., "Thermodynamic Parameters to Predict Stability of RNA/DNA Hybrid Duplexes," Biochem. 34:11211-11216 (1995).
Sugimoto, N., et al., "Thermodynamics-Structure Relationship of Single Mismatches in RNA/DNA Duplexes," Biochem. 39(37):11270-11281 (2000).
Superti-Furga, G., et al., "The −117 Mutation in Greek HPFH Affects the Binding of Three Nuclear Factors to the CCAAT Region of the Gamma-Globin Gene," EMBO J. 7(10):3099-3107 (1988).
Szczepek, M., et al., "Structure-Based Redesign of the Dimerization Interface Reduces the Toxicity of Zinc-Finger Nucleases," Nat. Biotechnol. 25:786-793 (2007).
Terns, M. P., et al., "CRISPR-based Adaptive Immune Systems," Curr. Opin. Microbiol. 14:321-327 (2011).
Thein, S.L., et al., "Control of Fetal Hemoglobin: New Insights Emerging from Genomics and Clinical Implications," Hum. Mol. Genet. 18(R2):R216-R223 (2009).
Thurman, R. E., et al., "The Accessible Chromatin Landscape of the Human Genome," Nature 489(7414):75-82 (2012).
Tolia, N. H., et al., "Slicer and the Argonautes," Nat. Chem. Biol. 3(1):36-43 (2007).
Tolpin, Thomas W., Third Party Observation for EP13793997.1, Jan. 6, 2015, 50 pages.
Tsai, S. Q., et al., "Dimeric CRISPR RNA-Guided FokI Nucleases for Highly Specific Genome Editing," Nat. Biotechnol. 32(6):569-576 (2014).
Tsai, S.Q., et al., "Open-Source GuideSeq Software for Analysis of GUIDE-Seq Data," Nat. Biotechnol. 34(5):483 (2016).
Urnov, F. D., et al., "Highly Efficient Endogenous Human Gene Correction Using Designed Zinc-Finger Nucleases," Nature 435:646-651 (2005).
Van Der Oost, J., "New Tool for Genome Surgery," Science 336:768-768 (2013).
Van Der Ploeg, J. R., "Analysis of CRISPR in *Streptococcus* Mutans Suggests Frequent Occurrence of Acquired Immunity Against Infection by M102-Like Bacteriophages," Microbiology 155:1966-1976 (2009).
Waber, P.G., et al., "Concordance of a Point Mutation 5' to the A Gamma-Globin Gene with A Gamma Beta + Hereditary Persistence of Fetal Hemoglobin in Greeks," Blood 67(2):551-554 (1986).
Wang, H., et al., "One-Step Generation of Mice Carrying Mutations in Multiple Genes By CRISPR/Cas-Mediated Genome Engineering," Cell 153(4):910-918 (2013).
Wang, J., et al., "Homology-Driven Genome Editing in Hematopoietic Stem and Progenitor Cells Using ZFN mRNA and AAV6 Donors," Nat. Biotechnol. 33(12):1256-1263 (2015).

Wang, J., et al., "Highly Efficient Homology-Driven Genome Editing in Human T Cells by Combining Zinc-Finger Nuclease mRNA and AAV6 Donor Delivery," Nucleic Acids Res. 44(3):e30 (2016).
Wang, T., et al., "Genetic Screens in Human Cells Using the CRISPR-Cas9 System," Science 343(6166):80-84 (2013).
Wiedenheft, B., et al., "RNA-Guided Genetic Silencing Systems in Bacteria and Archaea," Nature 482:331-338 (2012).
Wu, X., et al., "Genome-Wide Binding of the CRISPR Endonuclease Cas9 in Mammalian Cells," Nat. Biotechnol. 32(7):670-676 (2014).
Wu, Y., et al., "Correction of a Genetic Disease in Mouse via Use of CRISPR-Cas9," Cell Stem Cell 13(6):659-662 (2013).
Xiao, A., et al., "CasOT: A Genome-Wide Cas9/gRNA Off-Target Searching Tool," Bioinformatics 30(8):1180-1182 (2014).
Xu, Q., et al., "Design of 240,000 Orthogonal 25mer DNA Barcode Probes," Proc. Natl. Acad. Sci.106(7):2289-2294 (2009).
Xu, J., et al., "Transcriptional Silencing of {Gamma}-Globin by BCL11A Involves Long-Range Interactions and Cooperation with SOX6," Genes Dev. 24(8):783-798 (2010).
Yang, H., et al., "One-Step Generation of Mice Carrying Reporter and Conditional Alleles by CRISPR/Cas-Mediated Genome Engineering," Cell 154(6):1370-1390 (2013).
Zetsche, B., et al., "A Split-Cas9 Architecture for Inducible Genome Editing and Transcription Modulation," Nat. Biotechnol. 33(2):139-142 (2015).
Zou, J., et al., "Gene Targeting of a Disease-Related Gene in Human Induced Pluripotent Stem and Embryonic Stem Cells," Cell Stem Cell 5(1):97-110 (2009).
Zou, J., et al., "Site-Specific Gene Correction of a Point Mutation in Human iPS Cells Derived from an Adult Patient with Sickle Cell Disease," Blood 118(17):4599-4608 (2011).
European Patent Office, International Search Report and Written Opinion dated Jun. 24, 2015 for PCT/US2015/019064.
European Patent Office, International Search Report and Written Opinion dated Jul. 1, 2015 for PCT/US2015/019790.
European Patent Office, International Search Report and Written Opinion dated Sep. 28, 2015 for PCT/US2015/022856.
European Patent Office, International Search Report and Written Opinion dated Jul. 31, 2015 for PCT/US2015/022851.
European Patent Office, International Search Report and Written Opinion dated Aug. 10, 2015 for PCT/US2015/023906.
European Patent Office, International Search Report and Written Opinion dated Jul. 28, 2016 for PCT/US2016/029252.
European Patent Office, Examination Report for EP 13824232.6, dated Dec. 16, 2014, 4 pages.
United States Patent and Trademark Office, International Search Report and Written Opinion for PCT/US2013/075317, dated Apr. 15, 2014, 12 pages.
United States Patent and Trademark Office, International Search Report and Written Opinion for PCT/US2013/075326, dated Aug. 22, 2014, 13 pages.
United States Patent and Trademark Office, International Search Report and Written Opinion for PCT/US2014/027335, dated Jul. 16, 2014, 13 pages.
United States Patent and Trademark Office, International Search Report and Written Opinion for PCT/US2014/028630, dated Jul. 24, 2014, 9 pages.
United States Patent and Trademark Office, Invitation to Pay Additional Fees and, Where Applicable, Protest Fee for PCT/US2014/029068, Aug. 20, 2014, 3 pages.
United States Patent and Trademark Office, Office Action for U.S. Appl. No. 14/319,380, dated Jan. 28, 2015, 47 pages.
United States Patent and Trademark Office, Office Action for U.S. Appl. No. 14/319,530, dated Apr. 1, 2015, 23 pages.
Bothmer, A., et al., "Characterization of the Interplay Between DNA Repair and CRISPR/Cas9-Induced DNA Lesions at an Endogenous Locus," Nat. Commun. 8:13905 (2017).
Canver, M. C., et al., "BCL11A Enancer Dissection by Cas9-Mediated In Situ Saturating Mutagenesis," Nature 527(7577):192-197 (2015).
Chang, K.H., et al., "Long-Term Engraftment and Fetal Globin Induction upon BCL11A Gene Editing in Bone-Marrow-Derived CD34+ Hematopoietic Stem and Progenitor Cells," Mol. Ther. Methods Clin. Dev. 4:137-148 (2017).

(56) References Cited

OTHER PUBLICATIONS

Chen, F., et al., "Targeted Activation of Diverse CRISPR-Cas Systems for Mammalian Genome Editing Via Proximal CRISPR Targeting," Nat. Commun. 8:14958 (2017).
Dever, D. P., et al., "CRISPR/Cas9 Beta-Globin Gene Targeting in Human Haematopoietic Stem Cells," Nature 539:384-389 (2016).
European Patent Office, International Search Report and Written Opinion dated May 29, 2017 for PCT/US2017/022377.
Hinz, J. M., et al., "Nucleosomes Selectively Inhibit Cas9 Off-Target Activity at a Site Located at the Nucleosome Edge," J. Biol. Chem. 291 (48):24851-24856 (2016).
Ran, F. A., et al., "In Vivo Genome Editing Using *Staphylococcus aureus* Cas9," Nature 520(7546):186-191 (2015).
Richardson, C. D., et al., "Enhancing Homology-Directed Genome Editing by Catalytically Active and Inactive CRISPR-Cas9 Using Asymmetric Donor DNA," Nat. Biotechnol. 34(3):339-344 (2016).
Traxler, E. A., et al., "A Genome-Editing Strategy to Treat Beta-Hemoglobinopathies that Recapitulates a Muation Associated with a Benign Genetic Condition," Nat. Med. 22(9):987-990 (2016).
Zetsche, B., et al., "Cpf1 Is a Single RNA-Guided Endonuclease of a Class 2 CRISPR-Cas System," Cell 163(3):759-771 (2015).
Joung, J., et al., "Genome-Scale CRISPR-Cas9 Knockout and Transcriptional Activation Screening," Nat. Protoc. 12(4):828-863 (2017).
Kurita, R., et al., "Establishment of Immortalized Human Erythroid Progenitor Cell Lines Able to Produce Enucleated Red Blood Cells," PLoS One 8(3):e59890 (2013).
Martyn, G.E., et al., "The Regulation of Human Globin Promoters by CCAAT Box Elements and the Recruitment of NF-Y," Biochim. Biophys. Acta 1860(5):525-536 (2017).
Koike-Yusa, H., et al., "Genome-Wide Recessive Genetic Screening in Mammalian Cells with a Lentiviral CRISPR-Guide RNA Library," Nat. Biotechnol. 32(3):267-273 (2014).
Shalem, O., et al., "Genome-Scale CRISPR-Cas9 Knockout Screening in Human Cells," Science 343:84 (2014).
Sather, B. D., et al., "Efficient Modification of CCR5 in Primary Human Hematopoietic Cells Using a Mega TAL Nuclease and AAV Donor Template," Sci. Trans. Med. 7(307):307ra156 (2015).
Shmakov, S., et al., "Discovery and Functional Characterization of Diverse Class 2 CRISPR-Cas Systems," Mol. Cell 60(3):385-397 (2015).
Smith, C., et al., "Efficient and Allele-Specific Genome Editing of Disease Loci in Human iPSCs," Mol. Ther. 23(3):570-577 (2015).
Traxler, E., et al., "Genome Editing Recreates Hereditary Persistence of Fetal Hemoglobin in Primary Human Erythroblasts," Blood J. 126(23):640 (2015).
Yamano, T., et al., "Crystal Structure of Cpf1 in Complex with Guide RNA and Target DNA," Cell 165(4):949-962 (2016).
European Patent Office, International Search Report and Written Opinion dated Jun. 12, 2017 for PCT/US2017/024163.
Amrani, N., et al., "NmeCas9 is an Intrinsically High-Fidelity Genome-Editing Platform," Genome Biol. 19:214 (2018).
Burstein, D., et al., "New CRISPR-Cas Systems from Uncultivated Microbes," Nature 542(7640):237-241 (2017).
Cassini, A., et al., "A Highly Specific SpCas9 Variant is Identified by In Vivo Screening in Yeast," Nat. Biotechnol. 36(3):265-271 (2018).
Chandrakasan, S., et al., "Gene Therapy for Hemoglobinopathies: The State of the Field and the Future," Hematol. Oncol. Clin. North Am. 28(2): 199-216 (2014).
Chen, J. S., et al., "Enhanced Proofreading Governs CRISPR-Cas9 Targeting Accuracy," Nature 550(7676):407-410 (2017).
Fu, Y., et al., "Targeted Genome Editing in Human Cells Using CRISPR/Cas Nucleases and Truncated Guide RNAs," Methods Enzymol. 546:21-45 (2014).
Giarratana, M. C., et al., "Proof of Principle for Transfusion of In Vitro-Generated Red Blood Cells," Blood 118(19):5071-5079 (2011).

Huang, X., et al., "Production of Gene-Corrected Adult Beta Globin Protein in Human Erythrocytes Differentiated from Patient iPSCs After Genome Editing of the Sickle Point Mutation," Stem Cells 33:1470-1479 (2015).
Hyun, P. S., et al., "Therapeutic CRISPR/Cas9 Genome Editing for Treating Sickle Cell Disease," Blood 128(22):4703 (2016).
Karvelis, T., et al., "crRNA and tracrRNA Guide Cas9-Mediated DNA Interference in *Streptococcus thermophilus*," RNA Biol. 10(5):841-851 (2013).
Kim, H.S., et al., "Problems Encountered in Detecting a Targeted Gene by the Polymerase Chain Reaction," Gene 103:227-233 (1991).
Kim, E., et al., "In Vivo Genome Editing with a Small Cas9 Orthologue Derived from Campylobacter Jejuni," Nat. Commun. 8:14500 (2017).
Lee, J. K., et al., "Directed evolution of CRISPR-Cas9 to Increase Its Specificity," Nat. Commun. 9:3048 (2018).
Liang, P., et al., "CRISPR/Cas9-Mediated Gene Editing in Human Tripronuclear Zygotes," Protein Cell 6(5):363-372 (2015).
Nishimasu, H., et al., "Engineered CRISPR-Cas9 Nuclease with Expanded Targeting Space," Science 361 (6408): 1259-1262 (2018).
Notta, F., et al., "Isolation of Single Human Hematopoietic Stem Cells Capable of Long-Term Multilineage Engraftment," Science 333(6039):218-221 (2011).
Ou, Z., et al., "The Combination of CRISPR/Cas9 and iPSC Technologies in the Gene Therapy of Human Beta-Thalassemia in Mice," Scientific Reports 6(1):32463 (2016).
Pellissier, L. P., et al., "Specific Tools for Targeting and Expression in Muller Glial Cells," Mol. Ther. Methods Clin. Dev. 1:14009 (2014).
Peng, R., et al., "Potential Pitfalls of CRISPR/Cas9-Mediated Genome Editing," FEBS J. 283:1218-1231 (2016).
Song, B., et al., "Improved Hematopoietic Differentiation Efficiency of Gene-Corrected Beta-Thalassemia Induced Pluripotent Stem Cells by CRISPR/Cas9 System," Stem Cells Devel. 24(9):1053-1065 (2015).
Strecker, J., et al., "Engineering of CRISPR-Cas12b for Human Genome Editing," Nat. Commun. 10:212 (2019).
Tang, L., et al., "CRISPR/Cas9-Mediated Gene Editing in Human Zygotes Using Cas9 Protein," Mol. Genet. Genom. 292(3):525-533 (2017).
Teng, F., et al., "Repurposing CRISPR-Cas12b for Mammalian Genome Engineering," Cell Discov. 4:63 (2018).
Thorpe, S. J., et al., "Immunochemical Estimation of Haemoglobin Types in Red Blood Cells by FACS Analysis," Br. J. Haematol. 87:125-132 (1994).
Truong, L. N., et al., "Microhomology-Mediated End Joining and Homologous Recombination Share the Initial End Resection Step to Repair DNA Double-Strand Breaks in Mammalian Cells," PNAS 110(19):7720-7725 (2013).
Van Overbeek, M., et al., "DNA Repair Profiling Reveals Nonrandom Outcomes at Cas9-Mediated Breaks," Mol. Cell 63:633-646 (2016).
Wang, J., et al., "xCas9 Expands the Scope of Genome Editing with Reduced Efficiency in Rice," Plant Biotechnol. J. 17:709-711 (2019).
Xu, P., et al., "Both TALENs and CRISPR/Cas9 Directly Target the HBB IVS2-654 (C>T) Mutation in Beta-Thalassemia-Derived iPSCs," Scientific Reports 5:12065 (2015).
Yan, W. X., et al., "Functionally Diversse Type V CRISPR-Cas Systems," Science 363:88-91 (2019).
European Patent Office, International Search Report and Written Opinion dated Aug. 20, 2018 for PCT/US2018/022516.
European Patent Office, International Search Report and Written Opinion dated Dec. 3, 2018 for PCT/US2018/032172.
European Patent Office, International Search Report and Written Opinion dated Mar. 13, 2019 for PCT/US2018/059700.
Cramer, M. L., et al., "Induction of T-Cell Infiltration and Programmed Death Ligand 2 Expression by Adeno-Associated Virus in Rhesus Macaque Skeletal Muscle and Modulation by Prednisone," Hum. Gene Ther. 28(6):493-509 (2017).
Ding, Q., et al., "Enhanced Efficiency of Human Pluripotent Stem Cell Genome Editing Through Replacing TALENs with CRISPRs," Cell Stem Cell 12:393-394 (2013).

(56) References Cited

OTHER PUBLICATIONS

Guo, Q., et al., "'Cold shock' increases the frequency of homology directed repair gene editing in induced pluripotent stem cells," Sci. Rep. 8(1):2080 (2018).
Heintze, J., et al., "A CRISPR CASe for High-Throughput Silencing," Front. Genet. 4(193):1-6 (2013).
Hoban, M. D., et al., "A genome editing primer for the hematologist," Blood 127(21):2525-2535 (2016).
Kumar, S. R.P., et al., "Clinical development of gene therapy: results and lessons from recent successes," Mol. Ther. Methods Clin. Dev. 3:16034 (2016).
Lederer, C. W., et al., "Beta Testing: Preclinical Genome Editing in Beta-Globin Disorders," Cell Gene Therapeutic Insights 1(2):231-242 (2015).
Lidonnici, M. R., et al., "Gene Therapy and Gene Editing Strategies for Hemoglobinopathies," Blood Cells, Molecules & Diseases 70:87-101 (2018).
Mukherjee-Clavin, B., et al., "Current Approaches for Efficient Genetic Editing in Human Pluripotent Stem Cells," Front. Biol. 8(5):461-467 (2013).
Sobrevals, L., et al., "AAV Vectors Transduce Hepatocytes In Vivo as Efficiently in Cirrhotic as in Healthy Rat Livers," Gene Ther. 19:411-417 (2012).
Wu, Y., et al., "Highly Efficient Therapeutic Gene Editing of Human Hematopoietic Stem Cells," Nat. Med. 25(5)776-783 (2019).
Zetsche, B., et al., "Multiplex Gene Editing by CRISPR-Cpf1 Through Autonomous Processing of a Single crRNA Array," Nat. Biotechnol. 35(1):31-34 (2017).
European Patent Office, International Search Report and Written Opinion dated Jul. 1, 2019 for PCT/US2019/022360.
Bothmer, A., et al., "Detection and Modulation of DNA Translocations During Multi-Gene Genome Editing in T Cells," The CRISPR Journal 3(3):177-187 (2020).
Cost, G. J., et al., Geneseq Accession No. BBD49192 (2014), 2 pages.
De Dreuzy, E., et al., "EDIT-301: An Experimental Autologous Cell Therapy Comprising Cas12a-RNP Modified mPB-CD34+ Cells for the Potential Treatment of SCD," Blood 134(Suppl. 1):4636 (2019).
De Dreuzy, E., et al., "Robust Pre-Clinical Results and Large-Scale Manufacturing Process for Edit-301: An Autologous Cell Therapy for the Potential Treatment of SCD," Blood 136(Suppl. 1):45-46 (2020).

Fu, B. X. H., et al., "Landscape of Target: Guide Homology Effects on Cas9-Mediated Cleavage," Nucl. Acids Res. 42(22): 13778-13787 (2014).
Giannoukos, G., et al., "UDiTaS™, a genome editing detection method for indels and genome rearrangements," BMC Genomics 19:212 (2018).
Giarratana, M. C., et al., "Ex vivo generation of fully mature human red blood cells from hematopoietic stem cells," Nat. Biotechnol. 23(1):69-74 (2005).
Heath, J., et al., "EDIT-301: An Autologous Cell Therapy to Promote Fetal Hemoglobin Expression for the Potential Treatment of Sickle Cell Disease," Hemasphere 4(S1):S292 (2020).
Hu, X., "CRISPR/Cas9 System and Its Applications in Human Hematopoietic Cells," Blood Cells, Molecules & Diseases 62:6-12 (2016).
Kleinstiver, B. P., et al., "Engineered CRISPR-Cas12a variants with increased activities and improved targeting ranges for gene, epigenetic and base editing," Nat. Biotechnol. 37(3):276-282 (2019).
Kosicki, M., et al., "Repair of Double-Strand Breaks Induced by CRISPR-Cas9 Leads to Large Deletions and Complex Rearrangements," Nat. Biotechnol. 36(8):765-771 (2018).
Krieg, A. M., et al., GeneSeq Accession No. BAY71542 (2013).
Metais, J.Y., et al., "Genome Editing of HBG1 and HBG2 to Induce Fetal Hemoglobin," Blood Adv. 3(21):3379-92 (2019).
Pausch, P., et al., "CRISPR-Casϕ from Huge Phages is a Hypercompact Genome Editor," Science ;369(6501):333-337 (2020).
Reeks, J., et al., "Structure of a Dimeric Crenarchaeal Cas6 Enzyme with an Atypical Active Site for CRISPR RNA Processing," Biochem. J. 452:223-230 (2013).
Strohkendl, I., et al., "Kinetic Basis for DNA Target Specificity of CRISPR-Cas12a," Mol Cell. 71(5):816-824 (2018).
Swarts, D. C., et al., "Cas9 Versus Cas12a/Cpf1: Structure-Function Comparisons and Implications for Genome Editing," WIREs RNA 9:e1481 (2018).
Vidigal, J. A., et al.,"Rapid and Efficient One-Step Generation of Paired gRNA CRISPR-Cas9 Libraries," Nat. Commun. 6:8083 (2015).
European Patent Office, International Search Report and Written Opinion dated Mar. 6, 2020 for PCT/US2019/063766, 12 pages.
European Patent Office, International Search Report and Written Opinion dated Apr. 13, 2021 for PCT/US2020/063854, 18 pages.

* cited by examiner

Fig. 1G

Alignment

S. pyogenes      5'-NNNNNNNNNNNNNNNNNNNNGUUUACAGCUAUGCUGUUUG-3'    (SEQ ID NO:50)
S. thermophilus  5'-NNNNNNNNNNNNNNNNNNNNGUUUAAGAGCUGUGUUGUUUCG-3'  (SEQ ID NO:51)
                    ********************      * *** *  *  ******  *

S. pyogenes      5'-GAACCAUUCAAAACAGCAUAGCAAGUUAAAAUAAGGCUAGUCCGUUAUCAACUUGAAAAAGUGGCACCGAGUCGGUGCUUUU-3'     (SEQ ID NO:52)
S. thermophilus  5'------GGCGAACAACACAGCGAGUUAAAAUAAGGCUUAGUCCGUACUCAACUUGAAAAGUGGCACCGAUUCGGUGUUUU---3'   (SEQ ID NO:53)
                        *    *   **  *************  ***** * ********* ******* ** **

S. pyogenes - cont
S. thermophilus - cont

```
SM   GNSDK--LIPRKTKKFYWDTKKYGGFDSPTVAYSILVIADIERGKSKKLKTVKALVGVTIM
SP   RNSDK--LIARKKD----WDPKKYGGFDSPTVAYSVLVVAKVEKGKSNKLSVRELLGITIM
ST   PNSNEMLVQAKEY----LDPKKYGGYAGISNSFTVLVEGTIEKGAKKITNVLEFQGISIL
LI   GNESK--LIPRKTN----WDPMKYGGLDSPNMAYAVVI--EYAKGRN-KLVFEKKITRVIIM
            *  :       *::* **    .: :.:       : :     :      ::
Motif: -NS---L--*----K----D---KYGG------------*----KG---K*-----**I-*

SM   EKMTFERDPVAFLEREGYRMVQEEHTIKLLPKYSLFKLEMGRKRLLAS------AKELQK
SP   ERGSFEKMPIDFLEAKGYREVKKDLIIKLLPKYSLFELEMGRRRMELAS-----AGELQK
ST   DRINTRKDKLNFLLERGYRDI---ELIIEILPKYSLFELSDGSRRMLASILSTNMRKGEIHK
LI   ERKAFEEDERAFLEEQGTRQP---RVLAKILPKYTLYECEEGRRRMELAS------ANEAQK
       :   :   ::          ::  :***:*     . *:                : :
Motif: *------L-------*---------*LPKY*L*----*Q--R*LAS-------R---*-K SM   GNEIVLPMHLGTLLYHAKNIHKV-------DEPKHLDYVDKHRDEFKELLQVVSNFSKKYT
SP   GNELALPSKYVNFLYLASHYEKLKGSPEDNEQRQL-FVEQHKHYLDEIIEQISEFSKRVI
ST   GNQIFLSQFVKLLVYHAKRISNT-------IMENHRKYVENHKKEFEELFYYILEFMEDYV
LI   GNQQVLPMHLVTLLHHAANCEVS-------DQKSLDYIESNREMFAELLAHVSEFAPKYT
     **    *  : ::                         :   :  *  :     *
Motif: GN*--*L---*--L-*-A-----------------*-------*---F-----*--*-

SM   LAEGNLEKIKELYAQHNGEDLKELASSFI-------NLLTTTAIGAPATPKFFDKNIDR
SP   LADANLDKVLSAYNKHRDKPIREQAEHII-------HLFTLTNLGAPAAPKYFDTIDR
ST   GAKNKGKILNSAPQSWQHSIDELCSSFIGPTGSERKGLFELTSRGSAADPEFLGVNIPR
LI   LAEANLNKIWQLFEQNREGDIKALAQSFV-------DLMAFNAMGAPASFKFFETTIER
      * :: : :  :    :     *  *          :         ** .*     *
Motif: -A--N---I---------------------------*-----G---A--F----*-I-R
```

Fig. 2G

```
SM   KR-YTSTTEILNATLIHQSITGLYETRIDLNKLGGD    (SEQ ID NO: 1)
SP   KR-YTSTKEVLDATLIHQSITGLYETRIDLSQLGGD    (SEQ ID NO: 2)
ST   YRDYIPSSLLKDATLIHQSVTGLYETRIDLAKLGEG    (SEQ ID NO: 3)
LI   KR-YNNLKELLNSTIYQSITGLYESRKRLD----D    (SEQ ID NO: 4)
        *  :  . : :*::*::***::*:  .

Motif: --R--Y------*--*-*T**I*QS*TGLYE*R---L-----
```

Fig. 3A

Alignment of the N terminal BarC-like Domains disclosed in Chylinski et al. (excluding sequence outliers).
CLUSTAL format alignment by MAFFT (v7.0xxb))

| # | Sequence | SEQ ID |
|---|---|---|
| 1 | DIGTNSYGMAVT | (SEQ ID NO: 54) |
| 12 | DIGTNSYGMAVT | (SEQ ID NO: 55) |
| 3 | DVGTNSYGMAVT | (SEQ ID NO: 56) |
| 20 | DVGTNSYGMAVT | (SEQ ID NO: 57) |
| 15 | DMGTNSYGMAVT | (SEQ ID NO: 58) |
| 4 | DVGTNSYGMAVT | (SEQ ID NO: 59) |
| 7 | DIGTASYGMAVT | (SEQ ID NO: 60) |
| 6 | DVGTGSYGMAVT | (SEQ ID NO: 61) |
| 9 | DIGTNSYGMAVT | (SEQ ID NO: 62) |
| 10 | DIGTNSYGMAVT | (SEQ ID NO: 63) |
| 11 | DLGTNSYGMAVL | (SEQ ID NO: 64) |
| 43 | DLATNSYGMAVV | (SEQ ID NO: 65) |
| 40 | DIGTNSYGMAI- | (SEQ ID NO: 66) |
| 42 | DIGTNSIGMALV | (SEQ ID NO: 67) |
| 13 | DIGTNSYGMCVT | (SEQ ID NO: 68) |
| 14 | DIGTSSVGMAVT | (SEQ ID NO: 69) |
| 5 | DMGTGSIGMAVI | (SEQ ID NO: 70) |
| 16 | DIGTASYGMAII | (SEQ ID NO: 71) |
| 8 | DLGTGSYGMAVV | (SEQ ID NO: 72) |
| 17 | DIGIASIGMAIV | (SEQ ID NO: 73) |
| 21 | DLGVGSYGMSIV | (SEQ ID NO: 74) |
| 24 | DLGIASVGMAII | (SEQ ID NO: 75) |
| 25 | DIGVASVGMSIV | (SEQ ID NO: 76) |
| 26 | DIGIASVGMAVV | (SEQ ID NO: 77) |
| 28 | DIGYASIGPAIV | (SEQ ID NO: 78) |
| 29 | DIGIGSIGMSVI | (SEQ ID NO: 79) |
| 32 | DLGVGSIGMSVI | (SEQ ID NO: 80) |
| 33 | DLGVASVGMSVI | (SEQ ID NO: 81) |
| 38 | DVGVGSVGMAVI | (SEQ ID NO: 82) |
| 34 | DIGVGSIGMAVI | (SEQ ID NO: 83) |
| 47 | DYGTNSLGMAIV | (SEQ ID NO: 84) |
| 50 | DLGTNSIGMCLL | (SEQ ID NO: 85) |
| 49 | DIGTDSLGMAVV | (SEQ ID NO: 86) |
| 18 | DIGSNSIGPAVV | (SEQ ID NO: 87) |
| 41 | DLAVGSIGVAVA | (SEQ ID NO: 88) |
| 45 | DLGIASGMGYPP | (SEQ ID NO: 89) |

Alignment of the HNH-like Domains disclosed in Chylinski et al.
(CLUSTAL format alignment by MAFFT (v7.058b))

| | | SEQ ID NO |
|---|---|---|
| 1 | YDIDHIYPRS-LIKD------DSF-DNLVLCERTAN | SEQ ID NO: 178 |
| 2 | -DIDHIYPRSKVIKD------DSF-DNLVLKMEN | SEQ ID NO: 179 |
| 3 | -DRDHIYPQS-KIKD------DSI-DNLVLVNKTYN | SEQ ID NO: 180 |
| 4 | -DIDHIYPRS-KIKD------DSI-TNRVLVEKDIN | SEQ ID NO: 181 |
| 6 | -DIDHIYPQS-KIKD------DSI-SNRVLVCSSCN | SEQ ID NO: 182 |
| 5 | -DIDHIYPQS-KTMD------DSL-SNRVLVKKNYN | SEQ ID NO: 183 |
| 7 | -DQDHIYPKS-KIYD------DSL-ENRVLVKKNLN | SEQ ID NO: 184 |
| 8 | -QIDHIYPQS-LVKD------DSF-DNRVLVVPSEN | SEQ ID NO: 185 |
| 9 | -DIDHIIPQA-FIKD------NSI-DNRVLTSSKEN | SEQ ID NO: 186 |
| 12 | -DIDHIIPQA-FLKD------NSI-DNRVLVSSASN | SEQ ID NO: 187 |
| 16 | -DIDHIIPQA-YTKD------NSI-DNRVLVSNTIN | SEQ ID NO: 188 |
| 11 | -DIDHIYPQS-FITD------MSI-DNRVLTSSAGN | SEQ ID NO: 189 |
| 10 | -DVDHIYPQS-FLKD------DSI-DNRVLTRSDKN | SEQ ID NO: 190 |
| 14 | -NIDHIYPQS-MVKD------DSL-DNRVLVQSEIN | SEQ ID NO: 191 |
| 18 | -DIDHILPQS-LIKD------DSL-DNRVLVNATIN | SEQ ID NO: 192 |
| 19 | -DIDHILPQS-FIKD------DSI-ENRVLVKKAVN | SEQ ID NO: 193 |
| 13 | -EVDHIFPRS-FIKD------DSI-DNRVLVIKMMN | SEQ ID NO: 194 |
| 15 | -EVDHIYPRS-YIKD------DSF-ENRVLVTREEN | SEQ ID NO: 195 |
| 17 | -DIDHIIPQA-VTQN------DSI-DNRVLVARAEN | SEQ ID NO: 196 |
| 22 | -EIDHIIPYS-ISFD------DSS-SNKLLVLAESN | SEQ ID NO: 197 |
| 24 | -EIDHIIPYS-LCPD------DSS-ANRVLVHKQSN | SEQ ID NO: 198 |
| 23 | -EIDHIIPYS-KSMD------DSY-SNRVLVLSGEN | SEQ ID NO: 199 |
| 63 | -DIDHIIPYS-RSPD------DSF-NNRVLVLAEEN | SEQ ID NO: 200 |
| 59 | -EIDHIIPYS-RSPD------DSY-NNRVLVLVFTKQN | SEQ ID NO: 201 |
| 65 | -EIDHALPFS-RTWD------DSY-MNRVLVLTDZN | SEQ ID NO: 202 |
| 64 | -EIDHALPFS-RSPD------DSL-SNKILVLGSEN | SEQ ID NO: 203 |
| 68 | -EIDHALPFS-RTWD------DSF-NNRVLVLGGSN | SEQ ID NO: 204 |
| 69 | -EIDHALPFS-RTWD------DSF-NNRVLVLAEEN | SEQ ID NO: 205 |
| 28 | -EIDHIIPIS-ISLD------DSI-NNRVLVLSAAN | SEQ ID NO: 206 |
| 30 | -EVDHALPYS-RSYD------DSI-TNRVLVTHREN | SEQ ID NO: 207 |
| 62 | -QVDHALPYS-RSYD------DSK-NNRVLVLTHEN | SEQ ID NO: 208 |
| 27 | -EVDHILPLS-ITFD------DSL-ANRVLVTATAN | SEQ ID NO: 209 |
| 26 | -EIDHIIPRS-ISPD------DAR-SNRVLVTREEN | SEQ ID NO: 210 |

```
72  EIDHIYPRS-LSKKHFGVIFNSE-VNLIYCSSQGN  (SEQ ID NO:249)
74  EIDHILPRS-HTLKIYGFVFNPE-GNLIYVHQKCN  (SEQ ID NO:250)
75  ELDHIIPRS-HKKY----GTLNDE-ANLICVTRGDN (SEQ ID NO:251)
34  ELEHIVPHS-FRQS------NAL-SSLVLTWPGVN  (SEQ ID NO:252)
     *:  * *                *           
```

Alignment of the MAM-like Domains disclosed in Chylinski et al. (excluding sequence outliers). (CLUSTAL format alignment by MAFFT (v7.058b))

| | | |
|---|---|---|
| (SEQ ID NO: 288) | (SEQ ID NO: 289) | |
| (SEQ ID NO: 289) | (SEQ ID NO: 290) | |
| (SEQ ID NO: 290) | (SEQ ID NO: 291) | |
| (SEQ ID NO: 291) | (SEQ ID NO: 292) | |
| (SEQ ID NO: 292) | (SEQ ID NO: 293) | |
| (SEQ ID NO: 293) | (SEQ ID NO: 294) | |
| (SEQ ID NO: 294) | (SEQ ID NO: 295) | |
| (SEQ ID NO: 295) | (SEQ ID NO: 296) | |
| (SEQ ID NO: 296) | (SEQ ID NO: 297) | |
| (SEQ ID NO: 297) | (SEQ ID NO: 298) | |
| (SEQ ID NO: 298) | (SEQ ID NO: 299) | |
| (SEQ ID NO: 299) | (SEQ ID NO: 300) | |
| (SEQ ID NO: 300) | (SEQ ID NO: 301) | |
| (SEQ ID NO: 301) | (SEQ ID NO: 302) | |

Fig. 6B

```
44  EIEHIVPKA-RVFDDS--FGNKFLLTPHRIN
20  DKDHIIPQS-MKKDDSIINNLVLVNKNAN
45  QVDHILPWS-RFCDDS-YLNKTLCTARSN
50  DIDHIVPLA-RCGRDS-LDNMVLCQSDAN
46  DMEHTIPKS-ISFDNS--DQNLTLCESYYN
47  DIEHTIPRS-AGGDST--RMNLTLCSSRFN
48  DIEHTIPRS-ISQDNS--QMNKFLCSLAFN
39  DIEHLFPIA-ESEDNC--RMNLVISHSACN
41  DVDHIIPRD-DTADNS-YGNKVVAHRQCN
40  DIEHTVPQS-LQGLST-DYNTTVTLKSVN
35  ELDHIVPRT-DGGSNR-HENLAITCCACN
36  EMDHIVPRKGVGSTNT-KTNFAAVCAEEN
37  BMDHIVPRKGVGSTNT-RVMLAAACAACN
38  EMDHIVPRAGQGSTNT-BENLVAVCHRCN
34  ELEHIVPHS-PRQSNA-LSSLVLTWPGVN
```

Fig. 7A

Sequence alignment between SpCas9 and NmCas9

```
                                                                    Y
NmCas9      MAAFKPNSINYILGLDIGIASVGWAMVEIDEEENPIRLID-------------LGVRVFE
SpCas9      -------MDKKYSIGLDIGTNSVGWAVITDEYKVPSKKFKVLGNTDRHSIKKNLIGALLFD
            ----------*Y-*GLDIG--SVGWA**---*-*-----**----------------*G---*F*

NmCas9      RAEVPKTGDSLAMARRLARSVRRLTRRRAHRLLRTRRLLKREGVLQAA-------------
SpCas9      SGET-------AEATRLKRTARRRYTRRKNRICYLQEIFSNEMAKVDDSFFHRLEESFLV
            --E---------A-A-RL-R*-RR---RR---R*----*-_**--E--------------

NmCas9      ---------------NFDENGLIKSLPNTPWQLRAAALDRK----LTPLEWSAVLLHLIKHR
SpCas9      EEDKKHERHPIFGNIVDEVAYHEKYP-TIYHLRKKLVDSTDKADLRLI-YLALAHMIKFR
            ----------------DE----*--P-T-**LR---*D---------L------L-H*IK-R

NmCas9      GYLSQRKNE----------------------------------GETA---------DKEL---
SpCas9      GHFLIEGDLNPDNSDVDKLFIQLVQTYNQLFEENPINASGVDAKAILSARLSKSRRLENL
            G**----*---------------------------G--A-----------*-L---

NmCas9      ------GALLKGVAGNAHALQTG----DFRTPAE-------LAL---NKFEKESGHIRNQ-RSD
SpCas9      IAQLPGEKKNGLFGNLIALSLGLTPNFKSNFDLAEDAKLQLSKDTYDDDLDNLLAQIGDQ
            -----G---*G*-GN--AL--G---*F**--*------L-L--*-**-*----*--Q---*

NmCas9      YSHTFSR--------------------------------------------KDLQA
SpCas9      YADLFLAAKNLSDAILLSDILRVNTEITKAPLSASMIKRYDEHHQDLTLLKALVRQQLPE
            Y*--F-----------------------------------------**L--

NmCas9      ELILLFEKQKEFGN-PHVSGGLK--------------EGIETL---------LMTQRPA
SpCas9      KYKEIFFDQSKNGYAGYIDGGASQEEFYKFIKPILEKMDGTEELLVKLNREDLLRKQRTF
            *----*F--Q-*-G-*-**-GG---------------*G-E-L---------L--QR--

NmCas9      LSGDAV-QKMLGH---------CTFEPAEP------------KAAKNTYTAERFIWL
SpCas9      DNGSIPHQIHLGELHAILRRQEDFYPFLKDNREKIEKILTFRIPYYVGPLARGNSRFAWM
            --G----Q--LG----------F-P------------------*-----RF-W*

NmCas9      TKLNNLRILEQGSERPLTD--------TERATLMDEPY------RKSKLTYAQAR-------
SpCas9      TRKSEETITPWNFEEVVDKGASAQSFIERMTNFDKNLPNEKVLPKHSLLYEYFTVYNELF
            T*---**--I-----E---*---------ER-T-*D*--------K--L-Y---------

NmCas9      ----KLLGLEDTAFFKGLRY---------GKDN--------------------AEA
SpCas9      KVKYVTEGMRKPAFLSGEQKKAIVDLLFKTNRKVTVKQLKEDYFKKIECFDSVEISGVED
            --------G*----AF*-G-*----------*-----------------------E-

NmCas9      STLMEMKAYHAISRALEKEGLKDKKSPLNLSPELQDEIGTAFSLFKTDEDITGRLKDRIQ
SpCas9      RFNASLGTYHDLLKIIKDKDFLDNEE----NEDILEDIVLTLTLFEDREMIEERLKTYAH
            -----*-*YH-*-*-**-*--D**-----**--**I---***LF*--E-I--RLK---*

NmCas9      P---EILEALLKHISFDKFVQISLKALRRIVPLMEQGKRYDEACAE----IYGDHYGKKNT
SpCas9      LFDDKVMKQLKRRRYTGWGRLSRKLI---------NGIRDKQSGKTILDFLKSDGFANRNF
            ----*-*---LK*---*---*-**S-K-*---------*G-R---**--------*--D-*-*-**N-

NmCas9      EEKI-------Y------------LPPIPADEIRNPVVLRALSQARKVINGVVRRYG-
SpCas9      MQLIHDDSLTFKEDIQKAQVSGQGDSLHEHIANLAGSPAIKKGILQTVKVVDELVKVMGR
            -*-I--------*--------------L----A*-----P-*-*-*-Q*-KV**-*V*--G-

NmCas9      -SPARIHIETARE VGKSFKDRKEIEKRQEENRKDREKAAAKFREYFPNF----VGEPKSK
SpCas9      HKPENIVIEMARE NQTTQKGQKNSRER-------NKRIEEGIKELGSQILKEHPVENTQL
            --P--I-IE-ARE---*-K-*K*--*R-----------**-----**E---**------E-
         B                                       G
NmCas9      DILKLRLYEQQHGKCLYSGKEINLGRLNEKGYVEIDHALPFSRTWDDSFNNKVLVLGSEN
SpCas9      QNEKLYLYYLQNGRDMYVDQELDINRLSD----YDVDHIVPQSFLKDDSIDNKVLTRSDKN
            *--KL-LY--Q-G*--Y--*E***-RL-*----**DH-*P-S--DDS**NKVL-----N

NmCas9      QNKGNQTPYEYFNGKDNSREWQEFKA-RVET-SRFP-RSKKQRILLQKFDEDGFKERNLN
SpCas9      RGKSDNVPSEEVVKKM-KNYWRQLLNAKLITQRKFDNLTKAERGGLSELDKAGFIKRQLV
            *-K--P-E-----K-------W*--**-T--*F----*K-*R--L-**D*-GF-*R*L-
```

Fig. 7B

```
NmCas9    DTRYVNRFLCQFVADRMRLTGKGKKRVF------ASNGQITNLLRGFWGLRKVRAENDRH
SpCas9    ETRQITKHVAQILDSRMNTKYDENDKLIREVKVITLKSKLVSDFRKDPQFYKVREINNYH
          *TR-*-*-*-Q**---RM------*-***------*-*-**---*R---*-*-KVR--N*-H

NmCas9    HALDAVVACSTVAMQQKI---TRFVRYKEMNAFDGKTID----KETGEVLHQKTHFPQP
SpCas9    HHAHDAYLNAVVGTALIKKYPKLESEFVYGDYKVYDVRKMIAKSEQEIGKATAKYFFYSNI
          HH-AD-*-A-----A*-*K---------Y-*-*-*D-*-*------*E-G*---*---*-*-

NmCas9    WEFFAQEVMIRVPGKPDGKPE-----------FEEADTLEKLRTLLAEKLSSRPEAVHEY
SpCas9    MNFFKTEITLA-NGEIRKRPLIETNGETGEIVWDKGRDFATVRKVLS-----MPQ-----
          -*FF--E*-*---G*----*P-----------***----*--R-*L*------P*------

NmCas9    VTPLFVSRAPNRKMSGQGHMETVKSAKRLDEGVSVLRVPLTQLKLKDLEKMVN--REREP
SpCas9    --------------------VNIVKKTEVQTGGFSKES-----ILPKRNSDKLIARKKDWDP
          ---------------------VK-----G-S--------L--**-*K----*P

NmCas9    KLYEALKARLEAHKDDPAKAFAEPFYKYDKAGNRTQQVKAVR---VEQVQKTGVWVRNH-
SpCas9    KKYGGFD--------SPTVAYSVLVVAKVEKGK-SKKLKSVKELLGITIMERSSFEKNPI
          K-Y--*---------P*-A**--------*-G*-****K*V*------*-*----*-*N--

NmCas9    ----NGIAD----------------NATMVRVDVFEKGDKYYLVPIY--------
SpCas9    DFLEAKGYKEVKKDLIIKLPKYSLFELENGRKRMLASAGELQKGNELALPSKYVNFLYLA
          -----*G--*-----------------*---*------KG--L---Y--------

NmCas9    -SWQVAKGILPDRAVVQGKDEEDWQLIDDS------FNFKFSLHPNDLVEVI--------
SpCas9    SHYEKLKGSPEDNEQKQLFVEQHKHYLDEIIEQISEFSKRVILADANLDKVLSAYNKHRD
          --**--KG---D----Q---E*---*-*D*-------F--*--L----*L--*V*---------

NmCas9    ------------------TKKARMFGYFASCHRGTGNINIRIHDLDHKIGKNGILEGIGV
SpCas9    KPIREQAENIIHLFTLTNLGAPAAFKYFDTTIDRKRYTS-TKEVLDATLIHQSI-------
          -----------------------F-YF-*--------LD--*-**-I-------

NmCas9    KTALSFQKYQIDELGKEIRPCRLKKRPPVR    (SEQ ID NO:6)
SpCas9    -TGLYETRIDLSQLGGD-----------    (SEQ ID NO:7)
          -T-L---*-*-**-*LG-*-----------
```

Percent Identity Matrix - created by Clustal2.1

Fig. 8

Sequence of the NmCas9 ORF with dual NLS and HA tags atg[gtgcctaagaagaagagaaaggtg]gctgccttcaaacctaattcaatcaactacatcctcggcctcgat
atcggcatcgcatccgtcggctgggcgatggtagaaattgacgaagaagaaacccccatccgcctgattgat
ttgggcgtgcgcgtatttgagcgtgccgaagtaccgaaaacaggcgactcccttgccatggcaaggcgtttg
gcgcgcagtgttcgccgcctgacccgccgtcgcgcccaccgcctgcttcggacccgccgcctattgaaacgc
gaaggcgtattacaagccgccaattttgacgaaaacggcttgattaaatccttaccgaatacaccatggcaa
cttcgcgcagccgcattagaccgcaaactgacgcctttagagtggtcggcagtcttgttgcatttaatcaaa
catcgcggctatttatcgaacgaaaaacgagggcgaaactgccgataaggagcttggcgctttgcttaaa
ggcgtagccggcaatgccatgccttacagacaggcgatttccgcacaccggccgaattggctttaaataaa
tttgagaaagaaagcggccatatccgcaatcagcgcagcgattattcgcatacgttcagccgcaaagattta
caggcggagctgattttgctgtttgaaaaacaaaagaatttggcaatccgcatgtttcaggcggccttaaa
gaaggtattgaaacccctactgatgacgcaacgccctgccctgtccggcgatgccgttcaaaaaatgttgggg
cattgcaccttcgaaccggcagagccgaaagccgctaaaaacacctacacagccgaacgtttcatctggctg
accaagctgaacaacctgcgtatttagagcaaggcagcgagcggccattgaccgataccgaacgcgccacg
cttatggacgagccatacagaaaatccaaactgacttacgcacaagcccgtaagctgctgggtttagaagat
accgccttttcaaaggcttgcgctatggtaaagacaatgccgaagcctcaacattgatggaaatgaaggcc
taccatgccatcagccgtgcactggaaaaagaaggattgaaagacaaaaaatcccccattaaacctttctccc
gaattacaagacgaaatcggcacggcattctccctgttcaaaaccgatgaagacattacaggccgtctgaaa
gaccgtatacagcccgaaatcttagaagcgctgttgaaacacatcagcttcgataagttcgtccaaatttcc
ttgaaagcattgcgccgaattgtgcctctaatggaacaaggcaaacgttacgatgaagcctgcgccgaaatc
tacggagaccattacggcaagaagaatacggaagaaaagatttatctgccgccgattcccgccgacgaaatc
cgcaaccccgtcgtcttgcgcgccttatctcaagcacgtaaggtcattaacggcgtggtacgccgttacggc
tccccagctcgtatccatattgaaactgcaagggaagtaggtaaatcgtttaaagaccgcaagaaattgag
aaacgccaagaagaaaaccgcaaagaccgggaaaagccgccgccaaattccgagagtatttccccaattttt
gtcggagaacccaaatccaaagatattctgaaactgcgcctgtacgagcaacaacacggcaaatgcctgtat
tcgggcaaagaaatcaacttaggccgtctgaacgaaaaaggctatgtcgaaatcgaccatgccctgccgttc
tcgcgcacatgggacgacagtttcaacaataaagtactggtattgggcagcgaaaaccaaaacaaaggcaat
caaaccccttacgaatacttcaacggcaaagacaacagccgcgaatggcaggaatttaaagcgcgtgtcgaa
accagccgtttcccgcgcagtaaaaaacaacggattctgctgcaaaaattcgatgaagacggctttaaagaa
cgcaatctgaacgacacgcgctacgtcaaccgtttcctgtgtcaatttgttgccgaccgtatgcggctgaca
ggtaaaggcaagaaacgtgtctttgcatccaacggacaaattaccaatctgttgcgcggcttttggggattg
cgcaaagtgcgtgcggaaaacgaccgccatcacgccttggacgccgtcgtcgttgcctgctcgaccgttgcc
atgcagcagaaaattacccgttttgtacgctataaagagatgaacgcgtttgacggtaaaaccatagacaaa
gaaacaggagaagtgctgcatcaaaaaacacacttcccacaaccttgggaatttttcgcacaagaagtcatg
attcgcgtcttcggcaaaccggacggcaaacccgaattcgaagaagccgataccctagaaaaactgcgcacg
ttgcttgccgaaaaattatcatctcgccccgaagccgtacacgaatacgttacgccactgtttgtttcacgc
gcgcccaatcggaagatgagcgggcaagggcatatggagaccgtcaaatccgccaaacgactggacgaaggc
gtcagcgtgttgcgcgtaccgctgacacagttaaaactgaaagacttggaaaaaatggtcaatcgggagcgc
gaacctaagctatacgaagcactgaaagcacggctggaagcacataaagacgatcctgccaaagccttgcc
gagccgttttacaaatacgataaagcaggcaaccgcacccaacaggtaaaagccgtacgcgtagagcaagta
cagaaaaccggcgtatgggtgcgcaaccataacggtattgccgacaacgcaaccatggtgcgcgtagatgtg
tttgagaaaggcgacaagtattatctggtaccgatttacagttggcaggtagcgaaagggattttgccggat
agggctgttgtacaagaaaagatgaagaagattggcaacttattgatgatagtttcaactttaaattctca
ttacaccctaatgatttagtcgaggttataacaaaaaagctagaatgtttggttactttgccagctgccat
cgaggcacaggtaatatcaatatacgcattcatgatcttgatcataaaattggcaaaaatggaatactggaa
ggtatcggcgtcaaaaccgccctttcattccaaaaataccaaattgacgaactgggcaaagaaatcagacca
tgccgtctgaaaaaacgcccgcctgtccgt[tacccatacgatgttccagattacgct]gcagctccagcagcg
[aagaaaaagaagctggat]taa (SEQ ID NO:303)

R: SV40 NLS, G: HA tag, O: synthetic NLS (1); all else NmCas9

Fig. 9A

Fig. 9B gRNA pair BCL11A-2983W and BCL11A-2981W Deletion Events

Deletion Sequence:

SEQ ID NO: 16301  AATAAAAGGCTGTTTTGGAATGTGTAGAGAGGCA....13.3kb....AACCCTGTGAATTGTATAAGTAGCACCAGTTCTG  SEQ ID NO: 16302

Deletion Length:

13,336 base pair deletion (~13.3kb)

SEQ ID NO: 16303  AATAAAAGGCTGTTTTGGAA————13.3kb————TGTATAAGTAGTAGCAC (x2) SEQ ID NO: 16304
SEQ ID NO: 16305  AATAAAAGGCTGTTTTGGAATGTA————13.3kb————AATTGTATAAGTAGCAC (x9) SEQ ID NO: 16306
SEQ ID NO: 16307  AATAAAAGGCTGTTTTGGAATGT————13.3kb————AATTGTATAAGTAGTAGCAC (x2) SEQ ID NO: 16308
SEQ ID NO: 16309  AATAAAAGGCTGTTTTGGAATGTA————13.3kb————AAGTAGCAC  SEQ ID NO: 16310
SEQ ID NO: 16311  AATAAAAGGCTGTTTTGGA————13.3kb————ATAAGTAGCAC  SEQ ID NO: 16312
SEQ ID NO: 16313  AATAAAAGGCTGTT————13.3kb————TGTATAAGTAGTAGCAC  SEQ ID NO: 16314

Fig. 12B gRNA Pair BCL11A-2995W and BCL11A-2984W Deletion Events

Deletion Sequence:

SEQ ID NO: 16317  CTGTTTTGGAATGTAGAGAGGCAGAGGGGC---13.3kb---TTACAGCCATAACAGGGTTCCAGTGAATTGTATAA  SEQ ID NO: 16318

Deletion Length:

13,327 base pair deletion (~13.3kb)

| SEQ ID NO: 16319 | CTGTTTTGGAA------13.3kb------TGTAT (x2) | SEQ ID NO: 16320 |
| SEQ ID NO: 16321 | CTGTTTTGGAATGTA------13.3kb------TGTAT | SEQ ID NO: 16322 |
| SEQ ID NO: 16323 | CTGTTTTGGAATGTA------13.3kb------AATTGTAT (x12) | SEQ ID NO: 16324 |
| SEQ ID NO: 16325 | CTGTTTTG------13.3kb------GAATTGTAT (x4) | SEQ ID NO: 16326 |
| SEQ ID NO: 16327 | CTGTTTTGGAATG------13.3kb------GAATTGTAT | SEQ ID NO: 16328 |
| SEQ ID NO: 16329 | CTGTTTTGGAATGTA------13.3kb------GTAT | SEQ ID NO: 16330 |

Fig. 13B

CRISPR/CAS-RELATED METHODS AND COMPOSITIONS FOR TREATING SICKLE CELL DISEASE

REFERENCE TO RELATED APPLICATIONS

The present application is a national phase of International Application No. PCT/US2015/022856, filed Mar. 26, 2015, which claims the benefit of U.S. Provisional Application No. 61/970,588, filed Mar. 26, 2014, and U.S. Provisional Application No. 62/084,487, filed Nov. 25, 2014, the contents of each of which are hereby incorporated by reference in their entirety.

SEQUENCE LISTING

This application contains a Sequence Listing, which was submitted in ASCII format via EFS-Web, and is hereby incorporated by reference in its entirety. The ASCII copy, created on Aug. 17, 2021, is named SupplementalSequenceListing.txt and is 3,998,410 bytes in size.

FIELD OF THE INVENTION

The invention relates to CRISPR/CAS-related methods and components for editing of a target nucleic acid sequence, or modulating expression of a target nucleic acid sequence, and applications thereof in connection with Sickle Cell Disease (SCD).

BACKGROUND

Sickle Cell Disease (SCD), also known as Sickle Cell Anemia (SCA), is a common inherited hematologic disease. It affects 80,000-90,000 people in the United States. It is common in people of African descent and in Hispanic-Americans with the prevalence of SCD being 1 in 500 and 1 in 1,000, respectively.

SCD is caused by a mutation in the beta-globin (HBB) gene. HBB is located on chromosome 11 within the HBB gene cluster, which includes genes encoding the delta globin chain, A gamma chain, G gamma chain. The alpha-globin gene is located on chromosome 16. A point mutation (e.g., GAG→GTG) results in the substitution of valine for glutamic acid at amino acid position 6 in exon 1 of the HBB gene. Beta hemoglobin chains with this mutation are expressed as HbS. The disease is inherited in an autosomal recessive manner, so that only patients with two HbS alleles have SCD. Subjects who have sickle cell trait (are heterozygous for HbS) only display a phenotype if they are severely dehydrated or oxygen deprived.

Normal adult hemoglobin (Hb) is composed of a tetramer made from two alpha-globin chains and two beta-globin chains. In SCD, the valine at position 6 of the beta-chain is hydrophobic and causes a change in conformation of the beta-globin protein when it is not bound to oxygen. HbS is more likely to polymerize and leads to the characteristic sickle shaped red blood cells (RBCs) found in SCD.

Sickle shape RBCs cause multiple manifestations of disease, which include, e.g., anemia, sickle cell crises, vasoocclusive crises, aplastic crises and acute chest syndrome. The disease has various manifestations, e.g., vaso-occlusive crisis, splenic sequestration crisis and anemia. Subjects may also suffer from acute chest crisis and infarcts of extremities, end organs and central nervous system. Treatment includes, e.g., hydration, transfusion and analgesics. Treatment of SCD also includes, e.g., the use of hydroxyurea, supplementation with folic acid, and penicillin prophylaxis during childhood. Bone marrow transplants have been demonstrated to cure SCD.

Thus, there remains a need for additional methods and compositions that can be used to treat SCD.

SUMMARY OF THE INVENTION

Methods and compositions discussed herein, provide for the treatment and prevention of Sickle Cell Disease (SCD), also known as Sickle Cell Anemia (SCA). SCD is an inherited hematologic disease.

In healthy individuals, two beta-globin molecules pair with two alpha-globin molecules to form normal hemoglobin (Hb). In SCD, mutations in the beta-globin (HBB) gene, e.g., a point mutation (GAG→GTG) that results in the substitution of valine for glutamic acid at amino acid position 6 of the beta-globin molecule, cause production of sickle hemoglobin (HbS). HbS is more likely to polymerize and leads to the characteristic sickle shaped red blood cells (RBCs). Sickle shaped RBCs give rise to multiple manifestations of disease, such as, anemia, sickle cell crises, vasoocclusive crises, aplastic crises and acute chest syndrome. Alpha-globin can also pair with fetal hemoglobin (HbF), which significantly moderates the severe anemia and other symptoms of SCD. However, the expression of HbF is negatively regulated by the BCL11A gene product.

Methods and compositions disclosed herein provide a number of approaches for treating SCD. As is discussed in more detail below, methods described herein provide for treating SCD by correcting a target position in the HBB gene to provide corrected, or functional, e.g., wild type, beta-globin. Methods and compositions discussed herein can be used to treat or prevent SCD by altering the BCL11A gene (also known as B-cell CLL/lymphoma 11A, BCL11A-L, BCL11A-S, BCL11A-XL, CTIP1, HBFQTL5 and ZNF). BCL11A encodes a zinc-finger protein that is involved in the regulation of globin gene expression. By altering the BCL11A gene (e.g., one or both alleles of the BCL11A gene), the levels of gamma globin can be increased. Gamma globin can replace beta globin in the hemoglobin complex and effectively carry oxygen to tissues, thereby ameliorating SCD disease phenotypes.

In one aspect, methods and compositions discussed herein, provide for the correction of the underlying genetic cause of SCD, e.g., the correction of a mutation at a target position in the HBB gene, e.g., correction of a mutation at amino acid position 6, e.g., an E6V substitution in the HBB gene.

Mutations in the HBB gene (also known as beta-globin and CD113t-C) have been shown to cause SCD. Mutations leading to SCD can be described based on their target positions in the HBB gene. In an embodiment, the target position is E6, e.g., E6V, in the HBB gene.

"SCD target point position", as used herein, refers to a target position in the HBB gene, typically a single nucleotide, which, if mutated, can result in a protein having a mutant amino acid and give rise to SCD. In an embodiment, the SCD target position is the target position at which a change can give rise to an E6 mutant protein, e.g., a protein having an E6V substitution.

While much of the disclosure herein is presented in the context of the mutation in the HBB gene that gives rise to an E6 mutant protein (e.g., E6V mutant protein), the methods and compositions herein are broadly applicable to any mutation, e.g., a point mutation or a deletion, in the HBB gene that gives rise to SCD.

While not wishing to be bound by theory, it is believed that, in an embodiment, a mutation at an SCD target point position in the HBB gene is corrected, e.g., by homology directed repair (HDR), as described herein.

In one aspect, methods and compositions discussed herein may be used to alter the BCL11A gene to treat or prevent SCD, by targeting the BCL11A gene, e.g., coding or non-coding regions of the BCL11A gene. Altering the BCL11A gene herein refers to reducing or eliminating (1) BCL11A gene expression, (2) BCL11A protein function, or (3) the level of BCL11A protein.

In an embodiment, the coding region (e.g., an early coding region) of the BCL11A gene is targeted for alteration. In an embodiment, a non-coding sequence (e.g., an enhancer region, a promoter region, an intron, 5'UTR, 3'UTR, or polyadenylation signal) is targeted for alteration.

In an embodiment, the method provides an alteration that comprises disrupting the BCL11A gene by the insertion or deletion of one or more nucleotides mediated by Cas9 (e.g., enzymatically active Cas9 (eaCas9), e.g., Cas9 nuclease or Cas9 nickase) as described below. This type of alteration is also referred to as "knocking out" the BCL11A gene.

In another embodiment, the method provides an alteration that does not comprise nucleotide insertion or deletion in the BCL11A gene and is mediated by enzymatically inactive Cas9 (eiCas9) or an eiCas9-fusion protein, as described below. This type of alteration is also referred to as "knocking down" the BCL11A gene.

In an embodiment, the methods and compositions discussed herein may be used to alter the BCL11A gene to treat or prevent SCD by knocking out one or both alleles in the BCL11A gene. In an embodiment, the coding region (e.g., an early coding region) of the BCL11A gene, is targeted to alter the gene. In an embodiment, a non-coding region of the BCL11A gene (e.g., an enhancer region, a promoter region, an intron, 5' UTR, 3'UTR, polyadenylation signal) is targeted to alter the gene. In an embodiment, an enhancer (e.g., a tissue-specific enhancer, e.g., a myeloid enhancer, e.g., an erythroid enhancer) is targeted to alter the gene. BCL11A erythroid enhancer comprises an approximate 12.4 kb fragment of BCL11A intron2, located between approximate +52.0 to +64.4 kilobases (kb) from the Transcription Start Site (TSS+52 kb to TSS+64.4 kb, see FIG. 10). It's also referred to herein as chromosome 2 location 60,716,189-60,728,612 (according to UCSC Genome Browser hg 19 human genome assembly). Three deoxyribonuclese I hypersensitive sites (DHSs), TSS+62 kb, TSS+58 kb and TSS+55 kb are located in this region. Deoxyribonuclease I sensitivity is a marker for gene regulatory elements. While not wishing to be bound by theory, it's believed that deleting the enhancer region (e.g., TSS+52 kb to TSS+64.4 kb) may reduce or eliminate BCL11A expression in erythroid precursors which leads to *gamma* globin derepression while sparing BCL11A expression in nonerythoroid lineages. In an embodiment, the method provides an alteration that comprises a deletion of the enhancer region (e.g., a tissue-specific enhancer, e.g., a myleoid enhancer, e.g., an erythroid enhancer) or a portion of the region resulting in disruption of one or more DNase 1-hypersensitive sites (DHS). In an embodiment, the method provides an alteration that comprises an insertion or deletion of one or more nucleotides. As described herein, in an embodiment, a targeted knockout approach is mediated by non-homologous end joining (NHEJ) using a CRISPR/Cas system comprising an enzymatically active Cas9 (eaCas9). In an embodiment, a targeted knockout approach alters the BCL11A gene. In an embodiment, a targeted knockout approach reduces or eliminates expression of functional BCL11A gene product. In an embodiment, targeting affects one or both alleles of the BCL11A gene. In an embodiment, an enhancer disruption approach reduces or eliminates expression of functional BCL11A gene product in the erythroid lineage.

"SCD target knockout position", as used herein, refers to a position in the BCL11A gene, which if altered, e.g., disrupted by insertion or deletion of one or more nucleotides, e.g., by NHEJ-mediated alteration, results in reduction or elimination of expression of functional BCL11A gene product. In an embodiment, the position is in the BCL11A coding region, e.g., an early coding region. In an embodiment, the position is in the BCL11A non-coding region, e.g., an enhancer region.

In an embodiment, methods and compositions discussed herein, provide for altering (e.g., knocking out) the BCL11A gene. In an embodiment, knocking out the BCL11A gene herein refers to (1) insertion or deletion (e.g., NHEJ-mediated insertion or deletion) of one or more nucleotides in close proximity to or within the early coding region of the BCL11A gene, or (2) deletion (e.g., NHEJ-mediated deletion) of a genomic sequence including the erythroid enhancer of the BCL11A gene, In an embodiment, the SCD target knockout position is altered by genome editing using the CRISPR/Cas9 system. The SCD target knockout position may be targeted by cleaving with either a single nuclease or dual nickases, e.g., to induce insertion or deletion (e.g., NHEJ-mediated insertion or deletion) of one or more nucleotides in close proximity to or within the early coding region of the SCD target knockout position or to delete (e.g., mediated by NHEJ) a genomic sequence including the erythroid enhancer of the BCL11A gene.

In an embodiment, the methods and compositions described herein introduce one or more breaks in close proximity to or within the early coding region in at least one allele of the BCL11A gene. In an embodiment, a single strand break is introduced in close proximity to or within the early coding region in at least one allele of the BCL11A gene. In an embodiment, the single strand break will be accompanied by an additional single strand break, positioned by a second gRNA molecule.

In an embodiment, a double strand break is introduced in close proximity to or within the early coding region in at least one allele of the BCL11A gene. In an embodiment, a double strand break will be accompanied by an additional single strand break positioned by a second gRNA molecule. In an embodiment, a double strand break will be accompanied by two additional single strand breaks positioned by a second gRNA molecule and a third gRNA molecule.

In an embodiment, a pair of single strand breaks is introduced in close proximity to or within the early coding region in at least one allele of the BCL11A gene. In an embodiment, the pair of single strand breaks will be accompanied by an additional double strand break, positioned by a third gRNA molecule. In an embodiment, the pair of single strand breaks will be accompanied by an additional pair of single strand breaks positioned by a third gRNA molecule and a fourth gRNA molecule.

In an embodiment, two double strand breaks are introduced to flank the erythroid enhancer at the in the BCL11A gene (one 5' and the other one 3' to the erythroid enhancer) to remove (e.g., delete) the genomic sequence including the erythroid enhancer. It is contemplated herein that in an embodiment the deletion of the genomic sequence including the erythroid enhancer is mediated by NHEJ. In an embodiment, the breaks (i.e., the two double strand breaks) are positioned to avoid unwanted deletion of certain elements, such as endogenous splice sites. The breaks, i.e., two double strand breaks, can be positioned upstream and downstream of the erythroid enhancer, as discussed herein.

In an embodiment, two sets of breaks (e.g., one double strand break and a pair of single strand breaks) are introduced to flank the erythroid enhancer in the BCL11A gene (one set 5' and the other set 3' to the erythroid enhancer) to remove (e.g., delete) the genomic sequence including the erythroid enhancer. It is contemplated herein that in an embodiment the deletion of the genomic sequence including the erythroid enhancer is mediated by NHEJ. In an embodiment, the breaks (i.e., the double strand break and the pair of single strand breaks) are positioned to avoid unwanted deletion of certain chromosome elements, such as endogenous splice sites. The breaks, e.g., the double strand break and the pair of single strand breaks, can be positioned upstream and downstream of the erythroid enhancer, as discussed herein.

In an embodiment, two sets of breaks (e.g., two pairs of single strand breaks) are introduced to flank the erythroid enhancer at the SCD target position in the BCL11A gene (one set 5' and the other set 3' to the erythroid enhancer) to remove (e.g., delete) the genomic sequence including the erythroid enhancer. It is contemplated herein that in an embodiment the deletion of the genomic sequence including the erythroid enhancer is mediated by NHEJ. In an embodiment, the breaks (i.e., the two pairs of single strand breaks) are positioned to avoid unwanted deletion of certain chromosome elements, such as endogenous splice sites. The breaks, e.g., the two pairs of single strand breaks, can be positioned upstream and downstream of the erythroid enhancer, as discussed herein.

In an embodiment, the methods and compositions discussed herein may be used to alter the BCL11A gene to treat or prevent SCD by knocking down one or both alleles of the BCL11A gene. In one embodiment, the coding region of the BCL11A gene, is targeted to alter the gene. In another embodiment, a non-coding region (e.g., an enhancer region, a promoter region, an intron, 5' UTR, 3'UTR, polyadenylation signal) of the BCL11A gene is targeted to alter the gene. In an embodiment, the promoter region of the BCL11A gene is targeted to knock down the expression of the BCL11A gene. A targeted knockdown approach alters, e.g., reduces or eliminates the expression of the BCL11A gene. As described herein, in an embodiment, a targeted knockdown is mediated by targeting an enzymatically inactive Cas9 (eiCas9) or an eiCas9 fused to a transcription repressor domain or chromatin modifying protein to alter transcription, e.g., to block, reduce, or decrease transcription, of the BCL11A gene.

"SCD target knockdown position", as used herein, refers to a position, e.g., in the BCL11A gene, which if targeted by an eiCas9 or an eiCas9 fusion described herein, results in reduction or elimination of expression of functional BCL11A gene product. In an embodiment, transcription is reduced or eliminated. In an embodiment, the position is in the BCL11A promoter sequence. In an embodiment, a position in the promoter sequence of the BCL11A gene is targeted by an enzymatically inactive Cas9 (eiCas9) or an eiCas9-fusion protein, as described herein.

In an embodiment, one or more gRNA molecule comprising a targeting domain configured to target an enzymatically inactive Cas9 (eiCas9) or an eiCas9 fusion protein (e.g., an eiCas9 fused to a transcription repressor domain), sufficiently close to a SCD target knockdown position to reduce, decrease or repress expression of the BCL11A gene.

"SCD target position", as used herein, refers to any of an SCD target point position, SCD target knockout position, or SCD target knockdown position, as described herein.

In one aspect, disclosed herein is a gRNA molecule, e.g., an isolated or non-naturally occurring gRNA molecule, comprising a targeting domain which is complementary with a target domain from the HBB gene or BCL11A gene.

When two or more gRNAs are used to position two or more cleavage events, e.g., double strand or single strand breaks, in a target nucleic acid, it is contemplated that the two or more cleavage events may be made by the same or different Cas9 proteins. For example, when two gRNAs are used to position two double strand breaks, a single Cas9 nuclease may be used to create both double strand breaks. When two or more gRNAs are used to position two or more single stranded breaks (single strand breaks), a single Cas9 nickase may be used to create the two or more single strand breaks. When two or more gRNAs are used to position at least one double strand break and at least one single strand break, two Cas9 proteins may be used, e.g., one Cas9 nuclease and one Cas9 nickase. It is contemplated that when two or more Cas9 proteins are used that the two or more Cas9 proteins may be delivered sequentially to control specificity of a double strand versus a single strand break at the desired position in the target nucleic acid.

In an embodiment, the targeting domain of the first gRNA molecule and the targeting domain of the second gRNA molecule hybridize to the target domain through complementary base pairing to opposite strands of the target nucleic acid molecule. In an embodiment, the gRNA molecule and the second gRNA molecule are configured such that the PAMs are oriented outward.

In an embodiment, the targeting domain of a gRNA molecule is configured to avoid unwanted target chromosome elements, such as repeat elements, e.g., an Alu repeat, or the endogenous splice sites, in the target domain. The gRNA molecule may be a first, second, third and/or fourth gRNA molecule.

In an embodiment, the targeting domain of a gRNA molecule is configured to position a cleavage event sufficiently far from a preselected nucleotide, e.g., the nucleotide of a coding region, such that the nucleotide is not altered. In an embodiment, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

In an embodiment, a point mutation in the HBB gene, e.g., at E6, e.g., E6V, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 1A-1D. In an embodiment, the targeting domain is selected from those in Tables 1A-1D. For example, in an embodiment, the targeting domain is:

AAGGUGAACGUGGAUGAAGU; (SEQ ID NO: 387)

GUAACGGCAGACUUCUCCUC; (SEQ ID NO: 388)

-continued

GUGAACGUGGAUGAAGU; (SEQ ID NO: 389)

or

ACGGCAGACUUCUCCUC. (SEQ ID NO: 390)

In an embodiment, when the SCD target point position is E6, e.g., E6V, and two gRNAs are used to position two breaks, e.g., two single stranded breaks, in the target nucleic acid sequence, the targeting domain of each guide RNA is selected from one of Tables 1A-1D.

In an embodiment, a point mutation in the HBB gene, e.g., at E6, e.g., E6V, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 13A-13D. In an embodiment, the targeting domain is selected from those in Tables 13A-13D. For example, in an embodiment, the targeting domain is:

GGUGCACCUGACUCCUG; (SEQ ID NO: 6803)

or

GUAACGGCAGACUUCUCCAC. (SEQ ID NO: 6804)

In an embodiment, when the SCD target point position is E6, e.g., E6V, and two gRNAs are used to position two breaks, e.g., two single stranded breaks, in the target nucleic acid sequence, the targeting domain of each guide RNA is selected from one of Tables 13A-13D.

In an embodiment, a point mutation in the HBB gene, e.g., at E6, e.g., E6V, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 14A-14C. In an embodiment, the targeting domain is selected from those in Tables 14A-14C.

In an embodiment, when the SCD target point position is E6, e.g., E6V, and two gRNAs are used to position two breaks, e.g., two single stranded breaks, in the target nucleic acid sequence, each guide RNA is selected from one of Tables 14A-14C.

In an embodiment, a point mutation in the HBB gene, e.g., at E6, e.g., E6V, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 24A-24D. In an embodiment, the targeting domain is selected from those in Tables 24A-24D.

In an embodiment, when the SCD target point position is E6, e.g., E6V, and two gRNAs are used to position two breaks, e.g., two single stranded breaks, in the target nucleic acid sequence, the targeting domain of each guide RNA is selected from one of Tables 24A-24D.

In an embodiment, a point mutation in the HBB gene, e.g., at E6, e.g., E6V, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 25A-25B. In an embodiment, the targeting domain is selected from those in Tables 25A-25B.

In an embodiment, when the SCD target point position is E6, e.g., E6V, and two gRNAs are used to position two breaks, e.g., two single stranded breaks, in the target nucleic acid sequence, the targeting domain of each guide RNA is selected from one of Tables 25A-25B.

In an embodiment, a point mutation in the HBB gene, e.g., at E6, e.g., E6V, is targeted, e.g., for correction. In an embodiment, the targeting domain of a gRNA molecule comprises a sequence that is the same as, or differs by no more than 1, 2, 3, 4, or 5 nucleotides from, a targeting domain sequence from Table 26. In an embodiment, the targeting domain is selected from those in Table 26.

In an embodiment, when the SCD target point position is E6, e.g., E6V, and two gRNAs are used to position two breaks, e.g., two single stranded breaks, in the target nucleic acid sequence, the targeting domain of each guide RNA is selected from Table 26. In another embodiment, a position in the coding region, e.g., the early coding region, of the BCL11A gene is targeted, e.g., for knockout. In an embodiment, the targeting domain comprises a sequence that is the same as, or differs by no more than 1, 2, 3, 4, or 5 nucleotides from, a targeting domain sequence from any one of Tables 2A-2F. In an embodiment, the targeting domain is selected from those in Tables 2A-2F. In another embodiment, the targeting domain is:

UGGCAUCCAGGUCACGCCAG; (SEQ ID NO: 486)

GAUGCUUUUUUCAUCUCGAU; (SEQ ID NO: 487)

GCAUCCAAUCCCGUGGAGGU; (SEQ ID NO: 488)

UUUUCAUCUCGAUUGGUGAA; (SEQ ID NO: 489)

CCAGAUGAACUUCCCAUUGG; (SEQ ID NO: 490)

AGGAGGUCAUGAUCCCCUUC; (SEQ ID NO: 491)

CAUCCAGGUCACGCCAG; (SEQ ID NO: 492)

GCUUUUUUCAUCUCGAU; (SEQ ID NO: 493)

UCCAAUCCCGUGGAGGU; (SEQ ID NO: 494)

UCAUCUCGAUUGGUGAA; (SEQ ID NO: 495)

GAUGAACUUCCCAUUGG; (SEQ ID NO: 496)

or

AGGUCAUGAUCCCCUUC. (SEQ ID NO: 497)

In an embodiment, when the SCD target knockout position is the BCL11A coding region, e.g., early coding region, and more than one gRNA is used to position breaks, e.g., two single stranded breaks or two double stranded breaks, or a combination of single strand and double strand breaks, e.g., to create one or more indels, in the target nucleic acid sequence, the targeting domain of each guide RNA is selected from one of Tables 2A-2F.

In another embodiment, a position in the coding region, e.g., the early coding region, of the BCL11A gene is targeted, e.g., for knockout. In an embodiment, the targeting domain comprises a sequence that is the same as, or differs by no more than 1, 2, 3, 4, or 5 nucleotides from, a targeting domain sequence from any one of Table 4A-4E. In an embodiment, the targeting domain is selected from those in Table 4A-4E. In another embodiment, the targeting domain is:

GAGCUCCAUGUGCAGAACGA; (SEQ ID NO: 3073)

GAGCUCCCAACGGGCCG; (SEQ ID NO: 3074)

GAGUGCAGAAUAUGCCCCGC; (SEQ ID NO: 3075)

GAUAAACAAUCGUCAUCCUC; (SEQ ID NO: 3076)

GAUGCCAACCUCCACGGGAU; (SEQ ID NO: 3077)

GCAGAAUAUGCCCCGCA; (SEQ ID NO: 3078)

GCAUCCAAUCCCGUGGAGGU; (SEQ ID NO: 3079)

GCCAACCUCCACGGGAU; (SEQ ID NO: 3080)

GCUCCCAACGGGCCGUGGUC; (SEQ ID NO: 3081)
or

GGAGCUCUAAUCCCCACGCC. (SEQ ID NO: 3082)

In an embodiment, when the SCD target knockout position is the BCL11A coding region, e.g., early coding region, and more than one gRNA is used to position breaks, e.g., two single strand breaks or two double strand breaks, or a combination of single strand and double strand breaks, e.g., to create one or more indels, in the target nucleic acid sequence, the targeting domain of each guide RNA is selected from one of Table 4A-4E.

In another embodiment, a position in the coding region, e.g., the early coding region, of the BCL11A gene is targeted, e.g., for knockout. In an embodiment, the targeting domain comprises a sequence that is the same as, or differs by no more than 1, 2, 3, 4, or 5 nucleotides from, a targeting domain sequence from any one of Table 5A-5E. In an embodiment, the targeting domain is selected from those in Table 5A-5E.

In an embodiment, when the SCD target knockout position is the BCL11A coding region, e.g., early coding region, and more than one gRNA is used to position breaks, e.g., two single strand breaks or two double strand breaks, or a combination of single strand and double strand breaks, e.g., to create one or more indels, in the target nucleic acid sequence, the targeting domain of each guide RNA is selected from one of Table 5A-5E.

In another embodiment, a position in the coding region, e.g., the early coding region, of the BCL11A gene is targeted, e.g., for knockout. In an embodiment, the targeting domain comprises a sequence that is the same as, or differs by no more than 1, 2, 3, 4, or 5 nucleotides from, a targeting domain sequence from any one of Table 6A-6B. In an embodiment, the targeting domain is selected from those in Table 6A-6B.

In an embodiment, when the SCD target knockout position is the BCL11A coding region, e.g., early coding region, and more than one gRNA is used to position breaks, e.g., two single strand breaks or two double strand breaks, or a combination of single strand and double strand breaks, e.g., to create one or more indels, in the target nucleic acid sequence, the targeting domain of each guide RNA is selected from one of Table 6A-6B.

In another embodiment, a position in the coding region, e.g., the early coding region, of the BCL11A gene is targeted, e.g., for knockout. In an embodiment, the targeting domain comprises a sequence that is the same as, or differs by no more than 1, 2, 3, 4, or 5 nucleotides from, a targeting domain sequence from any one of Table 15A-15D. In an embodiment, the targeting domain is selected from those in Table 15A-15D.

In an embodiment, when the SCD target knockout position is the BCL11A coding region, e.g., early coding region, and more than one gRNA is used to position breaks, e.g., two single strand breaks or two double strand breaks, or a combination of single strand and double strand breaks, e.g., to create one or more indels, in the target nucleic acid sequence, the targeting domain of each guide RNA is selected from one of Table 15A-15D.

In another embodiment, a position in the coding region, e.g., the early coding region, of the BCL11A gene is targeted. e.g., for knockout. In an embodiment, the targeting domain comprises a sequence that is the same as, or differs by no more than 1, 2, 3, 4, or 5 nucleotides from, a targeting domain sequence from any one of Table 16A-16E. In an embodiment, the targeting domain is selected from those in Table 16A-16E.

In an embodiment, when the SCD target knockout position is the BCL11A coding region, e.g., early coding region, and more than one gRNA is used to position breaks, e.g., two single strand breaks or two double strand breaks, or a combination of single strand and double strand breaks, e.g., to create one or more indels, in the target nucleic acid sequence, the targeting domain of each guide RNA is selected from one of Table 16A-16E.

In another embodiment, a position in the coding region, e.g., the early coding region, of the BCL11A gene is targeted, e.g., for knockout. In an embodiment, the targeting domain comprises a sequence that is the same as, or differs by no more than 1, 2, 3, 4, or 5 nucleotides from, a targeting domain sequence from any one of Table 17A-17B. In an embodiment, the targeting domain is selected from those in Table 17A-17B.

In an embodiment, when the SCD target knockout position is the BCL11A coding region, e.g., early coding region, and more than one gRNA is used to position breaks, e.g., two single strand breaks or two double strand breaks, or a combination of single strand and double strand breaks, e.g., to create one or more indels, in the target nucleic acid sequence, the targeting domain of each guide RNA is selected from one of Table 17A-17B.

In another embodiment, a position in the non-coding region, e.g., the enhancer region, of the BCL11A gene is targeted, e.g., for knockout. In an embodiment, the targeting domain comprises a sequence that is the same as, or differs by no more than 1, 2, 3, 4, or 5 nucleotides from, a targeting domain sequence from any one of Tables 7A-7D. In an embodiment, the targeting domain is selected from those in Tables 7A-7D. In another embodiment, the targeting domain is:

```
                              (SEQ ID NO: 4835)
GAAAAUACUUACUGUACUGC;

(SEQ ID NO: 4836)
GAAAGCAGUGUAAGGCU;

(SEQ ID NO: 4837)
GGCUGUUUUGGAAUGUAGAG;
or (SEQ ID NO: 4838)
GUGCUACUUAUACAAUUCAC.
```

In an embodiment, when the SCD target knockout position is the non-coding region, e.g., the enhancer region, of the BCL11A gene, and more than one gRNA is used to position breaks, e.g., two single strand breaks or two double strand breaks, or a combination of single and double strand breaks, e.g., to create a deletion, in the target nucleic acid sequence, the targeting domain of each guide RNA is selected from one of Table 7A-7D.

In another embodiment, a position in the non-coding region, e.g., the enhancer region, of the BCL11A gene is targeted, e.g., for knockout. In an embodiment, the targeting domain comprises a sequence that is the same as, or differs by no more than 1, 2, 3, 4, or 5 nucleotides from, a targeting domain sequence from any one of Tables 8A-8D. In an embodiment, the targeting domain is selected from those in Tables 8A-8D.

In an embodiment, when the SCD target knockout position is the non-coding region, e.g., the enhancer region, of the BCL11A gene, and more than one gRNA is used to position breaks, e.g., two single strand breaks or two double strand breaks, or a combination of single and double strand breaks, e.g., to create a deletion, in the target nucleic acid sequence, the targeting domain of each guide RNA is selected from one of Table 8A-8D.

In another embodiment, a position in the non-coding region, e.g., the enhancer region, of the BCL11A gene is targeted, e.g., for knockout. In an embodiment, the targeting domain comprises a sequence that is the same as, or differs by no more than 1, 2, 3, 4, or 5 nucleotides from, a targeting domain sequence from Table 9. In an embodiment, the targeting domain is selected from those in Table 9.

In an embodiment, when the SCD target knockout position is the non-coding region, e.g., the enhancer region, of the BCL11A gene, and more than one gRNA is used to position breaks, e.g., two single strand breaks or two double strand breaks, or a combination of single and double strand breaks, e.g., to create a deletion, in the target nucleic acid sequence, the targeting domain of each guide RNA is selected from one of Table 9.

In another embodiment, a position in the non-coding region, e.g., the enhancer region, of the BCL11A gene is targeted, e.g., for knockout. In an embodiment, the targeting domain comprises a sequence that is the same as, or differs by no more than 1, 2, 3, 4, or 5 nucleotides from, a targeting domain sequence from any one of Tables 21A-21E. In an embodiment, the targeting domain is selected from those in Tables 21A-21E. In an embodiment, when the SCD target knockout position is the non-coding region, e.g., the enhancer region, of the BCL11A gene, and more than one gRNA is used to position breaks, e.g., two single strand breaks or two double strand breaks, or a combination of single strand and double strand breaks, e.g., to create a deletion, in the target nucleic acid sequence, the targeting domain of each guide RNA is selected from one of Table 21A-21E.

In another embodiment, a position in the non-coding region, e.g., the enhancer region, of the BCL11A gene is targeted. e.g., for knockout. In an embodiment, the targeting domain comprises a sequence that is the same as, or differs by no more than 1, 2, 3, 4, or 5 nucleotides from, a targeting domain sequence from any one of Tables 22A-22E. In an embodiment, the targeting domain is selected from those in Tables 22A-22E. In an embodiment, when the SCD target knockout position is the non-coding region, e.g., the enhancer region, of the BCL11A gene, and more than one gRNA is used to position breaks, e.g., two single strand breaks or two double strand breaks, or a combination of single strand and double strand breaks, e.g., to create a deletion, in the target nucleic acid sequence, the targeting domain of each guide RNA is selected from one of Table 22A-22E.

In another embodiment, a position in the non-coding region, e.g., the enhancer region, of the BCL11A gene is targeted, e.g., for knockout. In an embodiment, the targeting domain comprises a sequence that is the same as, or differs by no more than 1, 2, 3, 4, or 5 nucleotides from, a targeting domain sequence from any one of Tables 23A-23C. In an embodiment, the targeting domain is selected from those in Tables 23A-23C.

In an embodiment, when the SCD target knockout position is the non-coding region, e.g., the enhancer region, of the BCL11A gene, and more than one gRNA is used to position breaks, e.g., two single strand breaks or two double strand breaks, or a combination of single strand and double strand breaks, e.g., to create a deletion, in the target nucleic acid sequence, the targeting domain of each guide RNA is selected from one of Table 23A-23C.

In an embodiment, the targeting domain of the gRNA molecule is configured to target an enzymatically inactive Cas9 (eiCas9) or an eiCas9 fusion protein (e.g., an eiCas9 fused to a transcription repressor domain), sufficiently close to an SCD knockdown target position to reduce, decrease or repress expression of the BCL11A gene. In an embodiment, the targeting domain is configured to target the promoter region of the BCL11A gene to block transcription initiation, binding of one or more transcription enhancers or activators, and/or RNA polymerase. One or more gRNA may be used to target an eiCas9 to the promoter region of the BCL11A gene.

In an embodiment, when the BCL11A promoter region is targeted, e.g., for knockdown, the targeting domain can comprise a sequence that is the same as, or differs by no more than 1, 2, 3, 4, or 5 nucleotides from, a targeting domain sequence from any one of Tables 3A-3C. In an embodiment, the targeting domain is selected from those in Tables 3A-3C.

In an embodiment, when the SCD target knockdown position is the BCL11A promoter region and more than one gRNA is used to position an eiCas9 or an eiCas9-fusion protein (e.g., an eiCas9-transcription repressor domain fusion protein), in the target nucleic acid sequence, the targeting domain of each guide RNA is selected from one of Tables 3A-3C.

In an embodiment, when the BCL11A promoter region is targeted, e.g., for knockdown, the targeting domain can comprise a sequence that is the same as, or differs by no more than 1, 2, 3, 4, or 5 nucleotides from, a targeting domain sequence from any one of Tables 10A-10D. In an embodiment, the targeting domain is selected from those in Tables 10A-10D. In another embodiment, the targeting domain is:

GACGACGGCUCGGUUCACAU; (SEQ ID NO: 4981)

GACGCCAGACGCGGCCCCCG; (SEQ ID NO: 4982)

GCCUUGCUUGCGGCGAGACA; (SEQ ID NO: 4983)

GGCUCCGCGGACGCCAGACG; (SEQ ID NO: 4984)

GACGGCUCGGUUCACAU; (SEQ ID NO: 4985)

GCCGCGUCUGGCGUCCG; (SEQ ID NO: 4986)
or

GCGGGCGGACGACGGCU. (SEQ ID NO: 4987)

In an embodiment, when the SCD target knockdown position is the BCL11A promoter region and more than one gRNA is used to position an eiCas9 or an eiCas9-fusion protein (e.g., an eiCas9-transcription repressor domain fusion protein), in the target nucleic acid sequence, each guide RNA is selected from one of Tables 10A-10D.

In an embodiment, when the BCL11A promoter region is targeted, e.g., for knockdown, the targeting domain can comprise a sequence that is the same as, or differs by no more than 1, 2, 3, 4, or 5 nucleotides from, a targeting domain sequence from any one of Tables 11A-11D. In an embodiment, the targeting domain is selected from those in Tables 11A-11D.

In an embodiment, when the SCD target knockdown position is the BCL11A promoter region and more than one gRNA is used to position an eiCas9 or an eiCas9-fusion protein (e.g., an eiCas9-transcription repressor domain fusion protein), in the target nucleic acid sequence, each guide RNA is selected from one of Tables 11A-11D.

In an embodiment, when the BCL11A promoter region is targeted, e.g., for knockdown, the targeting domain can comprise a sequence that is the same as, or differs by no more than 1, 2, 3, 4, or 5 nucleotides from, a targeting domain sequence from Table 12. In an embodiment, the targeting domain is selected from those in Table 12.

In an embodiment, when the SCD target knockdown position is the BCL11A promoter region and more than one gRNA is used to position an eiCas9 or an eiCas9-fusion protein (e.g., an eiCas9-transcription repressor domain fusion protein), in the target nucleic acid sequence, each guide RNA is selected from Table 12.

In an embodiment, when the BCL11A promoter region is targeted, e.g., for knockdown, the targeting domain can comprise a sequence that is the same as, or differs by no more than 1, 2, 3, 4, or 5 nucleotides from, a targeting domain sequence from any one of Tables 18A-18C. In an embodiment, the targeting domain is selected from those in Tables 18A-18C.

In an embodiment, when the SCD target knockdown position is the BCL11A promoter region and more than one gRNA is used to position an eiCas9 or an eiCas9-fusion protein (e.g., an eiCas9-transcription repressor domain fusion protein), in the target nucleic acid sequence, each guide RNA is selected from one of Tables 18A-18C.

In an embodiment, when the BCL11A promoter region is targeted, e.g., for knockdown, the targeting domain can comprise a sequence that is the same as, or differs by no more than 1, 2, 3, 4, or 5 nucleotides from, a targeting domain sequence from any one of Tables 19A-19E. In an embodiment, the targeting domain is selected from those in Tables 19A-19E.

In an embodiment, when the SCD target knockdown position is the BCL11A promoter region and more than one gRNA is used to position an eiCas9 or an eiCas9-fusion protein (e.g., an eiCas9-transcription repressor domain fusion protein), in the target nucleic acid sequence, each guide RNA is selected from one of Tables 19A-19E.

In an embodiment, when the BCL11A promoter region is targeted, e.g., for knockdown, the targeting domain can comprise a sequence that is the same as, or differs by no more than 1, 2, 3, 4, or 5 nucleotides from, a targeting domain sequence from any one of Tables 20A-20C. In an embodiment, the targeting domain is selected from those in Tables 20A-20C.

In an embodiment, when the SCD target knockdown position is the BCL11A promoter region and more than one gRNA is used to position an eiCas9 or an eiCas9-fusion protein (e.g., an eiCas9-transcription repressor domain fusion protein), in the target nucleic acid sequence, each guide RNA is selected from one of Tables 20A-20C.

In an embodiment, the targeting domain comprises a sequence that is the same as, or differs by no more than 1, 2, 3, 4, or 5 nucleotides from, a targeting domain sequence selected from any one of Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31. In an embodiment, the targeting domain is selected from those in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31.

In an embodiment, the targeting domain which is complementary with the BCL11A gene is 16 nucleotides or more in length. In an embodiment, the targeting domain is 16 nucleotides in length. In an embodiment, the targeting domain is 17 nucleotides in length. In another embodiment, the targeting domain is 18 nucleotides in length. In still another embodiment, the targeting domain is 19 nucleotides in length. In still another embodiment, the targeting domain is 20 nucleotides in length. In still another embodiment, the targeting domain is 21 nucleotides in length. In still another embodiment, the targeting domain is 22 nucleotides in length. In still another embodiment, the targeting domain is 23 nucleotides in length. In still another embodiment, the targeting domain is 24 nucleotides in length. In still another embodiment, the targeting domain is 25 nucleotides in length. In still another embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, the gRNA, e.g., a gRNA comprising a targeting domain, which is complementary with the HBB gene or BCL11A gene, is a modular gRNA. In another embodiment, the gRNA is a unimolecular or chimeric gRNA.

HBB gRNA as described herein may comprise from 5' to 3': a targeting domain (comprising a "core domain", and optionally a "secondary domain"); a first complementarity domain; a linking domain; a second complementarity domain; a proximal domain; and a tail domain. In an embodiment, the proximal domain and tail domain are taken together as a single domain.

In an embodiment, a gRNA comprises a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 25 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

A cleavage event, e.g., a double strand or single strand break, is generated by a Cas9 molecule. The Cas9 molecule may be an enzymatically active Cas9 (eaCas9) molecule, e.g., an eaCas9 molecule that forms a double strand break in a target nucleic acid or an eaCas9 molecule forms a single strand break in a target nucleic acid (e.g., a nickase molecule). Alternatively, in an embodiment, the Cas9 molecule may be an enzymatically inactive Cas9 (eiCas9) molecule or a modified eiCas9 molecule, e.g., the eiCas9 molecule is fused to Krüppel-associated box (KRAB) to generate an eiCas9-KRAB fusion protein molecule.

In an embodiment, the eaCas9 molecule catalyzes a double strand break.

In an embodiment, the eaCas9 molecule comprises HNH-like domain cleavage activity but has no, or no significant, N-terminal RuvC-like domain cleavage activity. In this case, the eaCas9 molecule is an HNH-like domain nickase, e.g., the eaCas9 molecule comprises a mutation at D10, e.g., D10A. In another embodiment, the eaCas9 molecule comprises N-terminal RuvC-like domain cleavage activity but has no, or no significant, HNH-like domain cleavage activity. In an embodiment, the eaCas9 molecule is an N-terminal RuvC-like domain nickase, e.g., the eaCas9 molecule comprises a mutation at H840, e.g., H840A. In an embodiment, the eaCas9 molecule is an N-terminal RuvC-like domain nickase, e.g., the eaCas9 molecule comprises a mutation at N863, e.g., N863A.

In an embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

In another aspect, disclosed herein is a nucleic acid, e.g., an isolated or non-naturally occurring nucleic acid, e.g., DNA, that comprises (a) a sequence that encodes a gRNA molecule comprising a targeting domain that is complementary with a target domain, e.g., with an SCD target position, in the HBB gene or BCL11A gene as disclosed herein.

In an embodiment, the nucleic acid encodes a gRNA molecule, e.g., a first gRNA molecule, comprising a targeting domain configured to provide a cleavage event, e.g., a double strand break or a single strand break, sufficiently close to an SCD target position in the HBB gene or BCL11A gene to allow alteration, e.g., alteration associated with HDR or NHEJ, of the an SCD target position in the HBB gene or BCL11A gene.

In an embodiment, the nucleic acid encodes a gRNA molecule, e.g., a first gRNA molecule, comprising a targeting domain configured to target an enzymatically inactive Cas9 (eiCas9) or an eiCas9 fusion protein (e.g., an eiCas9 fused to a transcription repressor domain), sufficiently close to an SCD knockdown target position to reduce, decrease or repress expression of the BCL11A gene.

In an embodiment, the nucleic acid encodes a gRNA molecule, e.g., the first gRNA molecule, comprising a targeting domain comprising a sequence that is the same as, or differs by no more than 1, 2, 3, 4, or 5 nucleotides from, a targeting domain sequence from any one of Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31. In an embodiment, the nucleic acid encodes a gRNA molecule comprising a targeting domain is selected from those in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31.

In an embodiment, the nucleic acid encodes a modular gRNA, e.g., one or more nucleic acids encode a modular gRNA. In another embodiment, the nucleic acid encodes a chimeric gRNA. The nucleic acid may encode a gRNA, e.g., the first gRNA molecule, comprising a targeting domain comprising 16 nucleotides or more in length. In one embodiment, the nucleic acid encodes a gRNA, e.g., the first gRNA molecule, comprising a targeting domain that is 16 nucleotides in length. In another embodiment, the nucleic acid encodes a gRNA, e.g., the first gRNA molecule, comprising a targeting domain that is 17 nucleotides in length. In still another embodiment, the nucleic acid encodes a gRNA, e.g., the first gRNA molecule, comprising a targeting domain that is 18 nucleotides in length. In still another embodiment, the nucleic acid encodes a gRNA, e.g., the first gRNA molecule, comprising a targeting domain that is 19 nucleotides in length. In still another embodiment, the nucleic acid encodes a gRNA, e.g., the first gRNA molecule, comprising a targeting domain that is 20 nucleotides in length. In still another embodiment, the nucleic acid encodes a gRNA, e.g., the first gRNA molecule, comprising a targeting domain that is 21 nucleotides in length. In still another embodiment, the nucleic acid encodes a gRNA, e.g., the first gRNA molecule, comprising a targeting domain that is 22 nucleotides in length. In still another embodiment, the nucleic acid encodes a gRNA, e.g., the first gRNA molecule, comprising a targeting domain that is 23 nucleotides in length. In still another embodiment, the nucleic acid encodes a gRNA, e.g., the first gRNA molecule, comprising a targeting domain that is 24 nucleotides in length. In still another embodiment, the nucleic acid encodes a gRNA, e.g., the first gRNA molecule, comprising a targeting domain that is 25 nucleotides in length. In still another embodiment, the nucleic acid encodes a gRNA, e.g., the first gRNA molecule, comprising a targeting domain that is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, a nucleic acid encodes a gRNA comprising from 5' to 3': a targeting domain (comprising a "core domain", and optionally a "secondary domain"); a first complementarity domain; a linking domain; a second complementarity domain; a proximal domain; and a tail domain. In an embodiment, the proximal domain and tail domain are taken together as a single domain.

In an embodiment, a nucleic acid encodes a gRNA e.g., the first gRNA molecule, comprising a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In an embodiment, a nucleic acid encodes a gRNA e.g., the first gRNA molecule, comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a gRNA e.g., the first gRNA molecule, comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a gRNA comprising e.g., the first gRNA molecule, a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

In an embodiment, a nucleic acid comprises (a) a sequence that encodes a gRNA molecule e.g., the first gRNA molecule, comprising a targeting domain that is complementary with a target domain in the HBB gene or BCL11A gene as disclosed herein, and further comprising (b) a sequence that encodes a Cas9 molecule.

The Cas9 molecule may be an enzymatically active Cas9 (eaCas9) molecule, e.g., an eaCas9 molecule that forms a double strand break in a target nucleic acid or an eaCas9 molecule forms a single strand break in a target nucleic acid (e.g., a nickase molecule). Alternatively, in an embodiment, the Cas9 molecule may be an enzymatically inactive Cas9 (eiCas9) molecule or a modified eiCas9 molecule, e.g., the eiCas9 molecule is fused to Krüppel-associated box (KRAB) to generate an eiCas9-KRAB fusion protein molecule.

A nucleic acid disclosed herein may comprise (a) a sequence that encodes a gRNA molecule comprising a targeting domain that is complementary with a target domain in the HBB gene or BCL11A gene as disclosed herein; (b) a sequence that encodes a Cas9 molecule; and further comprises (c)(i) a sequence that encodes a second gRNA molecule described herein having a targeting domain that is complementary to a second target domain of the HBB gene or BCL11A gene, and optionally, (c)(ii) a sequence that encodes a third gRNA molecule described herein having a targeting domain that is complementary to a third target domain of the HBB gene or BCL11A gene; and optionally, (c)(iii) a sequence that encodes a fourth gRNA molecule described herein having a targeting domain that is complementary to a fourth target domain of the HBB gene or BCL11A gene.

In an embodiment, a nucleic acid encodes a second gRNA molecule comprising a targeting domain configured to provide a cleavage event, e.g., a double strand break or a single strand break, sufficiently close to an SCD target position in the HBB gene or BCL11A gene, to allow alteration, e.g., alteration associated with HDR or NHEJ, of an SCD target position in the HBB gene or BCL11A gene, either alone or in combination with the break positioned by said first gRNA molecule.

In an embodiment, the nucleic acid encodes a second gRNA molecule comprising a targeting domain configured to target an enzymatically inactive Cas9 (eiCas9) or an eiCas9 fusion protein (e.g., an eiCas9 fused to a transcription repressor domain), sufficiently close to an SCD knockdown target position to reduce, decrease or repress expression of the BCL11A gene.

In an embodiment, a nucleic acid encodes a third gRNA molecule comprising a targeting domain configured to provide a cleavage event, e.g., a double strand break or a single strand break, sufficiently close to an SCD target position in the HBB gene or BCL11A gene to allow alteration, e.g., alteration associated with HDR or NHEJ, of an SCD target position in the HBB gene or BCL11A gene, either alone or in combination with the break positioned by the first and/or second gRNA molecule.

In an embodiment, the nucleic acid encodes a third gRNA molecule comprising a targeting domain configured to target an enzymatically inactive Cas9 (eiCas9) or an eiCas9 fusion protein (e.g., an eiCas9 fused to a transcription repressor domain), sufficiently close to an SCD knockdown target position to reduce, decrease or repress expression of the BCL11A gene.

In an embodiment, a nucleic acid encodes a fourth gRNA molecule comprising a targeting domain configured to provide a cleavage event, e.g., a double strand break or a single strand break, sufficiently close to an SCD target position in the HBB gene or BCL11A gene to allow alteration, e.g., alteration associated with HDR or NHEJ, of an SCD target position in the HBB gene or BCL11A gene, either alone or in combination with the break positioned by the first gRNA molecule, the second gRNA molecule and/or the third gRNA molecule.

In an embodiment, the nucleic acid encodes a fourth gRNA molecule comprising a targeting domain configured to target an enzymatically inactive Cas9 (eiCas9) or an eiCas9 fusion protein (e.g., an eiCas9 fused to a transcription repressor domain), sufficiently close to an SCD knockdown target position to reduce, decrease or repress expression of the BCL11A gene.

In an embodiment, the nucleic acid encodes a second gRNA molecule. The second gRNA is selected to target the same SCD target position as the first gRNA molecule. Optionally, the nucleic acid may encode a third gRNA, and further optionally, the nucleic acid may encode a fourth gRNA molecule. The third gRNA molecule and the fourth gRNA molecule are selected to target the same SCD target position as the first and/or second gRNA molecules.

In an embodiment, the nucleic acid encodes a second gRNA molecule comprising a targeting domain comprising a sequence that is the same as, or differs by no more than 1, 2, 3, 4, or 5 nucleotides from, a targeting domain sequence from one of Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31. In an embodiment, the nucleic acid encodes a second gRNA molecule comprising a targeting domain selected from those in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31. In an embodiment, when a third or fourth gRNA molecule are present, the third and fourth gRNA molecules may independently comprise a targeting domain comprising a sequence that is the same as, or differs by no more than 1, 2, 3, 4, or 5 nucleotides from, a targeting domain sequence from one of Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31. In a further embodiment, when a third or fourth gRNA molecule are present, the third and fourth gRNA molecules may independently comprise a targeting domain selected from those in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31.

In an embodiment, the nucleic acid encodes a second gRNA which is a modular gRNA, e.g., wherein one or more nucleic acid molecules encode a modular gRNA. In another embodiment, the nucleic acid encoding a second gRNA is a chimeric gRNA. In another embodiment, when a nucleic acid encodes a third or fourth gRNA, the third and/or fourth gRNA may be a modular gRNA or a chimeric gRNA. When multiple gRNAs are used, any combination of modular or chimeric gRNAs may be used.

A nucleic acid may encode a second, a third, and/or a fourth gRNA comprising a targeting domain comprising 16 nucleotides or more in length. In an embodiment, the nucleic acid encodes a second gRNA comprising a targeting domain that is 16 nucleotides in length. In another embodiment, the nucleic acid encodes a second gRNA comprising a targeting domain that is 17 nucleotides in length. In still another embodiment, the nucleic acid encodes a second gRNA comprising a targeting domain that is 18 nucleotides in length. In still another embodiment, the nucleic acid encodes a second gRNA comprising a targeting domain that is 19 nucleotides in length. In still another embodiment, the nucleic acid encodes a second gRNA comprising a targeting domain that is 20 nucleotides in length. In still another embodiment, the nucleic acid encodes a second gRNA comprising a targeting domain that is 21 nucleotides in length. In still another embodiment, the nucleic acid encodes a second gRNA comprising a targeting domain that is 22 nucleotides in length. In still another embodiment, the nucleic acid encodes a second gRNA comprising a targeting domain that is 23 nucleotides in length. In still another embodiment, the nucleic acid encodes a second gRNA comprising a targeting domain that is 24 nucleotides in length. In still another embodiment, the nucleic acid encodes a second gRNA comprising a targeting domain that is 25 nucleotides in length. In still another embodiment, the nucleic acid encodes a second gRNA comprising a targeting domain that is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, a nucleic acid encodes a second, a third, and/or a fourth gRNA comprising from 5' to 3': a targeting domain (comprising a "core domain", and optionally a "secondary domain"); a first complementarity domain; a linking domain; a second complementarity domain; a proximal domain; and a tail domain. In an embodiment, the proximal domain and tail domain are taken together as a single domain.

In an embodiment, a nucleic acid encodes a second, a third, and/or a fourth gRNA comprising a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In an embodiment, a nucleic acid encodes a second, a third, and/or a fourth gRNA comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a second, a third, and/or a fourth gRNA comprising a linking domain of no more than 25 nucleotides in length; a proximal and tail domain, that taken together, are at least 35 nucleotides in length; and a targeting domain equal to or greater than 16, 17, 18, 19, 20, 21, 22, 23, 24, 25 or 26 nucleotides in length.

In an embodiment, a nucleic acid encodes a second, a third, and/or a fourth gRNA comprising a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

In an embodiment, when the HBB gene is corrected, e.g., by HDR, the nucleic acid encodes (a) a sequence that encodes a gRNA molecule comprising a targeting domain that is complementary with a target domain in the HBB gene as disclosed herein; (b) a sequence that encodes a Cas9 molecule; optionally, (c)(i) a sequence that encodes a second gRNA molecule described herein having a targeting domain that is complementary to a second target domain of the HBB gene, and further optionally, (c)(ii) a sequence that encodes a third gRNA molecule described herein having a targeting domain that is complementary to a third target domain of the HBB gene; and still further optionally, (c)(iii) a sequence that encodes a fourth gRNA molecule described herein having a targeting domain that is complementary to a fourth target domain of the HBB gene; and further may comprise (d) a template nucleic acid (in an embodiment where an exogenous template is used).

In an embodiment, a mutation in the HBB gene is corrected, e.g., by HDR, using an exogenously provided template nucleic acid.

In an embodiment, the template nucleic acid is a single stranded nucleic acid. In another embodiment, the template nucleic acid is a double stranded nucleic acid. In an embodiment, the template nucleic acid comprises a nucleotide sequence, e.g., of one or more nucleotides, that will be added to or will template a change in the target nucleic acid. In another embodiment, the template nucleic acid comprises a nucleotide sequence that may be used to modify the target position. In another embodiment, the template nucleic acid comprises a nucleotide sequence, e.g., of one or more nucleotides, that corresponds to wild type sequence of the target nucleic acid, e.g., of the target position.

The template nucleic acid may comprise a replacement sequence, e.g., a replacement sequence from the Table 27. In an embodiment, the template nucleic acid comprises a 5' homology arm, e.g., a 5' homology arm from Table 27. In another embodiment, the template nucleic acid comprises a 3' homology arm, e.g., a 3' homology arm from Table 27.

In another embodiment, a mutation in the HBB gene is corrected, e.g., by HDR, without using an exogenously provided template nucleic acid. While not wishing to be bound by theory, it is believed that an endogenous region of homology can mediate HDR-based correction. In an embodiment, alteration of the target sequence occurs by HDR with an endogenous genomic donor sequence. In an embodiment, the endogenous genomic donor sequence is located on the same chromosome as the target sequence. In another embodiment, the endogenous genomic donor sequence is located on a different chromosome from the target sequence. In an embodiment, the endogenous genomic donor sequence comprises one or more nucleotides derived from the HBD gene. Mutations in the HBB gene that can be corrected (e.g., altered) by HDR with an endogenous genomic donor sequence include, e.g., a point mutation at E6, e.g., E6V.

As described above, a nucleic acid may comprise (a) a sequence encoding a gRNA molecule comprising a targeting domain that is complementary with a target domain in the HBB gene or BCL11A gene, and (b) a sequence encoding a Cas9 molecule.

In an embodiment, (a) and (b) are present on the same nucleic acid molecule, e.g., the same vector, e.g., the same viral vector, e.g., the same adeno-associated virus (AAV) vector. In an embodiment, the nucleic acid molecule is an AAV vector. Exemplary AAV vectors that may be used in any of the described compositions and methods include an AAV2 vector, a modified AAV2 vector, an AAV3 vector, a modified AAV3 vector, an AAV6 vector, a modified AAV6 vector, an AAV8 vector and an AAV9 vector.

In another embodiment, (a) is present on a first nucleic acid molecule, e.g. a first vector, e.g., a first viral vector, e.g., a first AAV vector; and (b) is present on a second nucleic acid molecule, e.g., a second vector, e.g., a second vector, e.g., a second AAV vector. The first and second nucleic acid molecules may be AAV vectors.

In another embodiment, the nucleic acid may further comprise (c) a sequence that encodes a second, third and/or fourth gRNA molecule as described herein. In an embodiment, the nucleic acid comprises (a), (b) and (c). Each of (a) and (c) may be present on the same nucleic acid molecule, e.g., the same vector, e.g., the same viral vector, e.g., the same adeno-associated virus (AAV) vector. In an embodiment, the nucleic acid molecule is an AAV vector.

In another embodiment, (a) and (c) are on different vectors. For example, (a) may be present on a first nucleic acid molecule, e.g. a first vector, e.g., a first viral vector, e.g., a first AAV vector; and (c) may be present on a second nucleic acid molecule, e.g., a second vector. e.g., a second vector, e.g., a second AAV vector. In an embodiment, the first and second nucleic acid molecules are AAV vectors.

In another embodiment, each of (a), (b), and (c) are present on the same nucleic acid molecule, e.g., the same vector, e.g., the same viral vector, e.g., an AAV vector. In an embodiment, the nucleic acid molecule is an AAV vector. In an alternate embodiment, one of (a), (b), and (c) is encoded on a first nucleic acid molecule, e.g., a first vector, e.g., a first viral vector, e.g., a first AAV vector; and a second and third of (a), (b), and (c) is encoded on a second nucleic acid molecule, e.g., a second vector, e.g., a second vector, e.g., a second AAV vector. The first and second nucleic acid molecule may be AAV vectors.

In an embodiment, (a) is present on a first nucleic acid molecule, e.g., a first vector, e.g., a first viral vector, a first AAV vector; and (b) and (c) are present on a second nucleic acid molecule, e.g., a second vector, e.g., a second vector, e.g., a second AAV vector. The first and second nucleic acid molecule may be AAV vectors.

In another embodiment, (b) is present on a first nucleic acid molecule, e.g., a first vector, e.g., a first viral vector, e.g., a first AAV vector; and (a) and (c) are present on a second nucleic acid molecule, e.g., a second vector, e.g., a second vector, e.g., a second AAV vector. The first and second nucleic acid molecule may be AAV vectors.

In another embodiment, (c) is present on a first nucleic acid molecule, e.g., a first vector, e.g., a first viral vector, e.g., a first AAV vector; and (b) and (a) are present on a second nucleic acid molecule, e.g., a second vector, e.g., a second vector, e.g., a second AAV vector. The first and second nucleic acid molecule may be AAV vectors.

In another embodiment, each of (a), (b) and (c) are present on different nucleic acid molecules, e.g., different vectors, e.g., different viral vectors, e.g., different AAV vector. For example, (a) may be on a first nucleic acid molecule, (b) on a second nucleic acid molecule, and (c) on a third nucleic acid molecule. The first, second and third nucleic acid molecule may be AAV vectors.

In another embodiment, when a third and/or fourth gRNA molecule are present, each of (a), (b), (c)(i), (c)(ii) and (c)(iii) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i), (c)(ii) and (c)(iii) may be present on the different nucleic acid molecules, e.g., different vectors, e.g., the different viral vectors, e.g., different AAV vectors. In further embodiments, each of (a), (b), (c)(i), (c)(ii) and (c)(iii) may be present on more than one nucleic acid molecule, but fewer than five nucleic acid molecules, e.g., AAV vectors.

In another embodiment, when (d) a template nucleic acid is present, each of (a), (b), and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), and (d) may be present on the different nucleic acid molecules, e.g., different vectors, e.g., the different viral vectors, e.g., different AAV vectors. In further embodiments, each of (a), (b), and (d) may be present on more than one nucleic acid molecule, but fewer than three nucleic acid molecules, e.g., AAV vectors.

In another embodiment, when (d) a template nucleic acid is present, each of (a), (b), (c)(i) and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i) and (d) may be present on the different nucleic acid molecules, e.g., different vectors, e.g., the different viral vectors, e.g., different AAV vectors. In further embodiments, each of (a), (b), (c)(i) and (d) may be present on more than one nucleic acid molecule, but fewer than four nucleic acid molecules, e.g., AAV vectors.

In another embodiment, when (d) a template nucleic acid is present, each of (a), (b), (c)(i), (c)(ii) and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i), (c)(ii) and (d) may be present on the different nucleic acid molecules, e.g., different vectors, e.g., the different viral vectors, e.g., different AAV vectors. In further embodiments, each of (a), (b), (c)(i), (c)(ii) and (d) may be present on more than one nucleic acid molecule, but fewer than five nucleic acid molecules, e.g., AAV vectors.

In another embodiment, when (d) a template nucleic acid is present, each of (a), (b), (c)(i), (c)(ii), (c)(iii) and (d) may be present on the same nucleic acid molecule, e.g., the same vector, e.g., the same viral vector, e.g., an AAV vector. In an alternate embodiment, each of (a), (b), (c)(i), (c)(ii), (c)(iii) and (d) may be present on the different nucleic acid molecules, e.g., different vectors, e.g., the different viral vectors. e.g., different AAV vectors. In further embodiments, each of (a), (b), (c)(i), (c)(ii), (c)(iii) and (d) may be present on more than one nucleic acid molecule, but fewer than six nucleic acid molecules, e.g., AAV vectors.

The nucleic acids described herein may comprise a promoter operably linked to the sequence that encodes the gRNA molecule of (a), e.g., a promoter described herein. The nucleic acid may further comprise a second promoter operably linked to the sequence that encodes the second, third and/or fourth gRNA molecule of (c), e.g., a promoter described herein. The promoter and second promoter differ from one another. In an embodiment, the promoter and second promoter are the same.

The nucleic acids described herein may further comprise a promoter operably linked to the sequence that encodes the Cas9 molecule of (b), e.g., a promoter described herein.

In another aspect, disclosed herein is a composition comprising (a) a gRNA molecule comprising a targeting domain that is complementary with a target domain in the HBB gene or BCL11A gene, as described herein. The composition of (a) may further comprise (b) a Cas9 molecule, e.g., a Cas9 molecule as described herein. A composition of (a) and (b) may further comprise (c) a second, third and/or fourth gRNA molecule, e.g., a second, third and/or fourth gRNA molecule described herein. A composition of (a), (b) and (c) may further comprise (d) a template nucleic acid (in an embodiment where an exogenous template is used). In an embodiment, the composition is a pharmaceutical composition. The Compositions described herein, e.g., pharmaceutical compositions described herein, can be used in treating SCD in a subject, e.g., in accordance with a method disclosed herein.

In another aspect, disclosed herein is a method of altering a cell, e.g., altering the structure, e.g., altering the sequence, of a target nucleic acid of a cell, comprising contacting said cell with: (a) a gRNA that targets the HBB gene or BCL11A gene, e.g., a gRNA as described herein; (b) a Cas9 molecule, e.g., a Cas9 molecule as described herein; and optionally, (c) a second, third and/or fourth gRNA that targets HBB gene or BCL11A gene, e.g., a gRNA; and optionally, (d) a template nucleic acid, as described herein.

In an embodiment, the method comprises contacting said cell with (a) and (b).

In an embodiment, the method comprises contacting said cell with (a), (b), and (c).

In an embodiment, the method comprises contacting said cell with (a), (b), (c) and (d).

In an embodiment, the gRNA targets the HBB gene and no exogenous template nucleic acid is contacted with the cell.

The gRNA of (a) and optionally (c) may be selected from any of Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31, or a gRNA that differs by no more than 1, 2, 3, 4, or 5 nucleotides from, a targeting domain sequence from any of Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31.

In an embodiment, the method comprises contacting a cell from a subject suffering from or likely to develop SCD. The cell may be from a subject having a mutation at an SCD target position in the HBB gene or a subject which would benefit from having a mutation at an SCD target position in the BCL11A gene.

In an embodiment, the cell being contacted in the disclosed method is an erythroid cell. The contacting may be performed ex vivo and the contacted cell may be returned to the subject's body after the contacting step. In another embodiment, the contacting step may be performed in vivo.

In an embodiment, the method of altering a cell as described herein comprises acquiring knowledge of the sequence at an SCD target position in said cell, prior to the contacting step. Acquiring knowledge of the sequence at an SCD target position in the cell may be by sequencing the HBB gene or BCL11A gene, or a portion of the HBB gene or BCL11A gene.

In an embodiment, the contacting step of the method comprises contacting the cell with a nucleic acid, e.g., a vector, e.g., an AAV vector, that expresses at least one of (a), (b), and (c). In an embodiment, the contacting step of the method comprises contacting the cell with a nucleic acid, e.g., a vector, e.g., an AAV vector, that expresses each of (a), (b), and (c). In another embodiment, the contacting step of the method comprises delivering to the cell a Cas9 molecule of (b) and a nucleic acid which encodes a gRNA (a) and optionally, a second gRNA (c)(i) (and further optionally, a third gRNA (c)(iv) and/or fourth gRNA (c)(iii).

In an embodiment, the contacting step of the method comprises contacting the cell with a nucleic acid, e.g., a vector, e.g., an AAV vector, that expresses at least one of (a), (b), (c) and (d). In an embodiment, the contacting step of the method comprises contacting the cell with a nucleic acid, e.g., a vector, e.g., an AAV vector, that expresses each of (a), (b), and (c). In another embodiment, the contacting step of the method comprises delivering to the cell a Cas9 molecule of (b), a nucleic acid which encodes a gRNA of (a) and a template nucleic acid of (d), and optionally, a second gRNA (c)(i) (and further optionally, a third gRNA (c)(iv) and/or fourth gRNA (c)(iii).

In an embodiment, contacting comprises contacting the cell with a nucleic acid, e.g., a vector, e.g., an AAV vector, e.g., an AAV2 vector, a modified AAV2 vector, an AAV3 vector, a modified AAV3 vector, an AAV6 vector, a modified AAV6 vector, an AAV8 vector or an AAV9 vector.

In an embodiment, contacting comprises delivering to the cell a Cas9 molecule of (b), as a protein or an mRNA, and a nucleic acid which encodes (a) and optionally a second, third and/or fourth gRNA of (c).

In an embodiment, contacting comprises delivering to the cell a Cas9 molecule of (b), as a protein or an mRNA, said gRNA of (a), as an RNA, and optionally said second, third and/or fourth gRNA of (c), as an RNA.

In an embodiment, contacting comprises delivering to the cell a gRNA of (a) as an RNA, optionally said second, third and/or fourth gRNA of (c) as an RNA, and a nucleic acid that encodes the Cas9 molecule of (b).

In another aspect, disclosed herein is a method of treating or preventing a subject suffering from or likely to develop SCD, e.g., altering the structure, e.g., sequence, of a target nucleic acid of the subject, comprising contacting the subject (or a cell from the subject) with:

(a) a gRNA that targets the HBB gene or BCL11A gene, e.g., a gRNA disclosed herein;

(b) a Cas9 molecule, e.g., a Cas9 molecule disclosed herein; and optionally, (c)(i) a second gRNA that targets the HBB gene or BCL11A gene, e.g., a second gRNA disclosed herein, and further optionally, (c)(ii) a third gRNA, and still further optionally, (c)(iii) a fourth gRNA that target the HBB gene or BCL11A gene, e.g., a third and fourth gRNA disclosed herein.

The method of treating a subject may further comprise contacting the subject (or a cell from the subject) with (d) a template nucleic acid (in an embodiment where an exogenous template is used), e.g., a template nucleic acid disclosed herein.

In an embodiment, a template nucleic acid is used when the method of treating a subject uses HDR to alter the sequence of the target nucleic acid of the subject. In an embodiment, the gRNA targets the HBB gene and no exogenous template nucleic acid is contacted with the subject (or a cell from the subject).

In an embodiment, contacting comprises contacting with (a) and (b).

In an embodiment, contacting comprises contacting with (a), (b), and (c)(i).

In an embodiment, contacting comprises contacting with (a), (b), (c)(i) and (c)(ii).

In an embodiment, contacting comprises contacting with (a), (b), (c)(i), (c)(ii) and (c)(iii).

In an embodiment, contacting comprises contacting with (a), (b), (c)(i) and (d).

In an embodiment, contacting comprises contacting with (a), (b), (c)(i), (c)(ii) and (d).

In an embodiment, contacting comprises contacting with (a), (b), (c)(i), (c)(ii), (c)(iii) and (d).

The gRNA of (a) or (c) (e.g., (c)(i), (c)(ii), or (c)(iii) may be selected from any of Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31, or a gRNA that differs by no more than 1, 2, 3, 4, or 5 nucleotides from, a targeting domain sequence from any of Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31.

In an embodiment, the method comprises acquiring knowledge of the sequence (e.g., a mutation) of an SCD target position in said subject.

In an embodiment, the method comprises acquiring knowledge of the sequence (e.g., a mutation) of an SCD target position in said subject by sequencing the HBB gene or BCL11A gene or a portion of the HBB gene or BCL11A gene.

In an embodiment, the method comprises correcting a mutation at an SCD target position in the HBB gene.

In an embodiment, the method comprises correcting a mutation at an SCD target position in the HBB gene by HDR.

In an embodiment, the method comprises introducing a mutation at an SCD target position in the BCL11A gene.

In an embodiment, the method comprises introducing a mutation at an SCD target position in the BCL11A gene by NHEJ.

When the method comprises correcting the mutation at an SCD target position by HDR, a Cas9 of (b), at least one guide RNA, e.g., a guide RNA of (a) and a template nucleic acid of (d) are included in the contacting step.

In an embodiment, a cell of the subject is contacted ex vivo with (a), (b), (d) and optionally (c)(i), further optionally (c)(ii), and still further optionally (c)(iii). In an embodiment, said cell is returned to the subject's body.

In an embodiment, a cell of the subject is contacted is in vivo with (a), (b) (d) and optionally (c)(i), further optionally (c)(ii), and still further optionally (c)(iii).

In an embodiment, the cell of the subject is contacted in vivo by intravenous delivery of (a), (b), (d) and optionally (c)(i), further optionally (c)(ii), and still further optionally (c)(iii).

In an embodiment, the cell of the subject is contacted in vivo by intramuscular delivery of (a), (b), (d) and optionally (c)(i), further optionally (c)(ii), and still further optionally (c)(iii).

In an embodiment, the cell of the subject is contacted in vivo by subcutaneous delivery of (a), (b), (d) and optionally (c)(i), further optionally (c)(ii), and still further optionally (c)(iii).

In an embodiment, the cell of the subject is contacted in vivo by intra-bone marrow (IBM) delivery of (a), (b), (d) and optionally (c)(i), further optionally (c)(ii), and still further optionally (c)(iii).

In an embodiment, contacting comprises contacting the subject with a nucleic acid, e.g., a vector, e.g., an AAV vector, described herein, e.g., a nucleic acid that encodes at least one of (a), (b), (d) and optionally (c)(i), further optionally (c)(ii), and still further optionally (c)(iii).

In an embodiment, contacting comprises delivering to said subject said Cas9 molecule of (b), as a protein or mRNA, and a nucleic acid which encodes (a), a nucleic acid of (d) and optionally (c)(i), further optionally (c)(ii), and still further optionally (c)(iii).

In an embodiment, contacting comprises delivering to the subject the Cas9 molecule of (b), as a protein or mRNA, the gRNA of (a), as an RNA, a nucleic acid of (d) and optionally the second, third and/or fourth gRNA of (c), as an RNA.

In an embodiment, contacting comprises delivering to the subject the gRNA of (a), as an RNA, optionally said second, third and/or fourth gRNA of (c), as an RNA, a nucleic acid that encodes the Cas9 molecule of (b), and a nucleic acid of (d).

When the method comprises (1) introducing a mutation at an SCD target position by NHEJ or (2) knocking down expression of the BCL11A gene by targeting the promoter region, a Cas9 of (b) and at least one guide RNA, e.g., a guide RNA of (a) are included in the contacting step.

In an embodiment, a cell of the subject is contacted ex vivo with (a), (b) and optionally (c)(i), further optionally (c)(ii), and still further optionally (c)(iii). In an embodiment, said cell is returned to the subject's body.

In an embodiment, a populations of cells from a subject is contacted ex vivo with (a), (b) and optionally (c) to correct the E6V mutation in the HBB gene and a second population of cells from the subject is contacted ex vivo with (a), (b) and optionally (c) to introduce a mutation in the BCL11A gene to knockout the BCL11A gene. A mixture of the two cell populations may be returned to the subject's body to treat or prevent SCD.

In an embodiment, a cell of the subject is contacted is in vivo with (a), (b) and optionally (c)(i), further optionally (c)(ii), and still further optionally (c)(iii). In an embodiment, the cell of the subject is contacted in vivo by intravenous delivery of (a), (b) and optionally (c)(i), further optionally (c)(ii), and still further optionally (c)(iii). In an embodiment, the cell of the subject is contacted in vivo by intramuscular delivery of (a), (b) and optionally (c)(i), further optionally (c)(ii), and still further optionally (c)(iii). In an embodiment, the cell of the subject is contacted in vivo by subcutaneous delivery of (a), (b) and optionally (c)(i), further optionally (c)(ii), and still further optionally (c)(iii). In an embodiment, the cell of the subject is contacted in vivo by intra-bone marrow (IBM) delivery of (a), (b) and optionally (c)(i), further optionally (c)(ii), and still further optionally (c)(iii).

In an embodiment, contacting comprises contacting the subject with a nucleic acid, e.g., a vector, e.g., an AAV vector, described herein. e.g., a nucleic acid that encodes at least one of (a), (b), and optionally (c)(i), further optionally (c)(ii), and still further optionally (c)(iii).

In an embodiment, contacting comprises delivering to said subject said Cas9 molecule of (b), as a protein or mRNA, and a nucleic acid which encodes (a) and optionally (c)(i), further optionally (c)(ii), and still further optionally (c)(iii).

In an embodiment, contacting comprises delivering to the subject the Cas9 molecule of (b), as a protein or mRNA, the gRNA of (a), as an RNA, and optionally the second, third and/or fourth gRNA of (c), as an RNA.

In an embodiment, contacting comprises delivering to the subject the gRNA of (a), as an RNA, optionally said second, third and/or fourth gRNA of (c), as an RNA, and a nucleic acid that encodes the Cas9 molecule of (b).

In another aspect, disclosed herein is a reaction mixture comprising a gRNA, a nucleic acid, or a composition described herein, and a cell, e.g., a cell from a subject having, or likely to develop SCD, or a subject having a mutation at an SCD target position in the HBB gene, or a cell from a subject which would benefit from having a mutation at an SCD target position in the BCL11A gene.

In another aspect, disclosed herein is a kit comprising, (a) gRNA molecule described herein, or nucleic acid that encodes the gRNA, and one or more of the following:

(b) a Cas9 molecule, e.g., a Cas9 molecule described herein, or a nucleic acid or mRNA that encodes the Cas9;

(c)(i) a second gRNA molecule, e.g., a second gRNA molecule described herein or a nucleic acid that encodes (c)(i);

(c)(ii) a third gRNA molecule, e.g., a second gRNA molecule described herein or a nucleic acid that encodes (c)(ii);

(c)(iii) a fourth gRNA molecule, e.g., a second gRNA molecule described herein or a nucleic acid that encodes (c)(iii);

(d) a template nucleic acid (in an embodiment where an exogenous template is used), e.g., a template nucleic acid described herein.

In an embodiment, the kit comprises nucleic acid, e.g., an AAV vector, that encodes one or more of (a), (b), (c)(i), (c)(ii), (c)(iii) and (d).

In an aspect, the disclosure features a gRNA molecule, referred to herein as a governing gRNA molecule, comprising a targeting domain which is complementary to a target domain on a nucleic acid that encodes a component of the CRISPR/Cas system introduced into a cell or subject. In an embodiment, the governing gRNA molecule targets a nucleic acid that encodes a Cas9 molecule or a nucleic acid that encodes a target gene gRNA molecule. In an embodiment, the governing gRNA comprises a targeting domain that is complementary to a target domain in a sequence that encodes a Cas9 component. e.g., a Cas9 molecule or target gene gRNA molecule. In an embodiment, the target domain is designed with, or has, minimal homology to other nucleic acid sequences in the cell, e.g., to minimize off-target cleavage. For example, the targeting domain on the governing gRNA can be selected to reduce or minimize off-target effects. In an embodiment, a target domain for a governing gRNA can be disposed in the control or coding region of a Cas9 molecule or disposed between a control region and a transcribed region. In an embodiment, a target domain for a governing gRNA can be disposed in the control or coding region of a target gene gRNA molecule or disposed between a control region and a transcribed region for a target gene gRNA. While not wishing to be bound by theory, it is believed that altering, e.g., inactivating, a nucleic acid that encodes a Cas9 molecule or a nucleic acid that encodes a target gene gRNA molecule can be effected by cleavage of the targeted nucleic acid sequence or by binding of a Cas9 molecule/governing gRNA molecule complex to the targeted nucleic acid sequence.

The compositions, reaction mixtures and kits, as disclosed herein, can also include a governing gRNA molecule, e.g., a governing gRNA molecule disclosed herein.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting.

Headings, including numeric and alphabetical headings and subheadings, are for organization and presentation and are not intended to be limiting.

Other features and advantages of the invention will be apparent from the detailed description, drawings, and from the claims.

BRIEF DESCRIPTION OF THE DRAWINGS

FIGS. 1A-1I are representations of several exemplary gRNAs.

FIG. 1A depicts a modular gRNA molecule derived in part (or modeled on a sequence in part) from *Streptococcus pyogenes* (*S. pyogenes*) as a duplexed structure (SEQ ID NOS: 42 and 43, respectively, in order of appearance);

FIG. 1B depicts a unimolecular (or chimeric) gRNA molecule derived in part from *S. pyogenes* as a duplexed structure (SEQ ID NO: 44);

FIG. 1C depicts a unimolecular gRNA molecule derived in part from *S. pyogenes* as a duplexed structure (SEQ ID NO: 45);

FIG. 1D depicts a unimolecular gRNA molecule derived in part from *S. pyogenes* as a duplexed structure (SEQ ID NO: 46);

FIG. 1E depicts a unimolecular gRNA molecule derived in part from *S. pyogenes* as a duplexed structure (SEQ ID NO: 47);

FIG. 1F depicts a modular gRNA molecule derived in part from *Streptococcus thermophilus* (*S. thermophilus*) as a duplexed structure (SEQ ID NOS: 48 and 49, respectively, in order of appearance);

FIG. 1G depicts an alignment of modular gRNA molecules of *S. pyogenes* and *S. thermophilus* (SEQ ID NOS: 50-53, respectively, in order of appearance).

FIGS. 1H-1I depicts additional exemplary structures of unimolecular gRNA molecules.

FIG. 1H shows an exemplary structure of a unimolecular gRNA molecule derived in part from *S. pyogenes* as a duplexed structure (SEQ ID NO: 45).

FIG. 1I shows an exemplary structure of a unimolecular gRNA molecule derived in part from *S. aureus* as a duplexed structure (SEQ ID NO: 40).

Figure 2B:
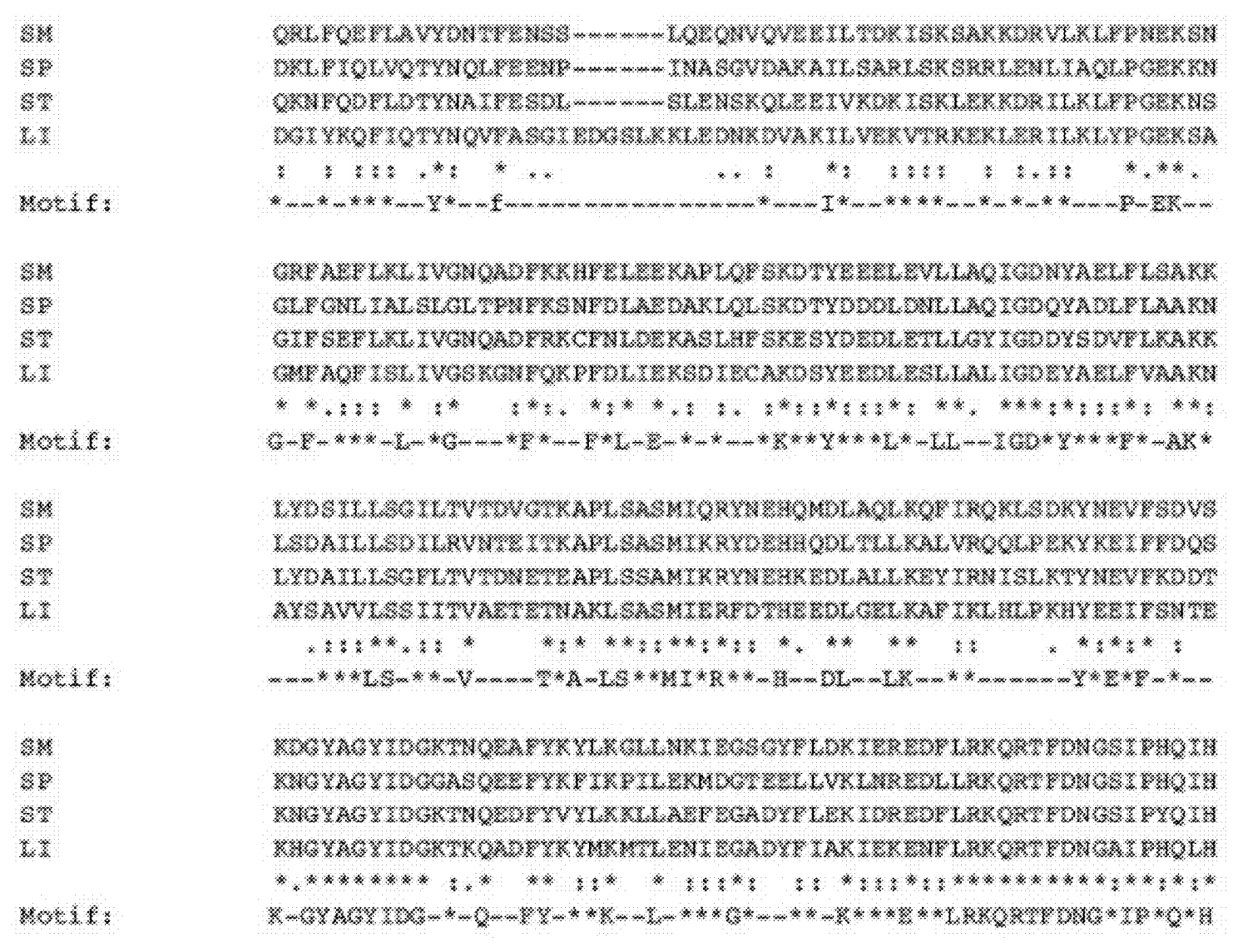
Figure 2E:
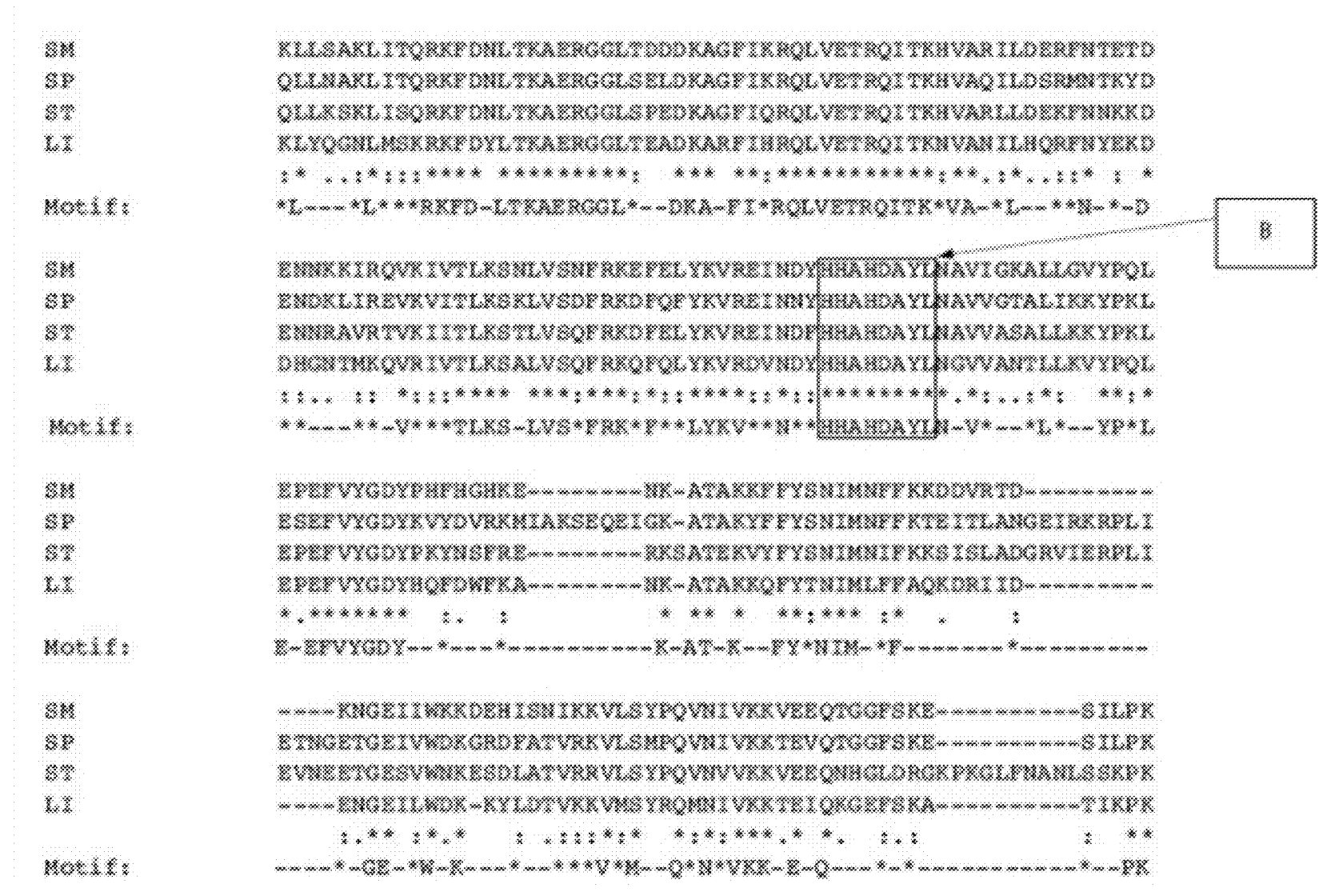

FIGS. 2A-2G depict an alignment of Cas9 sequences from Chylinski et al. (RNA Biol. 2013; 10(5): 726-737). The N-terminal RuvC-like domain is boxed and indicated with a "Y". The other two RuvC-like domains are boxed and indicated with a "B". The HNH-like domain is boxed and indicated by a "G". Sm: *S. mutans* (SEQ ID NO: 1); Sp: *S. pyogenes* (SEQ ID NO: 2); St: *S. thermophilus* (SEQ ID NO: 3); Li: *L. innocua* (SEQ ID NO: 4). Motif: this is a motif based on the four sequences: residues conserved in all four sequences are indicated by single letter amino acid abbreviation; "*" indicates any amino acid found in the corresponding position of any of the four sequences; and "-" indicates any amino acid, e.g., any of the 20 naturally occurring amino acids, or absent.

FIGS. 3A-3B show an alignment of the N-terminal RuvC-like domain from the Cas9 molecules disclosed in Chylinski et al (SEQ ID NOS: 54-103, respectively, in order of appearance). The last line of FIG. 3B identifies 4 highly conserved residues.

Figure 4A:
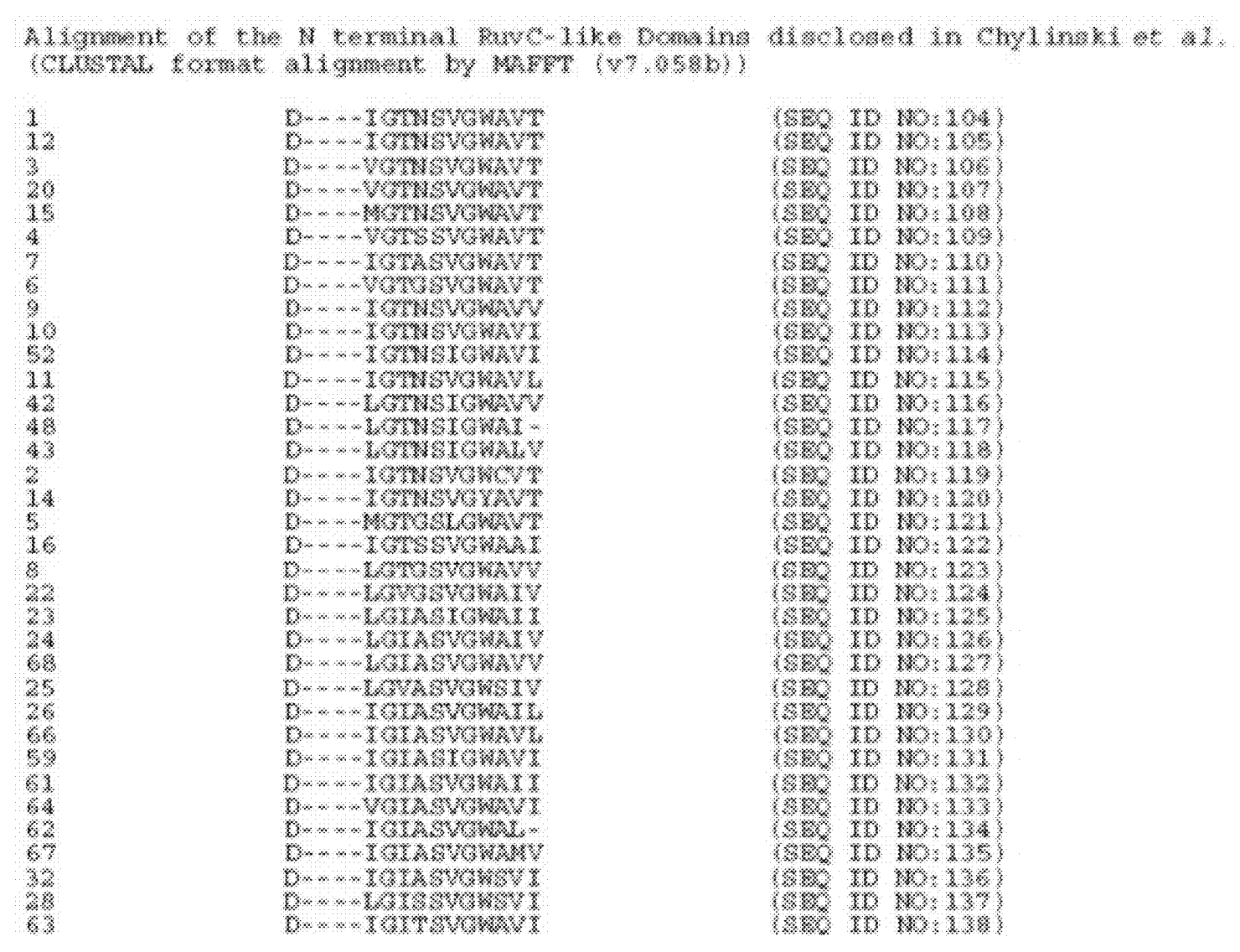

FIGS. 4A-4B show an alignment of the N-terminal RuvC-like domain from the Cas9 molecules disclosed in Chylinski et al. with sequence outliers removed (SEQ ID NOS: 104-177, respectively, in order of appearance). The last line of FIG. 4B identifies 3 highly conserved residues.

FIGS. 5A-5C show an alignment of the HNH-like domain from the Cas9 molecules disclosed in Chylinski et al (SEQ ID NOS: 178-252, respectively, in order of appearance). The last line of FIG. 5C identifies conserved residues.

FIGS. 6A-6B show an alignment of the HNH-like domain from the Cas9 molecules disclosed in Chylinski et al. with sequence outliers removed (SEQ ID NOS: 253-302, respectively, in order of appearance). The last line of FIG. 6B identifies 3 highly conserved residues.

FIGS. 7A-7B depict an alignment of Cas9 sequences from *S. pyogenes* and *Neisseria meningitidis* (*N. meningitidis*). The N-terminal RuvC-like domain is boxed and indicated with a "Y". The other two RuvC-like domains are boxed and indicated with a "B". The HNH-like domain is boxed and indicated with a "G". Sp: *S. pyogenes*; Nm: *N. meningitidis*. Motif: this is a motif based on the two sequences: residues conserved in both sequences are indicated by a single amino acid designation; "*" indicates any amino acid found in the corresponding position of any of the two sequences; "-" indicates any amino acid, e.g., any of the 20 naturally occurring amino acids, and "-" indicates any amino acid, e.g., any of the 20 naturally occurring amino acids, or absent.

FIG. 8 shows a nucleic acid sequence encoding Cas9 of *N. meningitidis* (SEQ ID NO: 303). Sequence indicated by an "R" is an SV40 NLS; sequence indicated as "G" is an HA tag; and sequence indicated by an "O" is a synthetic NLS sequence; the remaining (unmarked) sequence is the open reading frame (ORF).

FIGS. 9A and 9B are schematic representations of the domain organization of *S. pyogenes* Cas 9. FIG. 9A shows the organization of the Cas9 domains, including amino acid positions, in reference to the two lobes of Cas9 (recognition (REC) and nuclease (NUC) lobes). FIG. 9B shows the percent homology of each domain across 83 Cas9 orthologs.

FIGS. 12A-12B depict detected deletion events resulting from co-transfection of exemplary gRNA molecules, BCL11A-2983W and BCL11A-2981W.

FIG. 12A depicts schematic of DNA sequence recognized by BCL11A-2983W and BCL11A-2981W, which flanks the putative erythroid enhancer elements.

FIG. 12B depicts sequenced deletion events from the TOPO cloning of the PCR using primers that flank the enhancer region. A product is obtained when a deletion event has taken place.

FIGS. 13A-13B depicts detected deletion events resulting from co-transfection of the exemplary gRNA molecules, BCL11A-2995W and BCL11A-2984W.

FIG. 13A depicts Schematic of DNA sequence recognized by BCL11A-2995W and BCL11A-2984W, which flanks the putative erythroid enhancer elements.

FIG. 13B depicts sequenced deletion events from the TOPO cloning of the PCR using primers that flank the enhancer region. A product is obtained when a deletion event has taken place.

DETAILED DESCRIPTION

Definitions

Figure 1A:
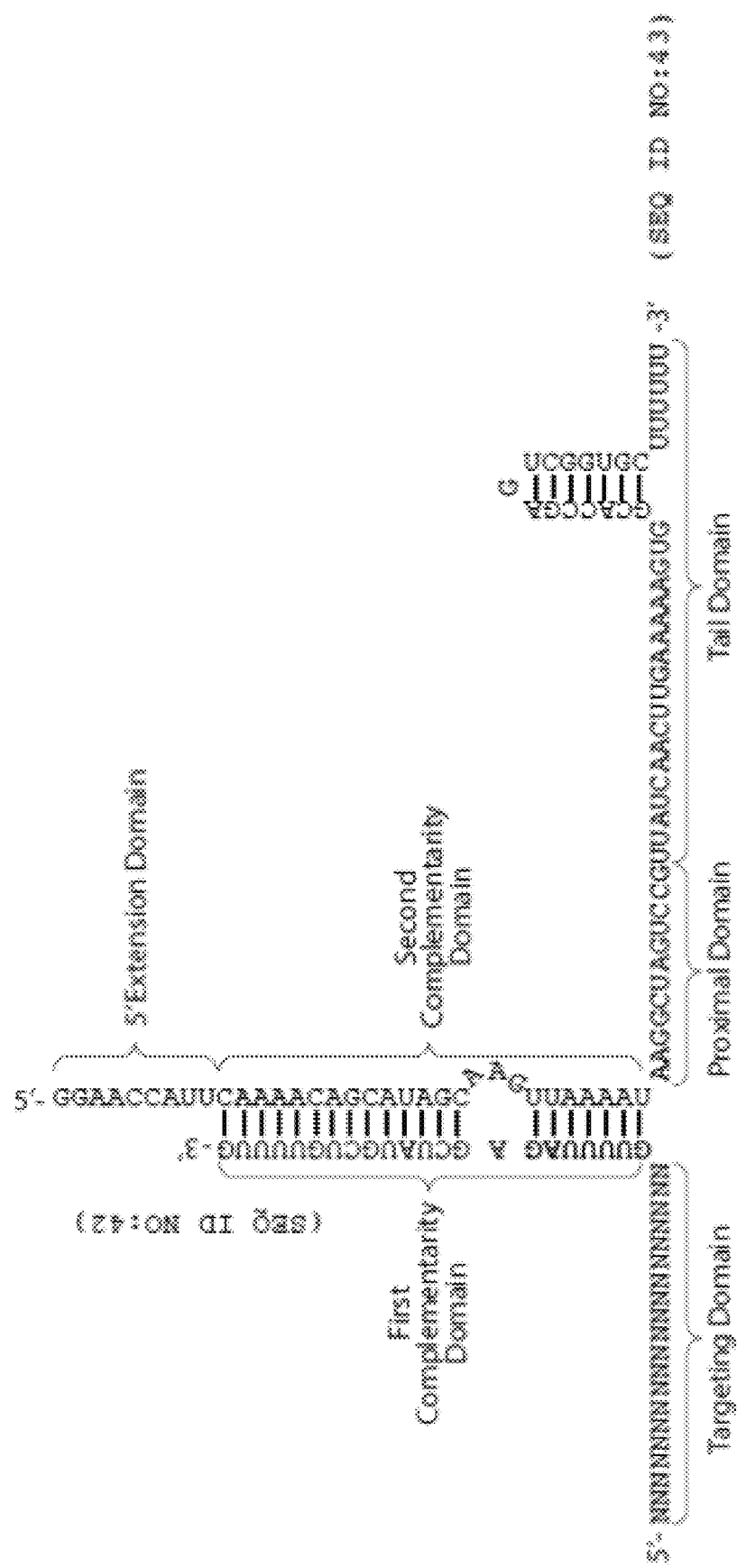

"Alt-HDR" or "alternative HDR", or alternative homology-directed repair, as used herein, refers to the process of repairing DNA damage using a homologous nucleic acid (e.g., an endogenous homologous sequence, e.g., a sister chromatid, or an exogenous nucleic acid, e.g., a template nucleic acid). Alt-HDR is distinct from canonical HDR in that the process utilizes different pathways from canonical HDR, and can be inhibited by the canonical HDR mediators, RAD51 and BRCA2. Also, alt-HDR uses a single-stranded or nicked homologous nucleic acid for repair of the break.

"Canonical HDR", or canonical homology-directed repair, as used herein, refers to the process of repairing DNA damage using a homologous nucleic acid (e.g., an endogenous homologous sequence, e.g., a sister chromatid, or an exogenous nucleic acid, e.g., a template nucleic acid). Canonical HDR typically acts when there has been significant resection at the double strand break, forming at least one single stranded portion of DNA. In a normal cell, HDR typically involves a series of steps such as recognition of the break, stabilization of the break, resection, stabilization of single stranded DNA, formation of a DNA crossover intermediate, resolution of the crossover intermediate, and ligation. The process requires RAD51 and BRCA2, and the homologous nucleic acid is typically double-stranded.

Unless indicated otherwise, the term "HDR" as used herein encompasses canonical HDR and alt-HDR.

"Domain", as used herein, is used to describe segments of a protein or nucleic acid. Unless otherwise indicated, a domain is not required to have any specific functional property.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frame shift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

"Governing gRNA molecule", as used herein, refers to a gRNA molecule that comprises a targeting domain that is complementary to a target domain on a nucleic acid that comprises a sequence that encodes a component of the CRISPR/Cas system that is introduced into a cell or subject. A governing gRNA does not target an endogenous cell or subject sequence. In an embodiment, a governing gRNA molecule comprises a targeting domain that is complementary with a target sequence on: (a) a nucleic acid that encodes a Cas9 molecule; (b) a nucleic acid that encodes a gRNA which comprises a targeting domain that targets the HBB or BCL11A gene (a target gene gRNA); or on more than one nucleic acid that encodes a CRISPR/Cas component, e.g., both (a) and (b). In an embodiment, a nucleic acid molecule that encodes a CRISPR/Cas component, e.g., that encodes a Cas9 molecule or a target gene gRNA, comprises more than one target domain that is complementary with a governing gRNA targeting domain. While not wishing to be bound by theory, it is believed that a governing gRNA molecule complexes with a Cas9 molecule and results in Cas9 mediated inactivation of the targeted nucleic acid, e.g., by cleavage or by binding to the nucleic acid, and results in cessation or reduction of the production of a CRISPR/Cas system component. In an embodiment, the Cas9 molecule forms two complexes: a complex comprising a Cas9 molecule with a target gene gRNA, which complex will alter the HBB or BCL11A gene; and a complex comprising a Cas9 molecule with a governing gRNA molecule, which complex will act to prevent further production of a CRISPR/Cas system component, e.g., a Cas9 molecule or a target gene gRNA molecule. In an embodiment, a governing gRNA molecule/Cas9 molecule complex binds to or promotes cleavage of a control region sequence, e.g., a promoter, operably linked to a sequence that encodes a Cas9 molecule, a sequence that encodes a transcribed region, an exon, or an intron, for the Cas9 molecule. In an embodiment, a governing gRNA molecule/Cas9 molecule complex binds to or promotes cleavage of a control region sequence, e.g., a promoter, operably linked to a gRNA molecule, or a sequence that encodes the gRNA molecule. In an embodiment, the governing gRNA, e.g., a Cas9-targeting governing gRNA molecule, or a target gene gRNA-targeting governing gRNA molecule, limits the effect of the Cas9 molecule/target gene gRNA molecule complex-mediated gene targeting. In an embodiment, a governing gRNA places temporal, level of expression, or other limits, on activity of the Cas9 molecule/target gene gRNA molecule complex. In an embodiment, a governing gRNA reduces off-target or other unwanted activity. In an embodiment, a governing gRNA molecule inhibits, e.g., entirely or substantially entirely inhibits, the production of a component of the Cas9 system and thereby limits, or governs, its activity.

"Modulator", as used herein, refers to an entity, e.g., a drug, that can alter the activity (e.g., enzymatic activity, transcriptional activity, or translational activity), amount, distribution, or structure of a subject molecule or genetic sequence. In an embodiment, modulation comprises cleavage, e.g., breaking of a covalent or non-covalent bond, or the forming of a covalent or non-covalent bond, e.g., the attachment of a moiety, to the subject molecule. In an embodiment, a modulator alters the, three dimensional, secondary, tertiary, or quaternary structure, of a subject molecule. A modulator can increase, decrease, initiate, or eliminate a subject activity.

"Large molecule", as used herein, refers to a molecule having a molecular weight of at least 2, 3, 5, 10, 20, 30, 40, 50, 60, 70, 80, 90, or 100 kD. Large molecules include proteins, polypeptides, nucleic acids, biologics, and carbohydrates.

A "polypeptide", as used herein, refers to a polymer of amino acids having less than 100 amino acid residues. In an embodiment, it has less than 50, 20, or 10 amino acid residues.

"Non-homologous end joining" or "NHEJ", as used herein, refers to ligation mediated repair and/or non-template mediated repair including canonical NHEJ (cNHEJ), alternative NHEJ (altNHEJ), microhomology-mediated end joining (MMEJ), single-strand annealing (SSA), and synthesis-dependent microhomology-mediated end joining (SD-MMEJ).

A "reference molecule", e.g., a reference Cas9 molecule or reference gRNA, as used herein, refers to a molecule to which a subject molecule, e.g., a subject Cas9 molecule of subject gRNA molecule, e.g., a modified or candidate Cas9 molecule is compared. For example, a Cas9 molecule can be characterized as having no more than 10% of the nuclease activity of a reference Cas9 molecule. Examples of reference Cas9 molecules include naturally occurring unmodified Cas9 molecules, e.g., a naturally occurring Cas9 molecule such as a Cas9 molecule of S. pyogenes, S. aureus or S. thermophilus. In an embodiment, the reference Cas9 molecule is the naturally occurring Cas9 molecule having the closest sequence identity or homology with the Cas9 molecule to which it is being compared. In an embodiment, the reference Cas9 molecule is a sequence, e.g., a naturally occurring or known sequence, which is the parental form on which a change, e.g., a mutation has been made.

"Replacement", or "replaced", as used herein with reference to a modification of a molecule does not require a process limitation but merely indicates that the replacement entity is present.

"Small molecule", as used herein, refers to a compound having a molecular weight less than about 2 kD, e.g., less than about 2 kD, less than about 1.5 kD, less than about 1 kD, or less than about 0.75 kD.

"Subject", as used herein, may mean either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats). In an embodiment, the subject is a human. In another embodiment, the subject is poultry.

"Treat", "treating" and "treatment", as used herein, mean the treatment of a disease in a mammal, e.g., in a human, including (a) inhibiting the disease, i.e., arresting or preventing its development; (b) relieving the disease, i.e., causing regression of the disease state; and (c) curing the disease.

"Prevent", "preventing" and "prevention", as used herein, means the prevention of a disease in a mammal, e.g., in a human, including (a) avoiding or precluding the disease; (2) affecting the predisposition toward the disease, e.g., preventing at least one symptom of the disease or to delay onset of at least one symptom of the disease.

"X" as used herein in the context of an amino acid sequence, refers to any amino acid (e.g., any of the twenty natural amino acids) unless otherwise specified.

Methods of Repairing Mutation(s) in the HBB Gene

One approach to treat or prevent SCD is to repair (i.e., correct) one or more mutations in the HBB gene, e.g., by HDR. In this approach, mutant HBB allele(s) are corrected and restored to wild type state. While not wishing to be bound by theory, it is believed that correction of the glutamic acid to valine substitution at amino acid 6 in the beta-globin gene restores wild type beta-globin production within erythroid cells. The method described herein can be performed in all cell types. Beta-globin is expressed in cells of erythroid cell lineage. In an embodiment, an erythroid cell is targeted.

In an embodiment, one HBB allele is repaired in the subject. In another embodiment, both HBB alleles are repaired in the subject. In either situation, the subject can be cured of disease. As the disease only displays a phenotype when both alleles are mutated, repair of a single allele is adequate for a cure.

In one aspect, methods and compositions discussed herein, provide for the correction of the underlying genetic cause of SCD, e.g., the correction of a mutation at a target position in the HBB gene, e.g., correction of a mutation at amino acid position 6, e.g., an E6V substitution in the HBB gene.

In an embodiment, the method provides for the correction of a mutation at a target position in the HBB gene, e.g., correction of a mutation at amino acid position 6, e.g., an E6V substitution in the HBB gene. As described herein, in one embodiment, the method comprises the introduction of one or more breaks (e.g., single strand breaks or double strand breaks) sufficiently close to (e.g., either 5' or 3' to) the target position in the HBB gene. e.g., E6V.

In an embodiment, the targeting domain of the gRNA molecule is configured to provide a cleavage event, e.g., a double strand break or a single strand break, sufficiently close to (e.g., either 5' or 3' to) the target position in the HBB gene, e.g., E6V to allow correction, e.g., an alteration in the HBB gene, e.g., an alternation associated with HDR. In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, 200, 250, 300, 350, 400, 450 or 500 nucleotides of a the target position in the HBB gene, e.g., E6V. The break, e.g., a double strand or single strand break, can be positioned upstream or downstream of the target position in the HBB gene, e.g., E6V.

In an embodiment, a second, third and/or fourth gRNA molecule is configured to provide a cleavage event, e.g., a double strand break or a single strand break, sufficiently close to (e.g., either 5' or 3' to) the target position in the HBB gene, e.g., E6V to allow correction, e.g., an alteration associated with HDR in the HBB gene. In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, 200, 250, 300, 350, 400, 450 or 500 nucleotides of a the target position in the HBB gene, e.g., E6V. The break, e.g., a double strand or single strand break, can be positioned upstream or downstream of the target position in the HBB gene, e.g., E6V.

In an embodiment, a single strand break is accompanied by an additional single strand break, positioned by a second, third and/or fourth gRNA molecule, as discussed below. For example, The targeting domains bind configured such that a cleavage event, e.g., the two single strand breaks, are positioned within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position in the HBB gene, e.g., E6V. In an embodiment, the first and second gRNA molecules are configured such, that when guiding a Cas9 nickase, a single strand break will be accompanied by an additional single strand break, positioned by a second gRNA, sufficiently close to one another to result in an alteration of the target position in the HBB gene, e.g., E6V. In an embodiment, the first and second gRNA molecules are configured such that a single strand break positioned by said second gRNA is within 10, 20, 30, 40, or 50 nucleotides of the break positioned by said first gRNA molecule, e.g., when the Cas9 is a nickase. In an embodiment, the two gRNA molecules are configured to position cuts at the same position, or within a few nucleotides of one another, on different strands, e.g., essentially mimicking a double strand break.

In an embodiment, a double strand break can be accompanied by an additional double strand break, positioned by a second, third and/or fourth gRNA molecule, as is discussed below. For example, the targeting domain of a first gRNA molecule is configured such that a double strand break is positioned upstream of the target position in the HBB gene, e.g., E6V, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position; and the targeting domain of a second gRNA molecule is configured such that a double strand break is positioned downstream the target position in the HBB gene, e.g., E6V, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position.

In an embodiment, a double strand break can be accompanied by two additional single strand breaks, positioned by a second gRNA molecule and a third gRNA molecule. For example, the targeting domain of a first gRNA molecule is configured such that a double strand break is positioned upstream of the target position in the HBB gene, e.g., E6V, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position; and the targeting domains of a second and third gRNA molecule are configured such that two single strand breaks are positioned downstream of the target position in the HBB gene, e.g., E6V, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position. In an embodiment, the targeting domain of the first, second and third gRNA molecules are configured such that a cleavage event, e.g., a double strand or single strand break, is positioned, independently for each of the gRNA molecules.

In an embodiment, a first and second single strand breaks can be accompanied by two additional single strand breaks positioned by a third gRNA molecule and a fourth gRNA molecule. For example, the targeting domain of a first and second gRNA molecule are configured such that two single strand breaks are positioned upstream of the target position in the HBB gene. e.g., E6V, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position in the HBB gene, e.g., E6V; and the targeting domains of a third and fourth gRNA molecule are configured such that two single strand breaks are positioned downstream of the target position in the HBB gene, e.g., E6V, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position in the HBB gene, e.g., E6V.

In an embodiment, a mutation in the HBB gene, e.g., E6V is corrected using an exogenously provided template nucleic acid, e.g., by HDR. In another embodiment, a mutation in the HBB gene. e.g., E6V is corrected without using an exogenously provided template nucleic acid, e.g., by HDR. In an embodiment, alteration of the target sequence occurs with an endogenous genomic donor sequence, e.g., by HDR. In an embodiment, the endogenous genomic donor sequence comprises one or more nucleotides derived from the HBD gene. In an embodiment, a mutation in the HBB gene, e.g., E6V is corrected by an endogenous genomic donor sequence (e.g, an HBD gene). In an embodiment, an eaCas9 molecule, e.g., an eaCas9 molecule described herein, is used. In an embodiment, the eaCas9 molecule comprises HNH-like domain cleavage activity but has no, or no significant, N-terminal RuvC-like domain cleavage activity. In an embodiment, the eaCas9 molecule is an HNH-like domain nickase. In an embodiment, the eaCas9 molecule comprises a mutation at D10 (e.g., D10A). In an embodiment, the eaCas9 molecule comprises N-terminal RuvC-like domain cleavage activity but has no, or no significant, HNH-like domain cleavage activity. In an embodiment, the eaCas9 molecule is an N-terminal RuvC-like domain nickase. In an embodiment, the eaCas9 molecule comprises a mutation at H840 (e.g., H840A) or N863 (e.g., N863A).

Methods of Altering BCL11A

One approach to increase the expression of HbF involves identification of genes whose products play a role in the regulation of globin gene expression. One such gene is BCL11A. It plays a role in the regulation of γ globin expression. It was first identified because of its role in lymphocyte development. BCL11A encodes a zinc finger protein that is thought to be involved in the stage specific regulation of γ globin expression. The BCL11A gene product is expressed in adult erythroid precursor cells and down-regulation of its expression leads to an increase in γ globin expression. In addition, it appears that the splicing of the BCL11A mRNA is developmentally regulated. In embryonic cells, it appears that the shorter BCL11A mRNA variants, known as BCL11A-S and BCL11A-XS are primary expressed, while in adult cells, the longer BCL11A-L and BCL11A-XL mRNA variants are predominantly expressed. See, Sankaran et al (2008) Science 322 p. 1839. The BCL11A protein appears to interact with the β globin locus to alter its conformation and thus its expression at different developmental stages. Thus, if BCL11A expression is altered e.g., disrupted (e.g., reduced or eliminated), it results in the elevation of γ globin and HbF production.

Disclosed herein are methods for altering the SCD target position in the BCL11A gene. Altering the SCD target position is achieved, e.g., by:
(1) knocking out the BCL11A gene:
  (a) insertion or deletion (e.g., NHEJ-mediated insertion or deletion) of one or more nucleotides in close proximity to or within the early coding region of the BCL11A gene, or
  (b) deletion (e.g., NHEJ-mediated deletion) of a genomic sequence including the erythroid enhancer of the BCL11A gene, or
(2) knocking down the BCL11A gene mediated by enzymatically inactive Cas9 (eiCas9) molecule or an eiCas9-fusion protein by targeting the promoter region of the gene.

All approaches give rise to alteration of the BCL11A gene.

In one embodiment, methods described herein introduce one or more breaks near the early coding region in at least one allele of the BCL11A gene. In another embodiment, methods described herein introduce two or more breaks to flank the erythroid enhancer of SCD target knockout position. The two or more breaks remove (e.g., delete) genomic sequence including the erythorid enhancer. In another embodiment, methods described herein comprises knocking down the BCL11A gene mediated by enzymatically inactive Cas9 (eiCas9) molecule or an eiCas9-fusion protein by targeting the promoter region of SCD target knockdown position. All methods described herein result in alteration of the BCL11A gene.

NHEJ-Mediated Introduction of an Indel in Close Proximity to or within the Early Coding Region of the SCD Knockout Position In an embodiment, the method comprises introducing a NHEJ-mediated insertion or deletion of one more nucleotides in close proximity to the SCD target knockout position (e.g., the early coding region) of the BCL11A gene. As described herein, in one embodiment, the method comprises the introduction of one or more breaks (e.g., single strand breaks or double strand breaks) sufficiently close to (e.g., either 5' or 3' to) the early coding region of the SCD target knockout position, such that the break-induced indel could be reasonably expected to span the SCD target knockout position (e.g., the early coding region). While not wishing to be bound by theory, it is believed that NHEJ-mediated repair of the break(s) allows for the NHEJ-mediated introduction of an indel in close proximity to within the early coding region of the SCD target knockout position.

In an embodiment, the targeting domain of the gRNA molecule is configured to provide a cleavage event, e.g., a double strand break or a single strand break, sufficiently close to the early coding region in the BCL11A gene to allow alteration, e.g., alteration associated with NHEJ in the BCL11A gene. In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, 200, 250, 300, 350, 400, 450 or 500 nucleotides of a SCD target knockout position. The break, e.g., a double strand or single strand break, can be positioned upstream or downstream of a SCD target knockout position in the BCL11A gene.

In an embodiment, a second gRNA molecule comprising a second targeting domain is configured to provide a cleavage event, e.g., a double strand break or a single strand break, sufficiently close to the early coding region in the BCL11A gene, to allow alteration, e.g., alteration associated with NHEJ in the BCL11A gene, either alone or in combination with the break positioned by said first gRNA molecule. In an embodiment, the targeting domains of the first and second gRNA molecules are configured such that a cleavage event, e.g., a double strand or single strand break, is positioned, independently for each of the gRNA molecules, within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position. In an embodiment, the breaks, e.g., double strand or single strand breaks, are positioned on both sides of a nucleotide of a SCD target knockout position in the BCL11A gene. In an embodiment, the breaks, e.g., double strand or single strand breaks, are positioned on one side, e.g., upstream or downstream, of a nucleotide of a SCD target knockout position in the BCL11A gene.

In an embodiment, a single strand break is accompanied by an additional single strand break, positioned by a second gRNA molecule, as discussed below. For example, The targeting domains bind configured such that a cleavage event, e.g., the two single strand breaks, are positioned within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the early coding region in the BCL11A gene. In an embodiment, the first and second gRNA molecules are configured such, that when guiding a Cas9 nickase, a single strand break will be accompanied by an additional single strand break, positioned by a second gRNA, sufficiently close to one another to result in alteration of the early coding region in the BCL11A gene. In an embodiment, the first and second gRNA molecules are configured such that a single strand break positioned by said second gRNA is within 10, 20, 30, 40, or 50 nucleotides of the break positioned by said first gRNA molecule, e.g., when the Cas9 is a nickase. In an embodiment, the two gRNA molecules are configured to position cuts at the same position, or within a few nucleotides of one another, on different strands, e.g., essentially mimicking a double strand break.

In an embodiment, a double strand break can be accompanied by an additional double strand break, positioned by a second gRNA molecule, as is discussed below. For example, the targeting domain of a first gRNA molecule is configured such that a double strand break is positioned upstream of the early coding region in the BCL11A gene, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position; and the targeting domain of a second gRNA molecule is configured such that a double strand break is positioned downstream of the early coding region in the BCL11A gene, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position.

In an embodiment, a double strand break can be accompanied by two additional single strand breaks, positioned by a second gRNA molecule and a third gRNA molecule. For example, the targeting domain of a first gRNA molecule is configured such that a double strand break is positioned upstream of the early coding region in the BCL11A gene, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position; and the targeting domains of a second and third gRNA molecule are configured such that two single strand breaks are positioned downstream of the early coding region in the BCL11A gene, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position. In an embodiment, the targeting domain of the first, second and third gRNA molecules are configured such that a cleavage event, e.g., a double strand or single strand break, is positioned, independently for each of the gRNA molecules.

In an embodiment, a first and second single strand breaks can be accompanied by two additional single strand breaks positioned by a third gRNA molecule and a fourth gRNA molecule. For example, the targeting domain of a first and second gRNA molecule are configured such that two single strand breaks are positioned upstream of the early coding region in the BCL11A gene, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the early coding region in the BCL11A gene; and the targeting domains of a third and fourth gRNA molecule are configured such that two single strand breaks are positioned downstream of a SCD target knockout position in the early coding region in the BCL11A gene, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the early coding region in the BCL11A gene.

NHEJ-Mediated Deletion of the Erythroid Enhancer at the SCD Target Position

Figure 10:
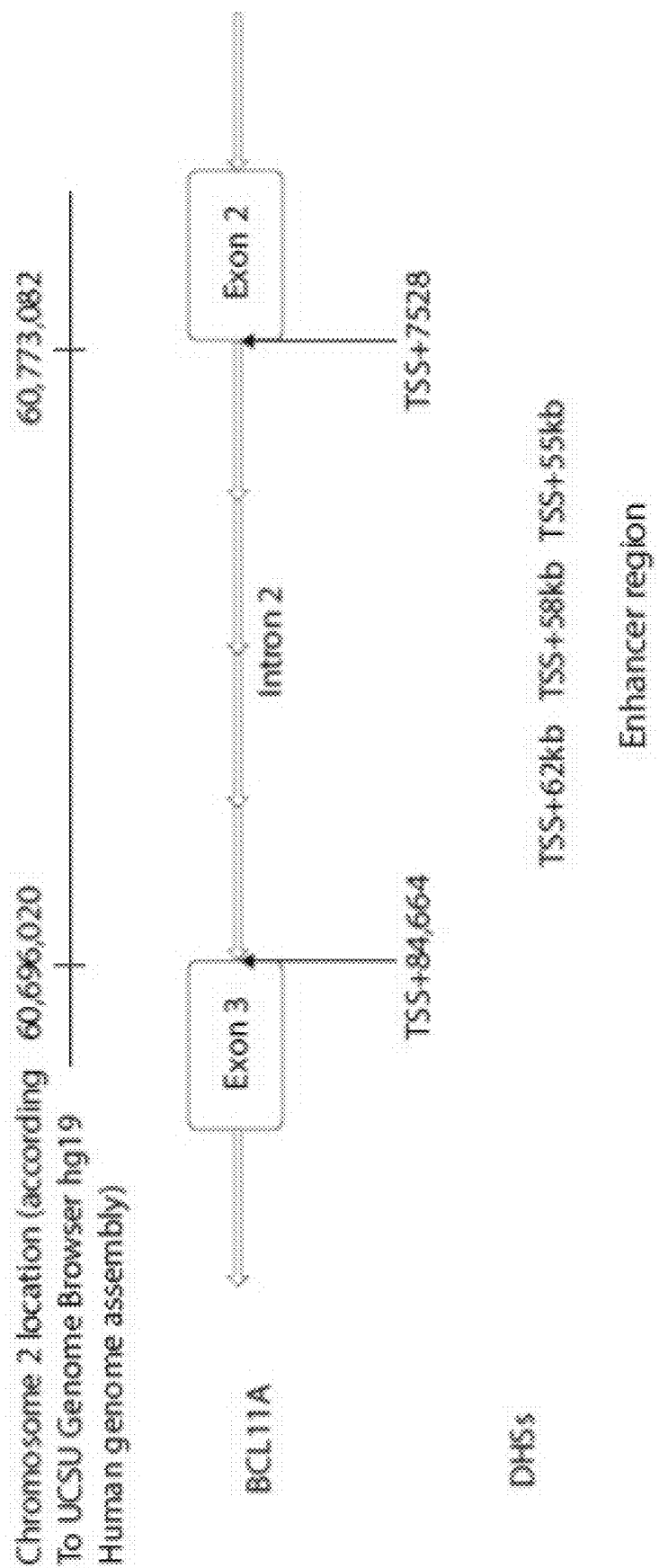
FIG. 10 shows chromosome 2 location (according to UCSC Genome Browser hg 19 human genome assembly) that corresponds to BCL11A intron 2. Three erythroid DHSs are labeled as distance in kilobases from BCL11A TSS (+62, +58 and +55). BCL11A transcription is from right to left.

In an embodiment, the method comprises introducing a NHEJ-mediated deletion of a genomic sequence including the erythroid enhancer. As described herein, in one embodiment, the method comprises the introduction of two double strand breaks—one 5' and the other 3' to (i.e., flanking) the SCD target position (e.g., the erythroid enhancer). Two gRNAs, e.g., unimolecular (or chimeric) or modular gRNA molecules, are configured to position the two double strand breaks on opposite sides of the SCD target knockdown position (e.g., the erythroid enhancer) in the BCL11A gene. In an embodiment, the first double strand break is positioned upstream of the the erythroid enhancer within intron 2 (e.g., between TSS+0.75 kb to TSS+52.0 kb), and the second double strand break is positioned downstream of the the erythroid enhancer within intron 2 (e.g., between TSS+64.4 kb to TSS+84.7 kb) (see FIG. 10). In an embodiment, the two double strand breaks are positioned to remove a portion of the erythroid enhancer resulting in disruption of one or more DHSs. In an embodiment, the breaks (i.e., the two double strand breaks) are positioned to avoid unwanted target chromosome elements, such as repeat elements, e.g., an Alu repeat, or the endogenous splice sites.

The first double strand break may be positioned as follows:

(1) upstream of the 5' end of the erythroid enhancer in intron 2 (e.g., between TSS+0.75 kb to TSS+52.0 kb), or
(2) within the erythroid enhancer provided that a portion of the erythroid enhancer is removed resulting in disruption of one or more DHSs (e.g., between TSS+52.0 kb to TSS+64.4 kb), and the second double strand break to be paired with the first double strand break may be positioned as follows:

(1) downstream the 3' end of the erythroid enhancer in intron 2 (e.g., between TSS+64.4 kb to TSS+84.7 kb), or
(2) within the erythroid enhancer provided that a portion of the erythroid enhancer is removed resulting in disruption of one or more DHSs (e.g., between TSS+52.0 kb to TSS+64.4 kb).

For example, the first double strand break may be positioned in the BCL11A gene:

(1) between TSS+0.75 kb to TSS+10 kb,
(2) between TSS+10 kb to TSS+20 kb,
(3) between TSS+20 kb to TSS+30 kb,
(4) between TSS+30 kb to TSS+40 kb,
(5) between TSS+40 kb to TSS+45 kb,
(6) between TSS+45 kb to TSS+47.5 kb,
(7) between TSS+47.5 kb to TSS+50 kb,
(8) between TSS+50 kb to TSS+51 kb,
(9) between TSS+51 kb to TSS+51.1 kb,
(10) between TSS+51.1 kb to TSS+51.2 kb,
(11) between TSS+51.2 kb to TSS+51.3 kb,
(12) between TSS+51.3 kb to TSS+51.4 kb,
(13) between TSS+51.4 kb to TSS+51.5 kb,
(14) between TSS+51.5 kb to TSS+51.6 kb,
(15) between TSS+51.6 kb to TSS+51.7 kb,
(16) between TSS+51.7 kb to TSS+51.8 kb,
(17) between TSS+51.8 kb to TSS+51.9 kb,
(18) between TSS+51.9 kb to TSS+52 kb,
(19) between TSS+52 kb to TSS+53 kb,
(20) between TSS+53 kb to TSS+54 kb,
(21) between TSS+54 kb to TSS+55 kb,
(22) between TSS+55 kb to TSS+56 kb,
(23) between TSS+56 kb to TSS+57 kb,
(24) between TSS+57 kb to TSS+58 kb,
(25) between TSS+58 kb to TSS+59 kb,
(26) between TSS+59 kb to TSS+60 kb,
(27) between TSS+60 kb to TSS+61 kb,
(28) between TSS+61 kb to TSS+62 kb,
(29) between TSS+62 kb to TSS+63 kb,
(30) between TSS+63 kb to TSS+64 kb, or
(31) between TSS+64 kb to TSS+64.4 kb, and the second double strand break to be paired with the first double strand break may be positioned in the BCL11A gene:

(1) between TSS+52 kb to TSS+53 kb,
(2) between TSS+53 kb to TSS+54 kb,
(3) between TSS+54 kb to TSS+55 kb,
(4) between TSS+55 kb to TSS+56 kb,
(5) between TSS+56 kb to TSS+57 kb,
(6) between TSS+57 kb to TSS+58 kb,
(7) between TSS+58 kb to TSS+59 kb,
(8) between TSS+59 kb to TSS+60 kb,
(9) between TSS+60 kb to TSS+61 kb,
(10) between TSS+61 kb to TSS+62 kb,
(11) between TSS+62 kb to TSS+63 kb,
(12) between TSS+63 kb to TSS+64 kb,
(13) between TSS+64 kb to TSS+64.4 kb,
(14) between TSS+64.4 kb to TSS+65 kb,
(15) between TSS+65 kb to TSS+65.1 kb,
(16) between TSS+65.1 kb to TSS+65.2 kb,

(17) between TSS+65.2 kb to TSS+65.3 kb,
(18) between TSS+65.3 kb to TSS+65.4 kb,
(19) between TSS+65.4 kb to TSS+65.5 kb,
(20) between TSS+65.5 kb to TSS+65.7 kb,
(21) between TSS+65.7 kb to TSS+65.8 kb,
(22) between TSS+65.8 kb to TSS+65.9 kb,
(23) between TSS+65.9 kb to TSS+66 kb,
(24) between TSS+66 kb to TSS+67 kb,
(25) between TSS+67 kb to TSS+68 kb,
(26) between TSS+68 kb to TSS+69 kb,
(27) between TSS+69 kb to TSS+70 kb,
(28) between TSS+70 kb to TSS+75 kb,
(29) between TSS+75 kb to TSS+80 kb, or
(30) between TSS+80 kb to TSS+84.4 kb.

While not wishing to be bound by theory, it is believed that the two double strand breaks allow for NHEJ-mediated deletion of erythroid enhancer in the BCL11A gene.

In an embodiment, the method comprises introducing a NHEJ-mediated deletion of a genomic sequence including the erythroid enhancer. As described herein, in one embodiment, the method comprises the introduction of two sets of breaks (e.g., one double strand break and a pair of single strand breaks)—one 5' and the other 3' to (i.e., flanking) the SCD target position (e.g., the erythroid enhancer). Two gRNAs, e.g., unimolecular (or chimeric) or modular gRNA molecules, are configured to position the two sets of breaks (either the double strand break or the pair of single strand breaks) on opposite sides of the SCD target knockdown position (e.g., the erythroid enhancer) in the BCL11A gene. In an embodiment, the first set of breaks (either the double strand break or the pair of single strand breaks) is positioned upstream of the the erythroid enhancer within intron 2 (e.g., between TSS+0.75 kb to TSS+52.0 kb), and the second set of breaks (either the double strand break or the pair of single strand breaks) is positioned downstream of the the erythroid enhancer within intron 2 (e.g., between TSS+64.4 kb to TSS+84.7 kb) (see FIG. 10). In an embodiment, the two sets of breaks (either the double strand break or the pair of single strand breaks) are positioned to remove a portion of the erythroid enhancer resulting in disruption of one or more DHSs. In an embodiment, the breaks (i.e., the two sets of breaks (either the double strand break or the pair of single strand breaks)) are positioned to avoid unwanted target chromosome elements, such as repeat elements, e.g., an Alu repeat, or the endogenous splice sites.

The first set of breaks (either the double strand break or the pair of single strand breaks) may be positioned as follows:
(1) upstream of the 5' end of the erythroid enhancer in intron 2 (e.g., between TSS+0.75 kb to TSS+52.0 kb), or
(2) within the erythroid enhancer provided that a portion of the erythroid enhancer is removed resulting in disruption of one or more DHSs (e.g., between TSS+52.0 kb to TSS+64.4 kb),
and the second set of breaks (either the double strand break or the pair of single strand breaks) to be paired with the first set of breaks (either the double strand break or the pair of single strand breaks) may be positioned as follows:
(1) downstream the 3' end of the erythroid enhancer in intron 2 (e.g., between TSS+64.4 kb to TSS+84.7 kb), or
(2) within the erythroid enhancer provided that a portion of the erythroid enhancer is removed resulting in disruption of one or more DHSs (e.g., between TSS+52.0 kb to TSS+64.4 kb).

For example, the first set of breaks (either the double strand break or the pair of single strand breaks) may be positioned in the BCL11A gene:
(1) between TSS+0.75 kb to TSS+10 kb,
(2) between TSS+10 kb to TSS+20 kb,
(3) between TSS+20 kb to TSS+30 kb,
(4) between TSS+30 kb to TSS+40 kb,
(5) between TSS+40 kb to TSS+45 kb,
(6) between TSS+45 kb to TSS+47.5 kb,
(7) between TSS+47.5 kb to TSS+50 kb,
(8) between TSS+50 kb to TSS+51 kb,
(9) between TSS+51 kb to TSS+51.1 kb,
(10) between TSS+51.1 kb to TSS+51.2 kb,
(11) between TSS+51.2 kb to TSS+51.3 kb,
(12) between TSS+51.3 kb to TSS+51.4 kb,
(13) between TSS+51.4 kb to TSS+51.5 kb,
(14) between TSS+51.5 kb to TSS+51.6 kb,
(15) between TSS+51.6 kb to TSS+51.7 kb,
(16) between TSS+51.7 kb to TSS+51.8 kb,
(17) between TSS+51.8 kb to TSS+51.9 kb,
(18) between TSS+51.9 kb to TSS+52 kb,
(19) between TSS+52 kb to TSS+53 kb,
(20) between TSS+53 kb to TSS+54 kb,
(21) between TSS+54 kb to TSS+55 kb,
(22) between TSS+55 kb to TSS+56 kb,
(23) between TSS+56 kb to TSS+57 kb,
(24) between TSS+57 kb to TSS+58 kb,
(25) between TSS+58 kb to TSS+59 kb,
(26) between TSS+59 kb to TSS+60 kb,
(27) between TSS+60 kb to TSS+61 kb,
(28) between TSS+61 kb to TSS+62 kb,
(29) between TSS+62 kb to TSS+63 kb,
(30) between TSS+63 kb to TSS+64 kb, or
(31) between TSS+64 kb to TSS+64.4 kb,
and the second set of breaks (either the double strand break or the pair of single strand breaks) to be paired with the first set of breaks (either the double strand break or the pair of single strand breaks) may be positioned in the BCL11A gene:
(1) between TSS+52 kb to TSS+53 kb,
(2) between TSS+53 kb to TSS+54 kb,
(3) between TSS+54 kb to TSS+55 kb,
(4) between TSS+55 kb to TSS+56 kb,
(5) between TSS+56 kb to TSS+57 kb,
(6) between TSS+57 kb to TSS+58 kb,
(7) between TSS+58 kb to TSS+59 kb,
(8) between TSS+59 kb to TSS+60 kb,
(9) between TSS+60 kb to TSS+61 kb,
(10) between TSS+61 kb to TSS+62 kb,
(11) between TSS+62 kb to TSS+63 kb,
(12) between TSS+63 kb to TSS+64 kb,
(13) between TSS+64 kb to TSS+64.4 kb,
(14) between TSS+64.4 kb to TSS+65 kb,
(15) between TSS+65 kb to TSS+65.1 kb,
(16) between TSS+65.1 kb to TSS+65.2 kb,
(17) between TSS+65.2 kb to TSS+65.3 kb,
(18) between TSS+65.3 kb to TSS+65.4 kb,
(19) between TSS+65.4 kb to TSS+65.5 kb,
(20) between TSS+65.5 kb to TSS+65.7 kb,
(21) between TSS+65.7 kb to TSS+65.8 kb,
(22) between TSS+65.8 kb to TSS+65.9 kb,
(23) between TSS+65.9 kb to TSS+66 kb,
(24) between TSS+66 kb to TSS+67 kb,
(25) between TSS+67 kb to TSS+68 kb,
(26) between TSS+68 kb to TSS+69 kb,
(27) between TSS+69 kb to TSS+70 kb,
(28) between TSS+70 kb to TSS+75 kb,

(29) between TSS+75 kb to TSS+80 kb, or
(30) between TSS+80 kb to TSS+84.4 kb.

While not wishing to be bound by theory, it is believed that the two sets of breaks (either the double strand break or the pair of single strand breaks) allow for NHEJ-mediated deletion of erythroid enhancer in the BCL11A gene.

In an embodiment, the method comprises introducing a NHEJ-mediated deletion of a genomic sequence including the erythroid enhancer. As described herein, in one embodiment, the method comprises the introduction of two sets of breaks (e.g., two pairs of single strand breaks)—one 5' and the other 3' to (i.e., flanking) the SCD target position (e.g., the erythroid enhancer). Two gRNAs, e.g., unimolecular (or chimeric) or modular gRNA molecules, are configured to position the two sets of breaks on opposite sides of the SCD target knockdown position (e.g., the erythroid enhancer) in the BCL11A gene. In an embodiment, the first set of breaks (i.e., the first pair of single strand breaks) is positioned upstream of the the erythroid enhancer within intron 2 (e.g., between TSS+0.75 kb to TSS+52.0 kb), and the second set of breaks (i.e., the second pair of single strand breaks) is positioned downstream of the the erythroid enhancer within intron 2 (e.g., between TSS+64.4 kb to TSS+84.7 kb) (see FIG. 10). In an embodiment, the two sets of breaks (e.g., two pairs of single strand breaks)) are positioned to remove a portion of the erythroid enhancer resulting in disruption of one or more DHSs. In an embodiment, the breaks (i.e., the two pairs of single strand breaks) are positioned to avoid unwanted target chromosome elements, such as repeat elements, e.g., an Alu repeat, or the endogenous splice sites.

The first pair of single strand breaks may be positioned as follows:
(1) upstream of the 5' end of the erythroid enhancer in intron 2 (e.g., between TSS+0.75 kb to TSS+52.0 kb), or
(2) within the erythroid enhancer provided that a portion of the erythroid enhancer is removed resulting in disruption of one or more DHSs (e.g., between TSS+52.0 kb to TSS+64.4 kb), and the second pair of single strand breaks to be paired with the first pair of single strand breaks may be positioned as follows:
(1) downstream the 3' end of the erythroid enhancer in intron 2 (e.g., between TSS+64.4 kb to TSS+84.7 kb), or
(2) within the erythroid enhancer provided that a portion of the erythroid enhancer is removed resulting in disruption of one or more DHSs (e.g., between TSS+52.0 kb to TSS+64.4 kb).

For example, the pair of single strand breaks may be positioned in the BCL11A gene:
(1) between TSS+0.75 kb to TSS+10 kb,
(2) between TSS+10 kb to TSS+20 kb,
(3) between TSS+20 kb to TSS+30 kb,
(4) between TSS+30 kb to TSS+40 kb,
(5) between TSS+40 kb to TSS+45 kb,
(6) between TSS+45 kb to TSS+47.5 kb,
(7) between TSS+47.5 kb to TSS+50 kb,
(8) between TSS+50 kb to TSS+51 kb,
(9) between TSS+51 kb to TSS+51.1 kb,
(10) between TSS+51.1 kb to TSS+51.2 kb,
(11) between TSS+51.2 kb to TSS+51.3 kb,
(12) between TSS+51.3 kb to TSS+51.4 kb,
(13) between TSS+51.4 kb to TSS+51.5 kb,
(14) between TSS+51.5 kb to TSS+51.6 kb,
(15) between TSS+51.6 kb to TSS+51.7 kb,
(16) between TSS+51.7 kb to TSS+51.8 kb,
(17) between TSS+51.8 kb to TSS+51.9 kb,
(18) between TSS+51.9 kb to TSS+52 kb,
(19) between TSS+52 kb to TSS+53 kb,
(20) between TSS+53 kb to TSS+54 kb,
(21) between TSS+54 kb to TSS+55 kb,
(22) between TSS+55 kb to TSS+56 kb,
(23) between TSS+56 kb to TSS+57 kb,
(24) between TSS+57 kb to TSS+58 kb,
(25) between TSS+58 kb to TSS+59 kb,
(26) between TSS+59 kb to TSS+60 kb,
(27) between TSS+60 kb to TSS+61 kb,
(28) between TSS+61 kb to TSS+62 kb,
(29) between TSS+62 kb to TSS+63 kb,
(30) between TSS+63 kb to TSS+64 kb, or
(31) between TSS+64 kb to TSS+64.4 kb, and the second pair of single strand breaks to be paired with the first pair of single strand breaks may be positioned in the BCL11A gene:
(1) between TSS+52 kb to TSS+53 kb,
(2) between TSS+53 kb to TSS+54 kb,
(3) between TSS+54 kb to TSS+55 kb,
(4) between TSS+55 kb to TSS+56 kb,
(5) between TSS+56 kb to TSS+57 kb,
(6) between TSS+57 kb to TSS+58 kb,
(7) between TSS+58 kb to TSS+59 kb,
(8) between TSS+59 kb to TSS+60 kb,
(9) between TSS+60 kb to TSS+61 kb,
(10) between TSS+61 kb to TSS+62 kb,
(11) between TSS+62 kb to TSS+63 kb,
(12) between TSS+63 kb to TSS+64 kb,
(13) between TSS+64 kb to TSS+64.4 kb,
(14) between TSS+64.4 kb to TSS+65 kb,
(15) between TSS+65 kb to TSS+65.1 kb,
(16) between TSS+65.1 kb to TSS+65.2 kb,
(17) between TSS+65.2 kb to TSS+65.3 kb,
(18) between TSS+65.3 kb to TSS+65.4 kb,
(19) between TSS+65.4 kb to TSS+65.5 kb,
(20) between TSS+65.5 kb to TSS+65.7 kb,
(21) between TSS+65.7 kb to TSS+65.8 kb,
(22) between TSS+65.8 kb to TSS+65.9 kb,
(23) between TSS+65.9 kb to TSS+66 kb,
(24) between TSS+66 kb to TSS+67 kb,
(25) between TSS+67 kb to TSS+68 kb,
(26) between TSS+68 kb to TSS+69 kb,
(27) between TSS+69 kb to TSS+70 kb,
(28) between TSS+70 kb to TSS+75 kb,
(29) between TSS+75 kb to TSS+80 kb, or
(30) between TSS+80 kb to TSS+84.4 kb.

While not wishing to be bound by theory, it is believed that the two sets of breaks (e.g., the two pair of single strand breaks) allow for NHEJ-mediated deletion of erythroid enhancer in the BCL11A gene.

Knocking Down the BCL11A Gene Mediated by an Enzymatically Inactive Cas9 (eiCas9) Molecule or an eiCas9-Fusion Protein by Targeting the Promoter Region of the Gene.

A targeted knockdown approach reduces or eliminates expression of functional BCL11A gene product. As described herein, a targeted knockdown is mediated by targeting an enzymatically inactive Cas9 (eiCas9) molecule or an eiCas9 fused to a transcription repressor domain or chromatin modifying protein to alter transcription, e.g., to block, reduce, or decrease transcription, of the BCL11A gene. In an embodiment, one or more eiCas9s may be used to block binding of one or more endogenous transcription factors. In another embodiment, an eiCas9 can be fused to a chromatin modifying protein. Altering chromatin status can result in decreased expression of the target gene. One or more eiCas9s fused to one or more chromatin modifying proteins may be used to alter chromatin status.

Methods and compositions discussed herein may be used to alter the expression of the BCL11A gene to treat or prevent SCD by targeting a promoter region of the BCL11A gene. In an embodiment, the promoter region, e.g., at least 2 kb, at least 1.5 kb, at least 1.0 kb, or at least 0.5 kb upstream or downstream of the TSS is targeted to knockdown expression of the BCL11A gene. In an embodiment, the methods and compositions discussed herein may be used to knock down the BCL11A gene to treat or prevent SCD by targeting 0.5 kb upstream or downstream of the TSS. A targeted knockdown approach reduces or eliminates expression of functional BCL11A gene product. As described herein, a targeted knockdown is mediated by targeting an enzymatically inactive Cas9 (eiCas9) molecule or an eiCas9 fused to a transcription repressor domain or chromatin modifying protein to alter transcription, e.g., to block, reduce, or decrease transcription, of the BCL11A gene.

Methods to Treat or Prevent Sickle Cell Disease (SCD)

Disclosed herein are the approaches to treat or prevent SCD, using the compositions and methods described herein.

One approach to treat or prevent SCD is to repair (i.e., correct) one or more mutations in the HBB gene, e.g., by HDR. In this approach, mutant HBB allele(s) are corrected and restored to wild type state. While not wishing to be bound by theory, it is believed that correction of the glutamic acid to valine substitution at amino acid 6 in the beta-globin gene restores wild type beta-globin production within erythroid cells. The method described herein can be performed in all cell types. Beta-globin is expressed in cells of erythroid cell lineage. In an embodiment, an erythroid cell is targeted.

In an embodiment, one HBB allele is repaired in the subject. In another embodiment, both HBB alleles are repaired in the subject. In either situation, the subjects can be cured of disease. As the disease only displays a phenotype when both alleles are mutated, repair of a single allele is adequate for a cure.

In one approach, the BCL11A gene is targeted as a targeted knockout or knockdown, e.g., to increase expression of fetal hemoglobin.

While not wishing to be bound by theory, it is considered that increasing levels of fetal hemoglobin (HbF) in subjects with SCD may ameliorate disease. Fetal hemoglobin can replace beta hemoglobin in the hemoglobin complex, form adequate tetramers with alpha hemoglobin, and effectively carry oxygen to tissues. Subjects with beta-thalassemia who express higher levels of fetal hemoglobin have been found to have a less severe phenotype. Hydroxyurea, often used in the treatment of beta-thalassemia, may exert its mechanism of action via increasing levels of HbF production.

In an embodiment, knockout or knockdown of the BCL11A gene increases fetal hemoglobin levels in beta-thalassemia subjects and improves phenotype and/or reduces or prevents disease progression. BCL11A is a zinc-finger repressor that is involved in the regulation of fetal hemoglobin and acts to repress the synthesis of fetal hemoglobin. Knockout of the BCL11A gene in erythroid cells induces increased fetal hemoglobin (HbF) synthesis and increased HbF can result in more effective oxygen carrying capacity in subjects with beta-thalassemia (HbF will form tetramers with hemoglobin alpha).

In an embodiment, the BCL11A knockout or knockdown is targeted specifically to cells of the erythroid lineage. BCL11A knockout in erythroid cells has been found in in vitro studies to have no effect on erythroid growth, maturation and function. In an embodiment, erythroid cells are preferentially targeted, e.g., at least 90%, 95%, 96%, 97%, 98%, 99%, or 100% of the targeted cells are erythroid cells. For example, in the case of in vivo delivery, erythroid cells are preferentially targeted, and if cells are treated ex vivo and returned to the subject, erythroid cells are preferentially modified.

In an embodiment, the methods described herein result in increased fetal hemoglobin synthesis in beta thalassemia subjects, thereby improving disease phenotype in subjects with SCD. For example, subjects with beta thalassemia major will suffer from less severe anemia and will need fewer blood transfusions. They will therefore have fewer complications arising from transfusions and chelation therapy. In an embodiment, the method described herein increases fetal hemoglobin synthesis and improves the oxygen carrying capacity of erythroid cells. For example, subjects are expected to demonstrate decreased rates of extramedullary erythropoiesis and decreased erythroid hypertrophy within the bone marrow compared to a subject who has not received the therapy. In an embodiment, the method described herein results in reduction of bone fractures, bone abnormalities, splenomegaly, and thrombosis compared to a subject who has not received the therapy.

Knockdown or knockout of one or both BCL11A alleles may be performed prior to disease onset or after disease onset, but preferably early in the disease course.

In an embodiment, the method comprises initiating treatment of a subject prior to disease onset.

In an embodiment, the method comprises initiating treatment of a subject after disease onset.

In an embodiment, the method comprises initiating treatment of a subject well after disease onset, e.g., 1, 2, 3, 4, 5, 6, 7, 8, 9, 10, 12, 16, 24, 36, 48 or more months after onset of SCD. While not wishing to be bound by theory it is believed that this treatment may be effective if subjects present well into the course of illness.

In an embodiment, the method comprises initiating treatment of a subject in an advanced stage of disease.

Overall, initiation of treatment for subjects at all stages of disease is expected to prevent negative consequences of disease and be of benefit to subjects.

In an embodiment, the method comprises initiating treatment of a subject prior to disease expression. In an embodiment, the method comprises initiating treatment of a subject in an early stage of disease, e.g., when a subject has tested positive for beta-thalassemia mutations but has no signs or symptoms associated with beta-thalassemia major, minor or intermedia.

In an embodiment, the method comprises initiating treatment of a subject at the appearance of microcytic anemia, e.g., in an infant, child, adult or young adult.

In an embodiment, the method comprises initiating treatment of a subject who is transfusion-dependent.

In an embodiment, the method comprises initiating treatment of a subject who has tested positive for a mutation in a beta globin gene.

In an embodiment, the method comprises initiating treatment at the appearance of any one or more of the following findings associated or consistent with beta-thalassemia major or beta-thalassemia minor: anemia, diarrhea, fever, failure to thrive, frontal bossing, broken long bones, hepatomegaly, splenomegaly, thrombosis, pulmonary embolus, stroke, leg ulcer, cardiomyopathy, cardiac arrhythmia, and evidence of extramedullary erythropoiesis.

In an embodiment, a cell is treated, e.g., ex vivo. In an embodiment, an ex vivo treated cell is returned to a subject.

In an embodiment, allogenic or autologous bone marrow or erythroid cells are treated ex vivo. In an embodiment, an ex vivo treated allogenic or autologous bone marrow or erythroid cells are administered to the subject. In an embodiment, an erythroid cell, e.g., an autologous erythroid cell, is treated ex vivo and returned to the subject. In an embodiment, an autologous stem cell, is treated ex vivo and returned to the subject. In an embodiment, the modified HSCs are administered to the patient following no myeloablative pre-conditioning. In an embodiment, the modified HSCs are administered to the patient following mild myeloablative pre-conditioning such that following engraftment, some of the hematopoietic cells are devied from the modified HSCs. In other aspects, the HSCs are administered after full myeloablation such that following engraftment, 100% of the hematopoietic cells are derived from the modified HSCs.

In an embodiment, the method comprises delivery of a gRNA molecule and Cas9 molecule by intravenous injection, intramuscular injection, subcutaneous injection, or intra-bone marrow (IBM) injection.

In an embodiment, the method comprises delivery of a gRNA molecule and/or a Cas9 molecule by an AAV. In an embodiment, the method comprises delivery of a gRNA molecule and/or a Cas9 molecule by a lentivirus. In an embodiment, the method comprises delivery of a gRNA molecule and/or a Cas9 molecule by a nanoparticle. In an embodiment, the method comprises delivery of a gRNA molecule by a parvovirus, e.g., a modified parvovirus specifically designed to target bone marrow cells and/or CD4 cells. In an embodiment, two or more gRNA molecules (e.g., a second, third or fourth gRNA molecules) are delivered.

I. gRNA Molecules

A gRNA molecule, as that term is used herein, refers to a nucleic acid that promotes the specific targeting or homing of a gRNA molecule/Cas9 molecule complex to a target nucleic acid. gRNA molecules can be unimolecular (having a single RNA molecule), sometimes referred to herein as "chimeric" gRNAs, or modular (comprising more than one, and typically two, separate RNA molecules). A gRNA molecule comprises a number of domains. The gRNA molecule domains are described in more detail below.

Several exemplary gRNA structures, with domains indicated thereon, are provided in FIGS. 1A-1G. While not wishing to be bound by theory, in an embodiment, with regard to the three dimensional form, or intra- or inter-strand interactions of an active form of a gRNA, regions of high complementarity are sometimes shown as duplexes in FIGS. 1A-1G and other depictions provided herein.

In an embodiment, a unimolecular, or chimeric, gRNA comprises, preferably from 5' to 3':
  a targeting domain (which is complementary to a target nucleic acid in the HBB gene or BCL11A gene, e.g., a targeting domain from any of Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31;
  a first complementarity domain;
  a linking domain;
  a second complementarity domain (which is complementary to the first complementarity domain);
  a proximal domain; and
  optionally, a tail domain.
In an embodiment, a modular gRNA comprises:
  a first strand comprising, preferably from 5' to 3';
  a targeting domain (which is complementary to a target nucleic acid in the HBB gene or BCL11A gene, e.g., a targeting domain from Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31; and
  a first complementarity domain; and
a second strand, comprising, preferably from 5' to 3':
  optionally, a 5' extension domain;
  a second complementarity domain;
  a proximal domain; and
  optionally, a tail domain.
The domains are discussed briefly below.

The Targeting Domain

FIGS. 1A-1G provide examples of the placement of targeting domains.

The targeting domain comprises a nucleotide sequence that is complementary, e.g., at least 80, 85, 90, or 95% complementary, e.g., fully complementary, to the target sequence on the target nucleic acid. The targeting domain is part of an RNA molecule and will therefore comprise the base uracil (U), while any DNA encoding the gRNA molecule will comprise the base thymine (T). While not wishing to be bound by theory, in an embodiment, it is believed that the complementarity of the targeting domain with the target sequence contributes to specificity of the interaction of the gRNA molecule/Cas9 molecule complex with a target nucleic acid. It is understood that in a targeting domain and target sequence pair, the uracil bases in the targeting domain will pair with the adenine bases in the target sequence. In an embodiment, the target domain itself comprises in the 5' to 3' direction, an optional secondary domain, and a core domain. In an embodiment, the core domain is fully complementary with the target sequence. In an embodiment, the targeting domain is 5 to 50 nucleotides in length. The strand of the target nucleic acid with which the targeting domain is complementary is referred to herein as the complementary strand. Some or all of the nucleotides of the domain can have a modification. e.g., a modification found in Section VIII herein.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

Targeting domains are discussed in more detail below.

The First Complementarity Domain

FIGS. 1A-1G provide examples of first complementarity domains.

The first complementarity domain is complementary with the second complementarity domain, and in an embodiment, has sufficient complementarity to the second complementarity domain to form a duplexed region under at least some physiological conditions. In an embodiment, the first complementarity domain is 5 to 30 nucleotides in length. In an embodiment, the first complementarity domain is 5 to 25 nucleotides in length. In an embodiment, the first complementary domain is 7 to 25 nucleotides in length. In an embodiment, the first complementary domain is 7 to 22 nucleotides in length. In an embodiment, the first complementary domain is 7 to 18 nucleotides in length. In an embodiment, the first complementary domain is 7 to 15 nucleotides in length. In an embodiment, the first complementary domain is 5, 6, 7, 8, 9, 10, 11, 12, 13, 14, 15, 16, 17, 18, 19, 20, 21, 22, 23, 24, or 25 nucleotides in length.

In an embodiment, the first complementarity domain comprises 3 subdomains, which, in the 5' to 3' direction are: a 5' subdomain, a central subdomain, and a 3' subdomain. In an embodiment, the 5' subdomain is 4 to 9, e.g., 4, 5, 6, 7, 8 or 9 nucleotides in length. In an embodiment, the central subdomain is 1, 2, or 3, e.g., 1, nucleotide in length. In an embodiment, the 3' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length.

The first complementarity domain can share homology with, or be derived from, a naturally occurring first complementarity domain. In an embodiment, it has at least 50% homology with a first complementarity domain disclosed herein, e.g., an *S. pyogenes, S. aureus* or *S. thermophilus*, first complementarity domain.

Some or all of the nucleotides of the domain can have a modification, e.g., a modification found in Section VIII herein.

First complementarity domains are discussed in more detail below.

The Linking Domain

FIGS. 1A-1G provide examples of linking domains.

A linking domain serves to link the first complementarity domain with the second complementarity domain of a unimolecular gRNA. The linking domain can link the first and second complementarity domains covalently or non-covalently. In an embodiment, the linkage is covalent. In an embodiment, the linking domain covalently couples the first and second complementarity domains, see, e.g., FIGS. 1B-1E. In an embodiment, the linking domain is, or comprises, a covalent bond interposed between the first complementarity domain and the second complementarity domain. Typically the linking domain comprises one or more, e.g., 2, 3, 4, 5, 6, 7, 8, 9, or 10 nucleotides.

In modular gRNA molecules the two molecules are associated by virtue of the hybridization of the complementarity domains see e.g., FIG. 1A.

A wide variety of linking domains are suitable for use in unimolecular gRNA molecules. Linking domains can consist of a covalent bond, or be as short as one or a few nucleotides, e.g., 1, 2, 3, 4, or 5 nucleotides in length. In an embodiment, a linking domain is 2, 3, 4, 5, 6, 7, 8, 9, 10, 15, 20, or 25 or more nucleotides in length. In an embodiment, a linking domain is 2 to 50, 2 to 40, 2 to 30, 2 to 20, 2 to 10, or 2 to 5 nucleotides in length. In an embodiment, a linking domain shares homology with, or is derived from, a naturally occurring sequence, e.g., the sequence of a tracrRNA that is 5' to the second complementarity domain. In an embodiment, the linking domain has at least 50% homology with a linking domain disclosed herein.

Some or all of the nucleotides of the domain can have a modification, e.g., a modification found in Section VIII herein.

Linking domains are discussed in more detail below.

The 5' Extension Domain

In an embodiment, a modular gRNA can comprise additional sequence, 5' to the second complementarity domain, referred to herein as the 5' extension domain, see, e.g., FIG. 1A. In an embodiment, the 5' extension domain is, 2 to 10, 2 to 9, 2 to 8, 2 to 7, 2 to 6, 2 to 5, 2 to 4 nucleotides in length. In an embodiment, the 5' extension domain is 2, 3, 4, 5, 6, 7, 8, 9, or 10 or more nucleotides in length.

The Second Complementarity Domain

FIGS. 1A-1G provides examples of second complementarity domains.

Figure 1B:
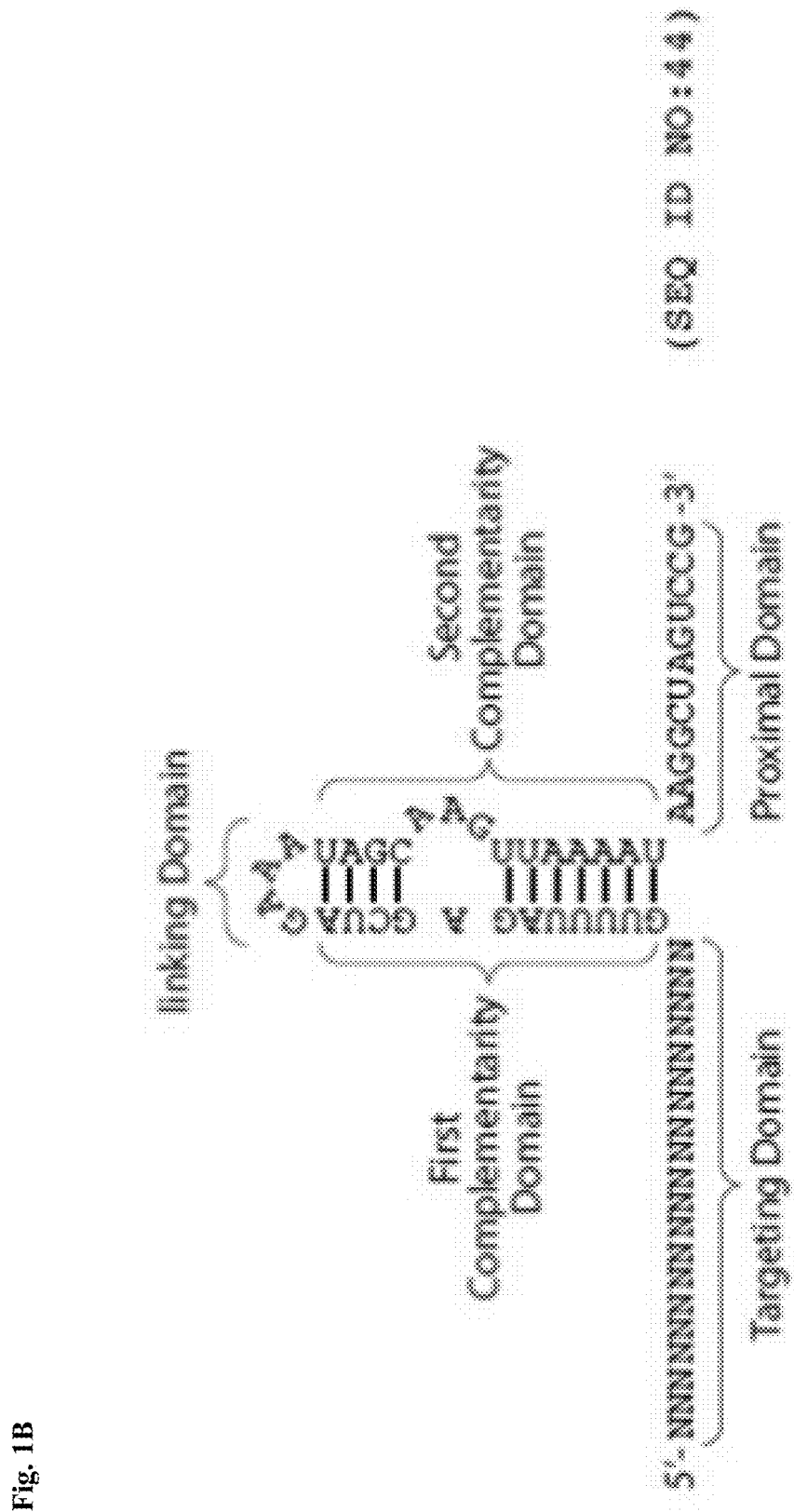
Figure 1C:
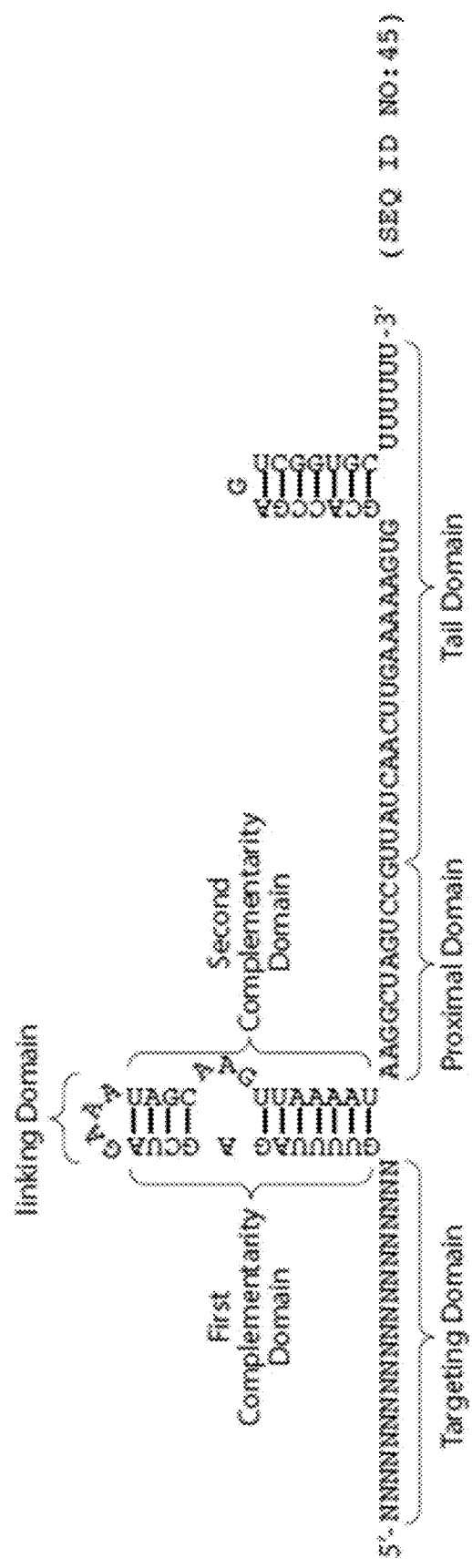
Figure 1D:
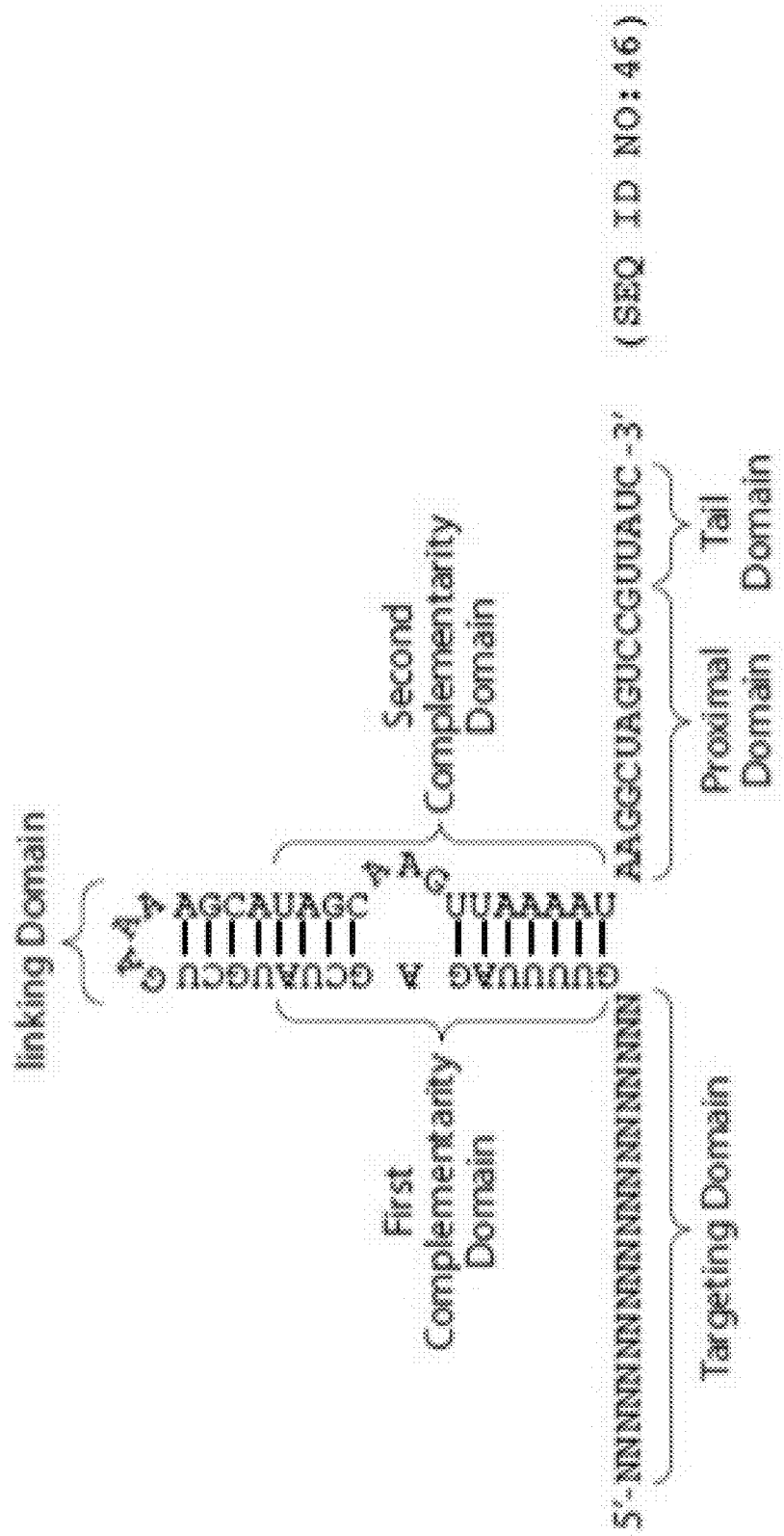
Figure 1E:
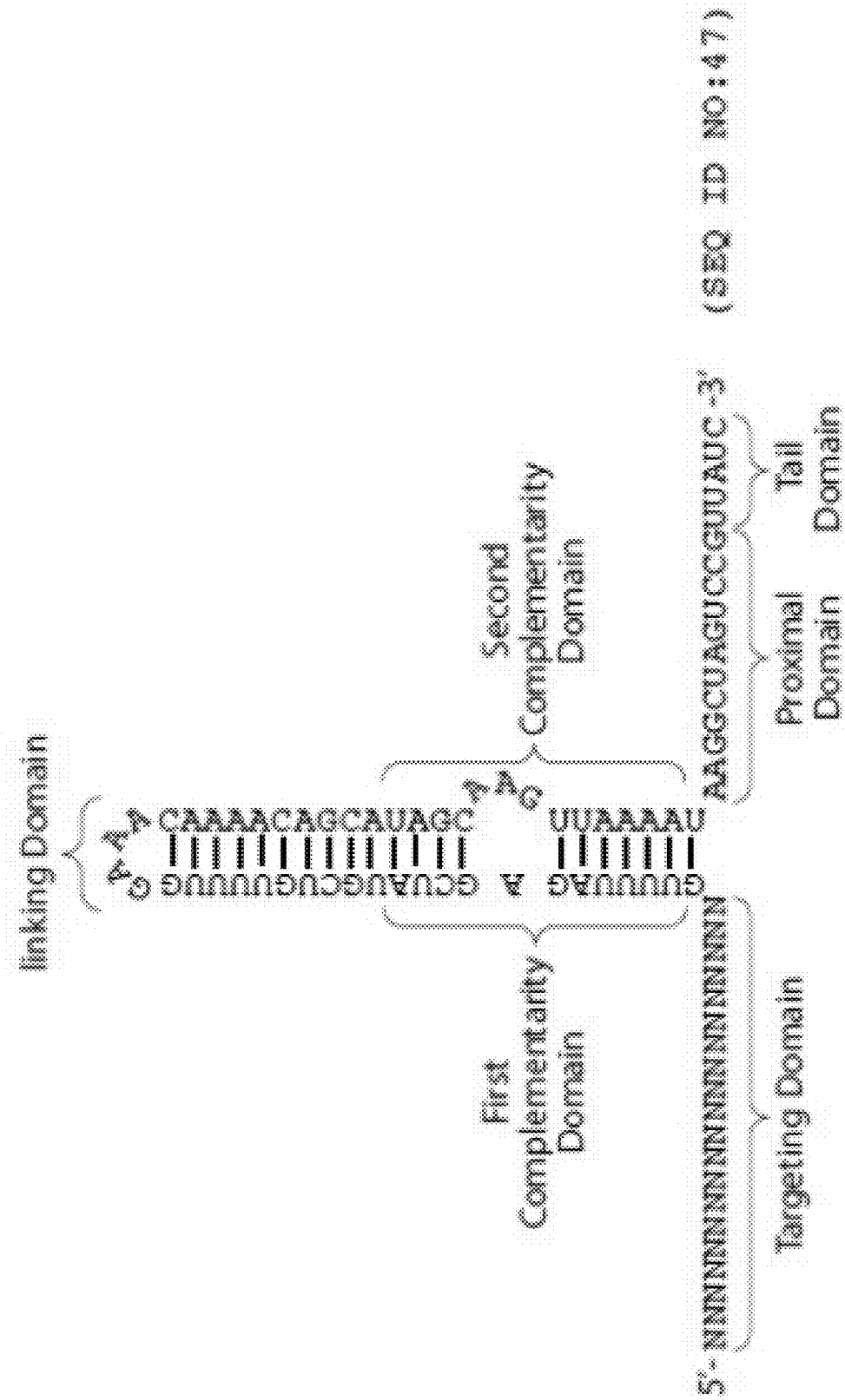
Figure 1F:
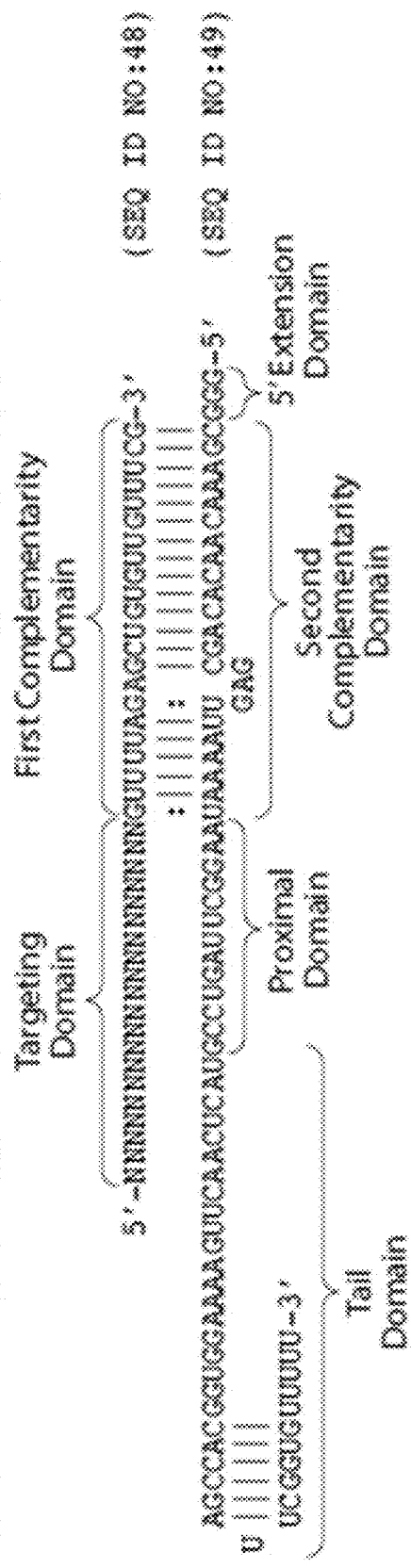

The second complementarity domain is complementary with the first complementarity domain, and in an embodiment, has sufficient complementarity to the second complementarity domain to form a duplexed region under at least some physiological conditions. In an embodiment, e.g., as shown in FIGS. 1A-1B, the second complementarity domain can include sequence that lacks complementarity with the first complementarity domain, e.g., sequence that loops out from the duplexed region.

In an embodiment, the second complementarity domain is 5 to 27 nucleotides in length. In an embodiment, it is longer than the first complementary region. In an embodiment the second complementary domain is 7 to 27 nucleotides in length. In an embodiment, the second complementary domain is 7 to 25 nucleotides in length. In an embodiment, the second complementary domain is 7 to 20 nucleotides in length. In an embodiment, the second complementary domain is 7 to 17 nucleotides in length. In an embodiment, the complementary domain is 5, 6, 7, 8, 9, 10, 11, 12, 13, 14, 15, 16, 17, 18, 19, 20, 21, 22, 23, 24, 25 or 26 nucleotides in length.

In an embodiment, the second complementarity domain comprises 3 subdomains, which, in the 5' to 3' direction are: a 5' subdomain, a central subdomain, and a 3' subdomain. In an embodiment, the 5' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length. In an embodiment, the central subdomain is 1, 2, 3, 4 or 5, e.g., 3, nucleotides in length. In an embodiment, the 3' subdomain is 4 to 9, e.g., 4, 5, 6, 7, 8 or 9 nucleotides in length.

In an embodiment, the 5' subdomain and the 3' subdomain of the first complementarity domain, are respectively, complementary, e.g., fully complementary, with the 3' subdomain and the 5' subdomain of the second complementarity domain.

The second complementarity domain can share homology with or be derived from a naturally occurring second complementarity domain. In an embodiment, it has at least 50% homology with a second complementarity domain disclosed herein, e.g., an *S. pyogenes, S. aureus* or *S. thermophilus*, first complementarity domain.

Some or all of the nucleotides of the domain can have a modification, e.g., a modification found in Section VIII herein.

A Proximal Domain

FIGS. 1A-1G provide examples of proximal domains.

In an embodiment, the proximal domain is 5 to 20 nucleotides in length. In an embodiment, the proximal domain can share homology with or be derived from a naturally occurring proximal domain. In an embodiment, it has at least 50% homology with a proximal domain disclosed herein, e.g., an *S. pyogenes, S. aureus* or *S. thermophilus*, proximal domain.

Some or all of the nucleotides of the domain can have a modification, e.g., modification found in Section VIII herein.

A Tail Domain

FIGS. 1A-1G provide examples of tail domains.

As can be seen by inspection of the tail domains in FIGS. 1A-1E, a broad spectrum of tail domains are suitable for use in gRNA molecules. In an embodiment, the tail domain is 0 (absent), 1, 2, 3, 4, 5, 6, 7, 8, 9, or 10 nucleotides in length. In embodiment, the tail domain nucleotides are from or share homology with sequence from the 5' end of a naturally occurring tail domain, see e.g., panels 4a or 5a of FIG. 1D or FIG. 1E. In an embodiment, the tail domain includes sequences that are complementary to each other and which, under at least some physiological conditions, form a duplexed region.

In an embodiment, the tail domain is absent or is 1 to 50 nucleotides in length. In an embodiment, the tail domain can share homology with or be derived from a naturally occurring proximal tail domain. In an embodiment, it has at least 50% homology with a tail domain disclosed herein, e.g., an *S. pyogenes, S. aureus* or *S. thermophilus*, tail domain.

In an embodiment, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. When a U6 promoter is used for in vivo transcription, these nucleotides may be the sequence UUUUUU. When alternate pol-III promoters are used, these nucleotides may be various numbers or uracil bases or may include alternate bases.

The domains of gRNA molecules are described in more detail below.

The Targeting Domain

The "targeting domain" of the gRNA is complementary to the "target domain" on the target nucleic acid. The strand of the target nucleic acid comprising the nucleotide sequence complementary to the core domain of the gRNA is referred to herein as the "complementary strand" of the target nucleic acid. Guidance on the selection of targeting domains can be found, e.g., in Fu Y et al., Nat Biotechnol 2014 (doi: 10.1038/nbt.2808) and Sternberg S H et al., Nature 2014 (doi: 10.1038/nature13011).

In an embodiment, the targeting domain is 16, 17, 18, 19, 20, 21, 22, 23, 24, 25 or 26 nucleotides in length.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, the targeting domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the targeting domain is 20+/−5 nucleotides in length.

In an embodiment, the targeting domain is 20+/−10, 30+/−10, 40+/−10, 50+/−10, 60+/−10, 70+/−10, 80+/−10, 90+/−10, or 100+/−10 nucleotides, in length.

In an embodiment, the targeting domain is 30+/−10 nucleotides in length.

In an embodiment, the targeting domain is 10 to 100, 10 to 90, 10 to 80, 10 to 70, 10 to 60, 10 to 50, 10 to 40, 10 to 30, 10 to 20 or 10 to 15 nucleotides in length.

In another embodiment, the targeting domain is 20 to 100, 20 to 90, 20 to 80, 20 to 70, 20 to 60, 20 to 50, 20 to 40, 20 to 30, or 20 to 25 nucleotides in length.

Typically the targeting domain has full complementarity with the target sequence. In an embodiment the targeting domain has or includes 1, 2, 3, 4, 5, 6, 7 or 8 nucleotides that are not complementary with the corresponding nucleotide of the targeting domain.

In an embodiment, the target domain includes 1, 2, 3, 4 or 5 nucleotides that are complementary with the corresponding nucleotide of the targeting domain within 5 nucleotides of its 5' end. In an embodiment, the target domain includes 1, 2, 3, 4 or 5 nucleotides that are complementary with the corresponding nucleotide of the targeting domain within 5 nucleotides of its 3' end.

In an embodiment, the target domain includes 1, 2, 3, or 4 nucleotides that are not complementary with the corresponding nucleotide of the targeting domain within 5 nucleotides of its 5' end. In an embodiment, the target domain includes 1, 2, 3, or 4 nucleotides that are not complementary with the corresponding nucleotide of the targeting domain within 5 nucleotides of its 3' end.

In an embodiment, the degree of complementarity, together with other properties of the gRNA, is sufficient to allow targeting of a Cas9 molecule to the target nucleic acid.

In an embodiment, the targeting domain comprises two consecutive nucleotides that are not complementary to the target domain ("non-complementary nucleotides"), e.g., two consecutive noncomplementary nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides within 5 nucleotides of the 5' end of the targeting domain, within 5 nucleotides of the 3' end of the targeting domain, or within a region that is more than 5 nucleotides away from one or both ends of the targeting domain, are not complementary to the targeting domain.

In an embodiment, there are no noncomplementary nucleotides within 5 nucleotides of the 5' end of the targeting domain, within 5 nucleotides of the 3' end of the targeting domain, or within a region that is more than 5 nucleotides away from one or both ends of the targeting domain.

In an embodiment, the targeting domain nucleotides do not comprise modifications, e.g., modifications of the type provided in Section VIII. However, in an embodiment, the targeting domain comprises one or more modifications, e.g., modifications that it render it less susceptible to degradation or more bio-compatible, e.g., less immunogenic. By way of example, the backbone of the targeting domain can be modified with a phosphorothioate, or other modification from Section VIII. In an embodiment, a nucleotide of the targeting domain can comprise a 2' modification (e.g., a modification at the 2' position on ribose), e.g., a 2-acetylation, e.g., a 2' methylation, or other modification(s) from Section VIII.

In an embodiment, the targeting domain includes 1, 2, 3, 4, 5, 6, 7 or 8 or more modifications. In an embodiment, the targeting domain includes 1, 2, 3, or 4 modifications within 5 nucleotides of its 5' end. In an embodiment, the targeting domain comprises as many as 1, 2, 3, or 4 modifications within 5 nucleotides of its 3' end.

In an embodiment, the targeting domain comprises modifications at two consecutive nucleotides, e.g., two consecutive nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides are modified within 5 nucleotides of the 5' end of the targeting domain, within 5 nucleotides of the 3' end of the targeting domain, or within a region that is more than 5 nucleotides away from one or both ends of the targeting domain. In an embodiment, no nucleotide is modified within 5 nucleotides of the 5' end of the targeting domain, within 5 nucleotides of the 3' end of the targeting domain, or within a region that is more than 5 nucleotides away from one or both ends of the targeting domain.

Modifications in the targeting domain can be selected to not interfere with targeting efficacy, which can be evaluated by testing a candidate modification in the system described in Section IV. gRNAs having a candidate targeting domain having a selected length, sequence, degree of complementarity, or degree of modification, can be evaluated in a system in Section IV. The candidate targeting domain can be placed, either alone, or with one or more other candidate changes in a gRNA molecule/Cas9 molecule system known to be functional with a selected target and evaluated.

In an embodiment, all of the modified nucleotides are complementary to and capable of hybridizing to corresponding nucleotides present in the target domain. In another embodiment, 1, 2, 3, 4, 5, 6, 7 or 8 or more modified nucleotides are not complementary to or capable of hybridizing to corresponding nucleotides present in the target domain.

In an embodiment, the targeting domain comprises, preferably in the 5'→3' direction: a secondary domain and a core domain. These domains are discussed in more detail below.

The Core Domain and Secondary Domain of the Targeting Domain

The "core domain" of the targeting domain is complementary to the "core domain target" on the target nucleic acid. In an embodiment, the core domain comprises about 8 to about 13 nucleotides from the 3' end of the targeting domain (e.g., the most 3' 8 to 13 nucleotides of the targeting domain).

In an embodiment, the core domain and targeting domain, are independently, 6+/−2, 7+/−2, 8+/−2, 9+/−2, 10+/−2, 11+/−2, 12+/−2, 13+/−2, 14+/−2, 15+/−2, or 16+−2, nucleotides in length.

In an embodiment, the core domain and targeting domain, are independently, 10+/−2 nucleotides in length.

In an embodiment, the core domain and targeting domain, are independently, 10+/−4 nucleotides in length.

In an embodiment, the core domain and targeting domain are independently 6, 7, 8, 9, 10, 11, 12, 13, 14, 15, 16, 17, or 18 nucleotides in length.

In an embodiment, the core domain and targeting domain are independently 3 to 20, 4 to 20, 5 to 20, 6 to 20, 7 to 20, 8 to 20, 9 to 20 10 to 20 or 15 to 20 nucleotides in length.

In an embodiment, the core domain and targeting domain are independently 3 to 15, e.g., 6 to 15, 7 to 14, 7 to 13, 6 to 12, 7 to 12, 7 to 11, 7 to 10, 8 to 14, 8 to 13, 8 to 12, 8 to 11, 8 to 10 or 8 to 9 nucleotides in length.

The core domain is complementary with the core domain target. Typically the core domain has exact complementarity with the core domain target. In an embodiment, the core domain can have 1, 2, 3, 4 or 5 nucleotides that are not complementary with the corresponding nucleotide of the core domain. In an embodiment, the degree of complementarity, together with other properties of the gRNA, is sufficient to allow targeting of a Cas9 molecule to the target nucleic acid.

The "secondary domain" of the targeting domain of the gRNA is complementary to the "secondary domain target" of the target nucleic acid.

In an embodiment, the secondary domain is positioned 5' to the core domain.

In an embodiment, the secondary domain is absent or optional.

In an embodiment, if the targeting domain is 26 nucleotides in length and the core domain (counted from the 3' end of the targeting domain) is 8 to 13 nucleotides in length, the secondary domain is 12 to 17 nucleotides in length.

In an embodiment, if the targeting domain is 25 nucleotides in length and the core domain (counted from the 3' end of the targeting domain) is 8 to 13 nucleotides in length, the secondary domain is 12 to 17 nucleotides in length.

In an embodiment, if the targeting domain is 24 nucleotides in length and the core domain (counted from the 3' end of the targeting domain) is 8 to 13 nucleotides in length, the secondary domain is 11 to 16 nucleotides in length.

In an embodiment, if the targeting domain is 23 nucleotides in length and the core domain (counted from the 3' end of the targeting domain) is 8 to 13 nucleotides in length, the secondary domain is 10 to 15 nucleotides in length.

In an embodiment, if the targeting domain is 22 nucleotides in length and the core domain (counted from the 3' end of the targeting domain) is 8 to 13 nucleotides in length, the secondary domain is 9 to 14 nucleotides in length.

In an embodiment, if the targeting domain is 21 nucleotides in length and the core domain (counted from the 3' end of the targeting domain) is 8 to 13 nucleotides in length, the secondary domain is 8 to 13 nucleotides in length.

In an embodiment, if the targeting domain is 20 nucleotides in length and the core domain (counted from the 3' end of the targeting domain) is 8 to 13 nucleotides in length, the secondary domain is 7 to 12 nucleotides in length.

In an embodiment, if the targeting domain is 19 nucleotides in length and the core domain (counted from the 3' end of the targeting domain) is 8 to 13 nucleotides in length, the secondary domain is 6 to 11 nucleotides in length.

In an embodiment, if the targeting domain is 18 nucleotides in length and the core domain (counted from the 3' end of the targeting domain) is 8 to 13 nucleotides in length, the secondary domain is 5 to 10 nucleotides in length.

In an embodiment, if the targeting domain is 17 nucleotides in length and the core domain (counted from the 3' end of the targeting domain) is 8 to 13 nucleotides in length, the secondary domain is 4 to 9 nucleotides in length.

In an embodiment, if the targeting domain is 16 nucleotides in length and the core domain (counted from the 3' end of the targeting domain) is 8 to 13 nucleotides in length, the secondary domain is 3 to 8 nucleotides in length.

In an embodiment, the secondary domain is 0, 1, 2, 3, 4, 5, 6, 7, 8, 9, 10, 11, 12, 13, 14 or 15 nucleotides in length.

The secondary domain is complementary with the secondary domain target. Typically the secondary domain has exact complementarity with the secondary domain target. In an embodiment the secondary domain can have 1, 2, 3, 4 or 5 nucleotides that are not complementary with the corresponding nucleotide of the secondary domain. In an embodiment, the degree of complementarity, together with other properties of the gRNA, is sufficient to allow targeting of a Cas9 molecule to the target nucleic acid.

In an embodiment, the core domain nucleotides do not comprise modifications, e.g., modifications of the type provided in Section VIII. However, in an embodiment, the core domain comprises one or more modifications, e.g., modifications that it render it less susceptible to degradation or more bio-compatible, e.g., less immunogenic. By way of example, the backbone of the core domain can be modified with a phosphorothioate, or other modification(s) from Section VIII. In an embodiment a nucleotide of the core domain can comprise a 2' modification (e.g., a modification at the 2' position on ribose), e.g., a 2-acetylation, e.g., a 2' methylation, or other modification(s) from Section VIII. Typically, a core domain will contain no more than 1, 2, or 3 modifications.

Modifications in the core domain can be selected to not interfere with targeting efficacy, which can be evaluated by testing a candidate modification in the system described in Section IV. gRNAs having a candidate core domain having a selected length, sequence, degree of complementarity, or degree of modification, can be evaluated in the system described at Section IV. The candidate core domain can be placed, either alone, or with one or more other candidate changes in a gRNA molecule/Cas9 molecule system known to be functional with a selected target and evaluated.

In an embodiment, the secondary domain nucleotides do not comprise modifications, e.g., modifications of the type provided in Section VIII. However, in an embodiment, the secondary domain comprises one or more modifications, e.g., modifications that render it less susceptible to degradation or more bio-compatible, e.g., less immunogenic. By way of example, the backbone of the secondary domain can be modified with a phosphorothioate, or other modification(s) from Section VIII. In an embodiment a nucleotide of the secondary domain can comprise a 2' modification (e.g., a modification at the 2' position on ribose), e.g., a 2-acetylation, e.g., a 2' methylation, or other modification from Section VIII. Typically, a secondary domain will contain no more than 1, 2, or 3 modifications.

Modifications in the secondary domain can be selected to not interfere with targeting efficacy, which can be evaluated by testing a candidate modification in the system described in Section IV. gRNAs having a candidate secondary domain having a selected length, sequence, degree of complementarity, or degree of modification, can be evaluated in the system described at Section IV. The candidate secondary domain can be placed, either alone, or with one or more other candidate changes in a gRNA molecule/Cas9 molecule system known to be functional with a selected target and evaluated.

In an embodiment, (1) the degree of complementarity between the core domain and its target, and (2) the degree of complementarity between the secondary domain and its target, may differ. In an embodiment, (1) may be greater than (2). In an embodiment, (1) may be less than (2). In an embodiment, (1) and (2) are the same, e.g., each may be completely complementary with its target.

In an embodiment, (1) the number of modifications (e.g., modifications from Section VIII) of the nucleotides of the core domain and (2) the number of modification (e.g., modifications from Section VIII) of the nucleotides of the secondary domain, may differ. In an embodiment, (1) may be less than (2). In an embodiment, (1) may be greater than (2). In an embodiment, (1) and (2) may be the same, e.g., each may be free of modifications.

The First and Second Complementarity Domains

The first complementarity domain is complementary with the second complementarity domain.

Typically the first domain does not have exact complementarity with the second complementarity domain target. In an embodiment, the first complementarity domain can have 1, 2, 3, 4 or 5 nucleotides that are not complementary with the corresponding nucleotide of the second complementarity domain. In an embodiment, 1, 2, 3, 4, 5 or 6, e.g., 3 nucleotides, will not pair in the duplex, and, e.g., form a non-duplexed or looped-out region. In an embodiment, an unpaired, or loop-out, region, e.g., a loop-out of 3 nucleotides, is present on the second complementarity domain. In an embodiment, the unpaired region begins 1, 2, 3, 4, 5, or 6, e.g., 4, nucleotides from the 5' end of the second complementarity domain.

In an embodiment, the degree of complementarity, together with other properties of the gRNA, is sufficient to allow targeting of a Cas9 molecule to the target nucleic acid.

In an embodiment, the first and second complementarity domains are:

independently, 6+/−2, 7+/−2, 8+/−2, 9+/−2, 10+/−2, 11+/−2, 12+/−2, 13+/−2, 14+/−2, 15+/−2, 16+/−2, 17+/−2, 18+/−2, 19+/−2, or 20+/−2, 21+/−2, 22+/−2, 23+/−2, or 24+/−2 nucleotides in length;

independently, 6, 7, 8, 9, 10, 11, 12, 13, 14, 14, 16, 17, 18, 19, 20, 21, 22, 23, 24, 25, or 26, nucleotides in length; or independently, 5 to 24, 5 to 23, 5 to 22, 5 to 21, 5 to 20, 7 to 18, 9 to 16, or 10 to 14 nucleotides in length.

In an embodiment, the second complementarity domain is longer than the first complementarity domain, e.g., 2, 3, 4, 5, or 6, e.g., 6, nucleotides longer.

In an embodiment, the first and second complementary domains, independently, do not comprise modifications, e.g., modifications of the type provided in Section VIII.

In an embodiment, the first and second complementary domains, independently, comprise one or more modifications, e.g., modifications that the render the domain less susceptible to degradation or more bio-compatible, e.g., less immunogenic. By way of example, the backbone of the domain can be modified with a phosphorothioate, or other modification(s) from Section VIII. In an embodiment a nucleotide of the domain can comprise a 2' modification (e.g., a modification at the 2' position on ribose), e.g., a 2-acetylation, e.g., a 2' methylation, or other modification(s) from Section VIII.

In an embodiment, the first and second complementary domains, independently, include 1, 2, 3, 4, 5, 6, 7 or 8 or more modifications. In an embodiment, the first and second complementary domains, independently, include 1, 2, 3, or 4 modifications within 5 nucleotides of its 5' end. In an embodiment, the first and second complementary domains, independently, include as many as 1, 2, 3, or 4 modifications within 5 nucleotides of its 3' end.

In an embodiment, the first and second complementary domains, independently, include modifications at two consecutive nucleotides, e.g., two consecutive nucleotides that are within 5 nucleotides of the 5' end of the domain, within 5 nucleotides of the 3' end of the domain, or more than 5 nucleotides away from one or both ends of the domain. In an embodiment, the first and second complementary domains, independently, include no two consecutive nucleotides that are modified, within 5 nucleotides of the 5' end of the domain, within 5 nucleotides of the 3' end of the domain, or within a region that is more than 5 nucleotides away from one or both ends of the domain. In an embodiment, the first and second complementary domains, independently, include no nucleotide that is modified within 5 nucleotides of the 5' end of the domain, within 5 nucleotides of the 3' end of the domain, or within a region that is more than 5 nucleotides away from one or both ends of the domain.

Modifications in a complementarity domain can be selected to not interfere with targeting efficacy, which can be evaluated by testing a candidate modification in the system described in Section IV. gRNAs having a candidate complementarity domain having a selected length, sequence, degree of complementarity, or degree of modification, can be evaluated in the system described in Section IV. The candidate complementarity domain can be placed, either alone, or with one or more other candidate changes in a gRNA molecule/Cas9 molecule system known to be functional with a selected target and evaluated.

In an embodiment, the first complementarity domain has at least 60, 70, 80, 85%, 90% or 95% homology with, or differs by no more than 1, 2, 3, 4, 5, or 6 nucleotides from, a reference first complementarity domain, e.g., a naturally occurring, e.g., an *S. pyogenes, S. aureus* or *S. thermophilus*, first complementarity domain, or a first complementarity domain described herein, e.g., from FIGS. 1A-1G.

In an embodiment, the second complementarity domain has at least 60, 70, 80, 85%, 90%, or 95% homology with, or differs by no more than 1, 2, 3, 4, 5, or 6 nucleotides from, a reference second complementarity domain, e.g., a naturally occurring, e.g., an *S. pyogenes, S. aureus* or *S. thermophilus*, second complementarity domain, or a second complementarity domain described herein, e.g., from FIGS. 1A-1G.

The duplexed region formed by first and second complementarity domains is typically 6, 7, 8, 9, 10, 11, 12, 13, 14, 15, 16, 17, 18, 19, 20, 21 or 22 base pairs in length (excluding any looped out or unpaired nucleotides).

In an embodiment, the first and second complementarity domains, when duplexed, comprise 11 paired nucleotides, for example, in the gRNA sequence (one paired strand underlined, one bolded): NNNNNNNNNNNNNNNNNNNNGUUUUAGA <u>GCUAGAAAUAGCAAGUUAAAAUAAGG</u> CUAGUCCGUUAUCAACUUGAAAAAGUGGCACCGAGUCGGUGC (SEQ ID NO: 5).

In an embodiment, the first and second complementarity domains, when duplexed, comprise 15 paired nucleotides, for example in the gRNA sequence (one paired strand underlined, one bolded): NNNNNNNNNNNNNNNNNNNNGUUUUAGA <u>GCUAUGCUGAAAAGCAUAGCAAGUUA</u> AAAUAAGGCUAGUCCGUUAUCAAC-UUGAAAAAGUGGCACCGAGUCGGUGC (SEQ ID NO: 27).

In an embodiment the first and second complementarity domains, when duplexed, comprise 16 paired nucleotides, for example in the gRNA sequence (one paired strand underlined, one bolded): NNNNNNNNNNNNNNNNNNNNGUUUUAGA <u>GCUAUGCUGGAAACAGCAUAGCAAGU</u> UAAAAUAAGGCUAGUCCGUUAUCAAC-UUGAAAAAGUGGCACCGAGUCGGUGC (SEQ ID NO: 28).

In an embodiment the first and second complementarity domains, when duplexed, comprise 21 paired nucleotides, for example in the gRNA sequence (one paired strand underlined, one bolded): NNNNNNNNNNNNNNNNNNNNGUUUUAGA <u>GCUAUGCUGUUUUGGAAACAAAACAG</u> CAUAGCAAGUUAAAAUAAGGCUAGUCCGUUAUCAACUUGAAAAAGUGGCACCGA GUCGGUGC (SEQ ID NO: 29).

In an embodiment, nucleotides are exchanged to remove poly-U tracts, for example in the gRNA sequences (exchanged nucleotides underlined):

(SEQ ID NO: 30)
NNNNNNNNNNNNNNNNNNNNNGU<u>A</u>UUAGAGCUAGAAAUAGCAAGUUA<u>A</u>UAU

AAGGCUAGUCCGUUAUCAACUUGAAAAAGUGGCACCGAGUCGGUGC;

(SEQ ID NO: 31)
NNNNNNNNNNNNNNNNNNNNNGUUU<u>A</u>AGAGCUAGAAAUAGCAAGUU<u>U</u>AAAU

-continued

AAGGCUAGUCCGUUAUCAACUUGAAAAAGUGGCACCGAGUCGGUGC;
or (SEQ ID NO: 32)
NNNNNNNNNNNNNNNNNNNNNNNNGUAUUAGAGCUAUGCUGUAUUGGAAACAAU

ACAGCAUAGCAAGUUAAUAUAAGGCUAGUCCGUUAUCAACUUGAAAAAGU

GGCACCGAGUCGGUGC.

The 5' Extension Domain

In an embodiment, a modular gRNA can comprise additional sequence, 5' to the second complementarity domain. In an embodiment, the 5' extension domain is 2 to 10, 2 to 9, 2 to 8, 2 to 7, 2 to 6, 2 to 5, or 2 to 4 nucleotides in length. In an embodiment, the 5' extension domain is 2, 3, 4, 5, 6, 7, 8, 9, or 10 or more nucleotides in length.

In an embodiment, the 5' extension domain nucleotides do not comprise modifications, e.g., modifications of the type provided in Section VIII. However, in an embodiment, the 5' extension domain comprises one or more modifications, e.g., modifications that it render it less susceptible to degradation or more bio-compatible, e.g., less immunogenic. By way of example, the backbone of the 5' extension domain can be modified with a phosphorothioate, or other modification(s) from Section VIII. In an embodiment, a nucleotide of the 5' extension domain can comprise a 2' modification (e.g., a modification at the 2' position on ribose), e.g., a 2-acetylation, e.g., a 2' methylation, or other modification(s) from Section VIII.

In an embodiment, the 5' extension domain can comprise as many as 1, 2, 3, 4, 5, 6, 7 or 8 modifications. In an embodiment, the 5' extension domain comprises as many as 1, 2, 3, or 4 modifications within 5 nucleotides of its 5' end, e.g., in a modular gRNA molecule. In an embodiment, the 5' extension domain comprises as many as 1, 2, 3, or 4 modifications within 5 nucleotides of its 3' end, e.g., in a modular gRNA molecule.

In an embodiment, the 5' extension domain comprises modifications at two consecutive nucleotides, e.g., two consecutive nucleotides that are within 5 nucleotides of the 5' end of the 5' extension domain, within 5 nucleotides of the 3' end of the 5' extension domain, or more than 5 nucleotides away from one or both ends of the 5' extension domain. In an embodiment, no two consecutive nucleotides are modified within 5 nucleotides of the 5' end of the 5' extension domain, within 5 nucleotides of the 3' end of the 5' extension domain, or within a region that is more than 5 nucleotides away from one or both ends of the 5' extension domain. In an embodiment, no nucleotide is modified within 5 nucleotides of the 5' end of the 5' extension domain, within 5 nucleotides of the 3' end of the 5' extension domain, or within a region that is more than 5 nucleotides away from one or both ends of the 5' extension domain.

Modifications in the 5' extension domain can be selected so as to not interfere with gRNA molecule efficacy, which can be evaluated by testing a candidate modification in the system described in Section IV. gRNAs having a candidate 5' extension domain having a selected length, sequence, degree of complementarity, or degree of modification, can be evaluated in the system described at Section IV. The candidate 5' extension domain can be placed, either alone, or with one or more other candidate changes in a gRNA molecule/Cas9 molecule system known to be functional with a selected target and evaluated.

In an embodiment, the 5' extension domain has at least 60, 70, 80, 85, 90 or 95% homology with, or differs by no more than 1, 2, 3, 4, 5, or 6 nucleotides from, a reference 5' extension domain, e.g., a naturally occurring, e.g., an *S. pyogenes, S. aureus* or *S. thermophilus,* 5' extension domain, or a 5' extension domain described herein, e.g., from FIGS. 1A-1G.

The Linking Domain

In a unimolecular gRNA molecule the linking domain is disposed between the first and second complementarity domains. In a modular gRNA molecule, the two molecules are associated with one another by the complementarity domains.

In an embodiment, the linking domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the linking domain is 20+/−10, 30+/−10, 40+/−10, 50+/−10, 60+/−10, 70+/−10, 80+/−10, 90+/−10, or 100+/−10 nucleotides, in length.

In an embodiment, the linking domain is 10 to 100, 10 to 90, 10 to 80, 10 to 70, 10 to 60, 10 to 50, 10 to 40, 10 to 30, 10 to 20 or 10 to 15 nucleotides in length.

In another embodiment, the linking domain is 20 to 100, 20 to 90, 20 to 80, 20 to 70, 20 to 60, 20 to 50, 20 to 40, 20 to 30, or 20 to 25 nucleotides in length.

In an embodiment, the linking domain is 1, 2, 3, 4, 5, 6, 7, 8, 9, 10, 11, 12, 13, 14, 15, 16 17, 18, 19, or 20 nucleotides in length.

In and embodiment, the linking domain is a covalent bond.

In an embodiment, the linking domain comprises a duplexed region, typically adjacent to or within 1, 2, or 3 nucleotides of the 3' end of the first complementarity domain and/or the S-end of the second complementarity domain. In an embodiment, the duplexed region can be 20+/−10 base pairs in length. In an embodiment, the duplexed region can be 10+/−5, 15+/−5, 20+/−5, or 30+/−5 base pairs in length. In an embodiment, the duplexed region can be 1, 2, 3, 4, 5, 6, 7, 8, 9, 10, 11, 12, 13, 14, or 15 base pairs in length.

Typically the sequences forming the duplexed region have exact complementarity with one another, though in an embodiment as many as 1, 2, 3, 4, 5, 6, 7 or 8 nucleotides are not complementary with the corresponding nucleotides.

In an embodiment, the linking domain nucleotides do not comprise modifications, e.g., modifications of the type provided in Section VIII. However, in an embodiment, the linking domain comprises one or more modifications, e.g., modifications that it render it less susceptible to degradation or more bio-compatible, e.g., less immunogenic. By way of example, the backbone of the linking domain can be modified with a phosphorothioate, or other modification(s) from Section VIII. In an embodiment a nucleotide of the linking domain can comprise a 2' modification (e.g., a modification at the 2' position on ribose), e.g., a 2-acetylation, e.g., a 2' methylation, or other modification(s) from Section VIII. In an embodiment, the linking domain can comprise as many as 1, 2, 3, 4, 5, 6, 7 or 8 modifications.

Modifications in a linking domain can be selected so as to not interfere with targeting efficacy, which can be evaluated by testing a candidate modification in the system described in Section IV. gRNAs having a candidate linking domain having a selected length, sequence, degree of complementarity, or degree of modification, can be evaluated a system described in Section IV. A candidate linking domain can be placed, either alone, or with one or more other candidate changes in a gRNA molecule/Cas9 molecule system known to be functional with a selected target and evaluated.

In an embodiment, the linking domain has at least 60, 70, 80, 85, 90 or 95% homology with, or differs by no more than 1, 2, 3, 4, 5, or 6 nucleotides from, a reference linking domain, e.g., a linking domain described herein, e.g., from FIGS. 1A-1G.

The Proximal Domain

In an embodiment, the proximal domain is 6+/−2, 7+/−2, 8+/−2, 9+/−2, 10+/−2, 11+/−2, 12+/−2, 13+/−2, 14+/−2, 14+/−2, 16+/−2, 17+/−2, 18+/−2, 19+/−2, or 20+/−2 nucleotides in length.

In an embodiment, the proximal domain is 6, 7, 8, 9, 10, 11, 12, 13, 14, 15, 16, 17, 18, 19, 20, 21, 22, 23, 24, 25 or 26 nucleotides in length.

In an embodiment, the proximal domain is 5 to 20, 7, to 18, 9 to 16, or 10 to 14 nucleotides in length.

In an embodiment, the proximal domain nucleotides do not comprise modifications, e.g., modifications of the type provided in Section VIII. However, in an embodiment, the proximal domain comprises one or more modifications, e.g., modifications that it render it less susceptible to degradation or more bio-compatible, e.g., less immunogenic. By way of example, the backbone of the proximal domain can be modified with a phosphorothioate, or other modification(s) from Section VIII. In an embodiment a nucleotide of the proximal domain can comprise a 2' modification (e.g., a modification at the 2' position on ribose), e.g., a 2-acetylation, e.g., a 2' methylation, or other modification(s) from Section VIII.

In an embodiment, the proximal domain can comprise as many as 1, 2, 3, 4, 5, 6, 7 or 8 modifications. In an embodiment, the proximal domain comprises as many as 1, 2, 3, or 4 modifications within 5 nucleotides of its 5' end, e.g., in a modular gRNA molecule. In an embodiment, the target domain comprises as many as 1, 2, 3, or 4 modifications within 5 nucleotides of its 3' end, e.g., in a modular gRNA molecule.

In an embodiment, the proximal domain comprises modifications at two consecutive nucleotides, e.g., two consecutive nucleotides that are within 5 nucleotides of the 5' end of the proximal domain, within 5 nucleotides of the 3' end of the proximal domain, or more than 5 nucleotides away from one or both ends of the proximal domain. In an embodiment, no two consecutive nucleotides are modified within 5 nucleotides of the 5' end of the proximal domain, within 5 nucleotides of the 3' end of the proximal domain, or within a region that is more than 5 nucleotides away from one or both ends of the proximal domain. In an embodiment, no nucleotide is modified within 5 nucleotides of the 5' end of the proximal domain, within 5 nucleotides of the 3' end of the proximal domain, or within a region that is more than 5 nucleotides away from one or both ends of the proximal domain.

Modifications in the proximal domain can be selected so as to not interfere with gRNA molecule efficacy, which can be evaluated by testing a candidate modification in the system described in Section IV. gRNAs having a candidate proximal domain having a selected length, sequence, degree of complementarity, or degree of modification, can be evaluated in the system described at Section IV. The candidate proximal domain can be placed, either alone, or with one or more other candidate changes in a gRNA molecule/Cas9 molecule system known to be functional with a selected target and evaluated.

In an embodiment, the proximal domain has at least 60, 70, 80, 85 90 or 95% homology with, or differs by no more than 1, 2, 3.4, 5, or 6 nucleotides from, a reference proximal domain, e.g., a naturally occurring, e.g., an S. pyogenes, S. aureus or S. thermophilus, proximal domain, or a proximal domain described herein, e.g., from FIGS. 1A-1G.

The Tail Domain

In an embodiment, the tail domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the tail domain is 20+/−5 nucleotides in length.

In an embodiment, the tail domain is 20+/−10, 30+/−10, 40+/−10, 50+/−10, 60+/−10, 70+/−10, 80+/−10, 90+/−10, or 100+/−10 nucleotides, in length.

In an embodiment, the tail domain is 25+/−10 nucleotides in length.

In an embodiment, the tail domain is 10 to 100, 10 to 90, 10 to 80, 10 to 70, 10 to 60, 10 to 50, 10 to 40, 10 to 30, 10 to 20 or 10 to 15 nucleotides in length.

In another embodiment, the tail domain is 20 to 100, 20 to 90, 20 to 80, 20 to 70, 20 to 60, 20 to 50, 20 to 40, 20 to 30, or 20 to 25 nucleotides in length.

In an embodiment, the tail domain is 1 to 20, 1 to 15, 1 to 10, or 1 to 5 nucleotides in length.

In an embodiment, the tail domain nucleotides do not comprise modifications, e.g., modifications of the type provided in Section VIII. However, in an embodiment, the tail domain comprises one or more modifications, e.g., modifications that it render it less susceptible to degradation or more bio-compatible, e.g., less immunogenic. By way of example, the backbone of the tail domain can be modified with a phosphorothioate, or other modification(s) from Section VIII. In an embodiment a nucleotide of the tail domain can comprise a 2' modification (e.g., a modification at the 2' position on ribose), e.g., a 2-acetylation, e.g., a 2' methylation, or other modification(s) from Section VIII.

In an embodiment, the tail domain can have as many as 1, 2, 3, 4, 5, 6, 7 or 8 modifications. In an embodiment, the target domain comprises as many as 1, 2, 3, or 4 modifications within 5 nucleotides of its 5' end. In an embodiment, the target domain comprises as many as 1, 2, 3, or 4 modifications within 5 nucleotides of its 3' end.

In an embodiment, the tail domain comprises a tail duplex domain, which can form a tail duplexed region. In an embodiment, the tail duplexed region can be 3, 4, 5, 6, 7, 8, 9, 10, 11, or 12 base pairs in length. In an embodiment, a further single stranded domain, exists 3' to the tail duplexed domain. In an embodiment, this domain is 3, 4, 5, 6, 7, 8, 9, or 10 nucleotides in length. In an embodiment it is 4 to 6 nucleotides in length.

In an embodiment, the tail domain has at least 60, 70, 80, or 90% homology with, or differs by no more than 1, 2, 3, 4, 5, or 6 nucleotides from, a reference tail domain, e.g., a naturally occurring, e.g., an S. pyogenes, S. aureus or S. thermophilus, tail domain, or a tail domain described herein, e.g., from FIGS. 1A-1G.

In an embodiment, the proximal and tail domain, taken together comprise the following sequences:

```
                                          (SEQ ID NO: 33)
AAGGCUAGUCCGUUAUCAACUUGAAAAAGUGGCACCGAGUCGGUGCU,
or
                                          (SEQ ID NO: 34)
AAGGCUAGUCCGUUAUCAACUUGAAAAAGUGGCACCGAGUCGGUGGUGC,
or
                                          (SEQ ID NO: 35)
AAGGCUAGUCCGUUAUCAACUUGAAAAAGUGGCACCGAGUCGGUGCGGA
UC,
or
```

-continued

AAGGCUAGUCCGUUAUCAACUUGAAAAAGUG, (SEQ ID NO: 36)
or

AAGGCUAGUCCGUUAUCA, (SEQ ID NO: 37)
or

AAGGCUAGUCCG. (SEQ ID NO: 38)

In an embodiment, the tail domain comprises the 3' sequence UUUUUU, e.g., if a U6 promoter is used for transcription.

In an embodiment, the tail domain comprises the 3' sequence UUUU, e.g., if an H1 promoter is used for transcription.

In an embodiment, tail domain comprises variable numbers of 3' Us depending, e.g., on the termination signal of the pol-III promoter used.

In an embodiment, the tail domain comprises variable 3' sequence derived from the DNA template if a T7 promoter is used.

In an embodiment, the tail domain comprises variable 3' sequence derived from the DNA template, e.g., if in vitro transcription is used to generate the RNA molecule.

In an embodiment, the tail domain comprises variable 3' sequence derived from the DNA template, e., if a pol-II promoter is used to drive transcription.

Modifications in the tail domain can be selected to not interfere with targeting efficacy, which can be evaluated by testing a candidate modification in the system described in Section IV. gRNAs having a candidate tail domain having a selected length, sequence, degree of complementarity, or degree of modification, can be evaluated in the system described in Section IV. The candidate tail domain can be placed, either alone, or with one or more other candidate changes in a gRNA molecule/Cas9 molecule system known to be functional with a selected target and evaluated.

In an embodiment, the tail domain comprises modifications at two consecutive nucleotides, e.g., two consecutive nucleotides that are within 5 nucleotides of the 5' end of the tail domain, within 5 nucleotides of the 3' end of the tail domain, or more than 5 nucleotides away from one or both ends of the tail domain. In an embodiment, no two consecutive nucleotides are modified within 5 nucleotides of the 5' end of the tail domain, within 5 nucleotides of the 3' end of the tail domain, or within a region that is more than 5 nucleotides away from one or both ends of the tail domain. In an embodiment, no nucleotide is modified within 5 nucleotides of the 5' end of the tail domain, within 5 nucleotides of the 3' end of the tail domain, or within a region that is more than 5 nucleotides away from one or both ends of the tail domain.

In an embodiment a gRNA has the following structure:
5' [targeting domain]-[first complementarity domain]-[linking domain]-[second complementarity domain]-[proximal domain]-[tail domain]-3'
wherein, the targeting domain comprises a core domain and optionally a secondary domain, and is 10 to 50 nucleotides in length;
the first complementarity domain is 5 to 25 nucleotides in length and, In an embodiment has at least 50, 60, 70, 80, 85, 90 or 95% homology with a reference first complementarity domain disclosed herein;
the linking domain is 1 to 5 nucleotides in length;
the second complementarity domain is 5 to 27 nucleotides in length and, in an embodiment has at least 50, 60, 70, 80, 85, 90 or 95% homology with a reference second complementarity domain disclosed herein;
the proximal domain is 5 to 20 nucleotides in length and, in an embodiment has at least 50, 60, 70, 80, 85, 90 or 95% homology with a reference proximal domain disclosed herein; and
the tail domain is absent or a nucleotide sequence is 1 to 50 nucleotides in length and, in an embodiment has at least 50, 60, 70, 80, 85, 90 or 95% homology with a reference tail domain disclosed herein.

Exemplary Chimeric gRNAs

In an embodiment, a unimolecular, or chimeric, gRNA comprises, preferably from 5' to 3':
   a targeting domain (which is complementary to a target nucleic acid);
   a first complementarity domain, e.g., comprising 15, 16, 17, 18, 19, 20, 21, 22, 23, 24, 25, or 26 nucleotides;
   a linking domain;
   a second complementarity domain (which is complementary to the first complementarity domain);
   a proximal domain; and
   a tail domain,
   wherein,
   (a) the proximal and tail domain, when taken together, comprise at least 15, 18, 20, 25, 30, 31, 35, 40, 45, 49, 50, or 53 nucleotides;
   (b) there are at least 15, 18, 20, 25, 30, 31, 35, 40, 45, 49, 50, or 53 nucleotides 3' to the last nucleotide of the second complementarity domain; or
   (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25, or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleo- In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number: NNNNNNNNNNNNNNNNNNNNGUUUUAGAGCUA-GAAAUAGCAAGUUAAAAUAAGG CUAGU-CCGUUAUCAACUUGAAAAAGUGGCACCGAGUCG-GUGCUUUUUU (SEQ ID NO: 45). In an embodiment, the unimolecular, or chimeric, gRNA molecule is a S. pyogenes gRNA molecule.

In some embodiments, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number: NNNNNNNNNNNNNNNNNNNNGUUUUAGUACU-CUGGAAACAGAAUCUACUAAAAC AAGGCAAAAUGCCGUGUUUAUCUCGUCAACUU-GUUGGCGAGAUUUUUU (SEQ ID NO: 40). In an embodiment, the unimolecular, or chimeric, gRNA molecule is a S. aureus gRNA molecule.

Figure 1H:
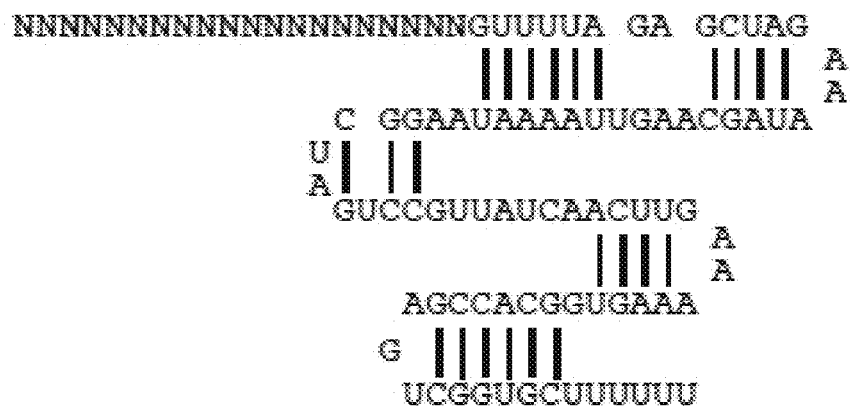
Figure 1I:
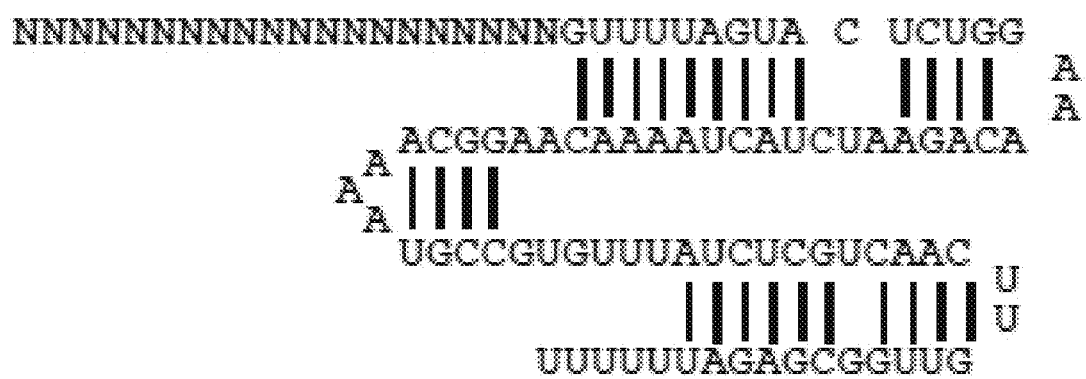
Figure 2D:
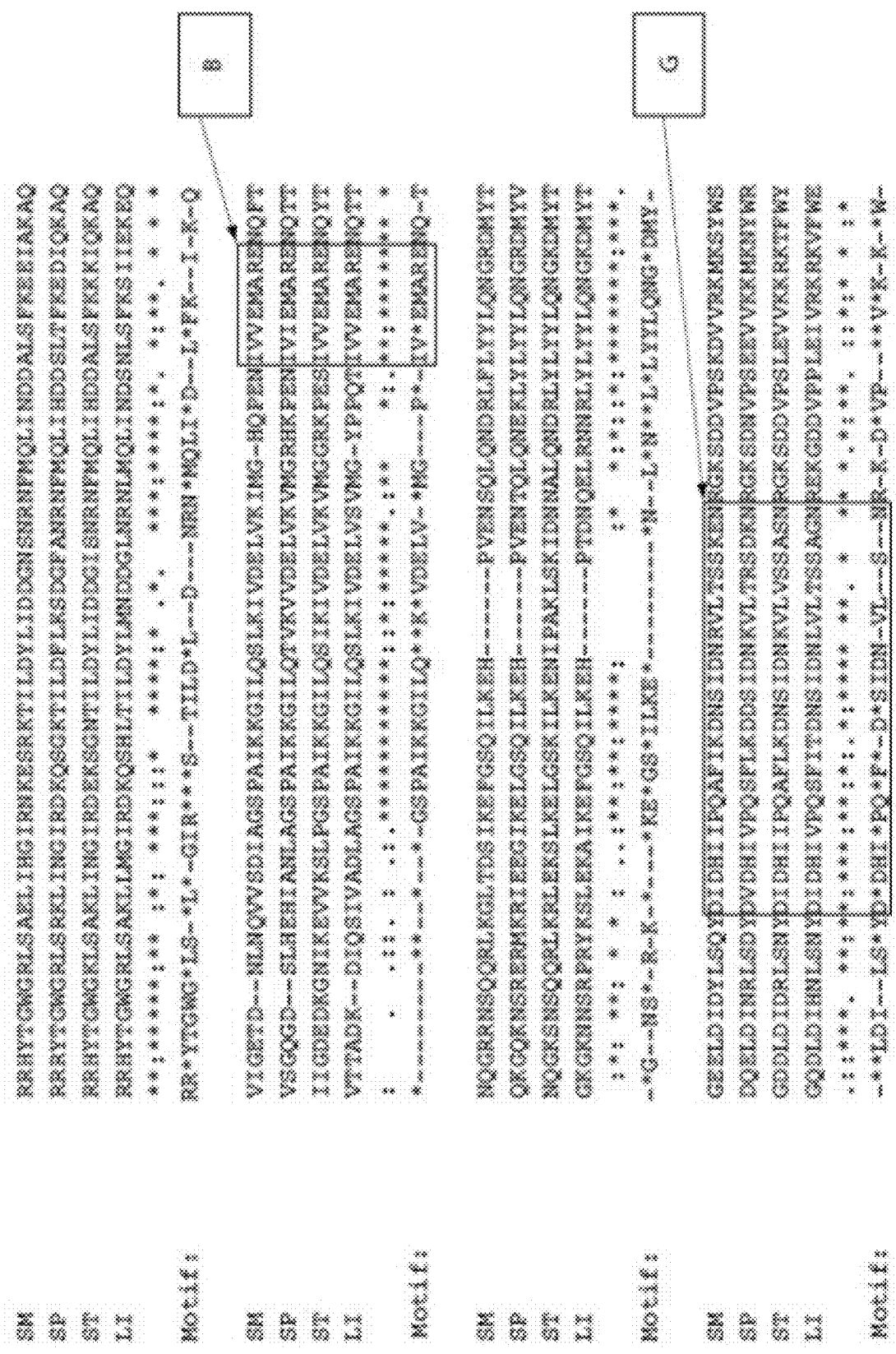
Figure 3B:
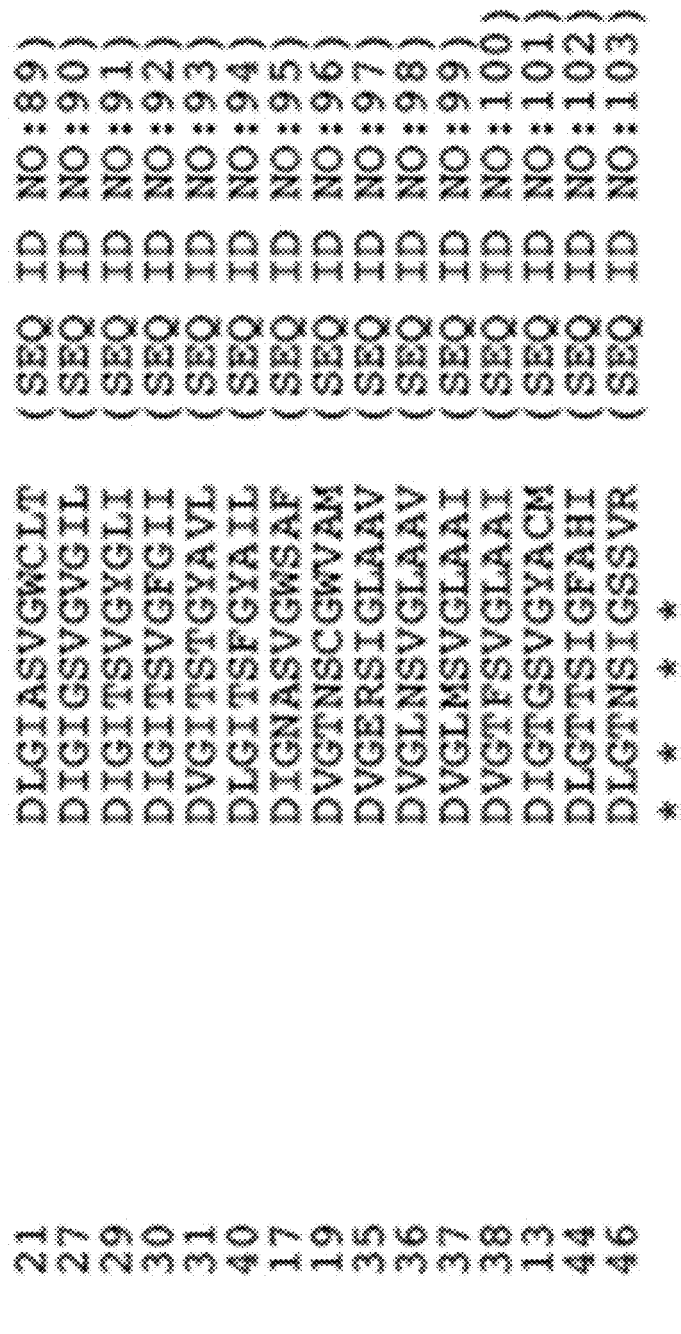
Figure 4B:
Figure 5B:
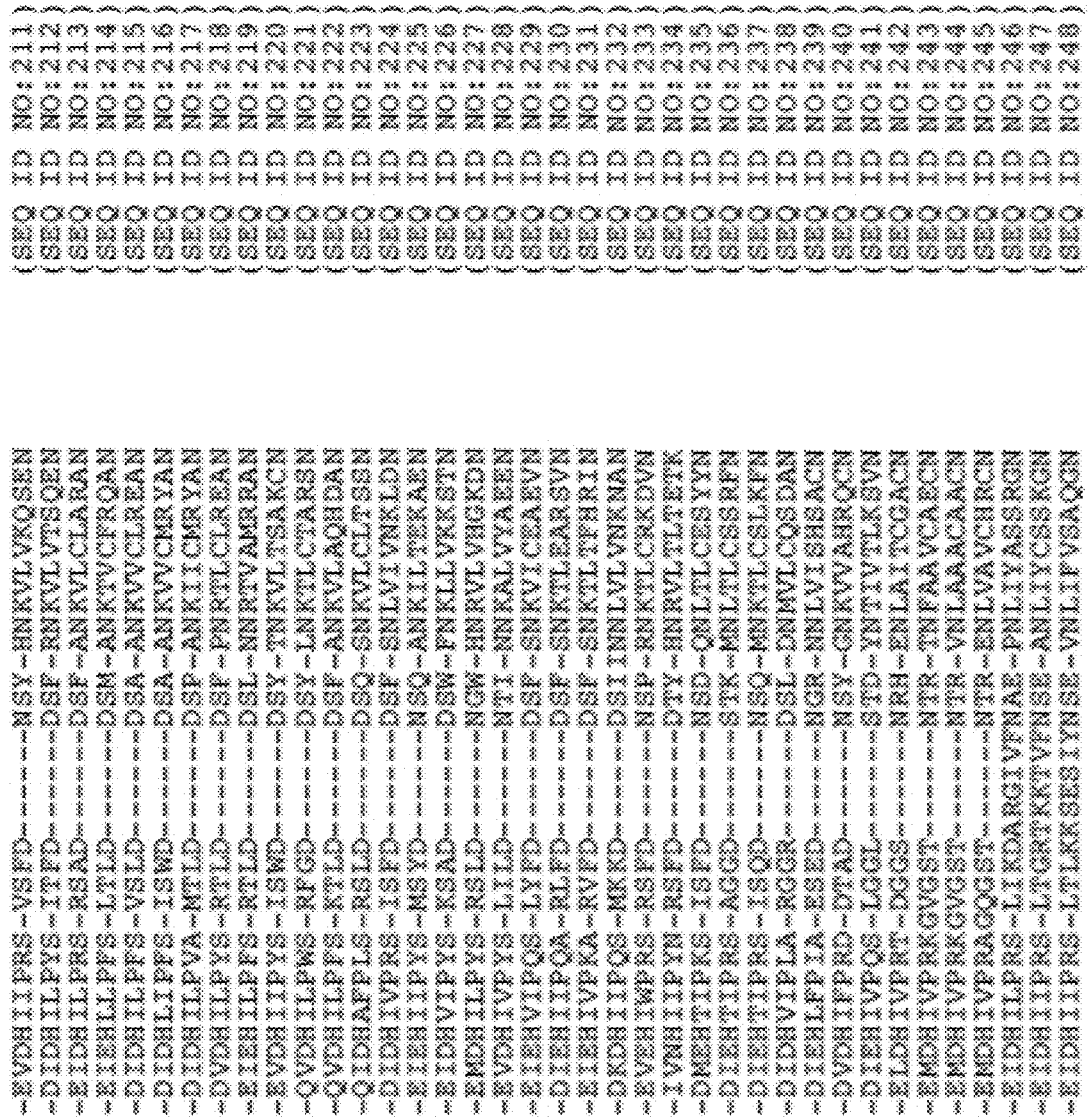

The sequences and structures of exemplary chimeric gRNAs are also shown in FIGS. 1H-1I.

Exemplary Modular gRNAs

In an embodiment, a modular gRNA comprises:
a first strand comprising, preferably from 5' to 3';
   a targeting domain, e.g., comprising 15, 16, 17, 18, 19, 20, 21, 22, 23, 24, 25, or 26 nucleotides;
   a first complementarity domain; and
a second strand, comprising, preferably from 5' to 3':
   optionally a 5' extension domain;
   a second complementarity domain;
   a proximal domain; and
   a tail domain,
wherein:
(a) the proximal and tail domain, when taken together, comprise at least 15, 18, 20, 25, 30, 31, 35, 40, 45, 49, 50, or 53 nucleotides;
(b) there are at least 15, 18, 20, 25, 30, 31, 35, 40, 45, 49, 50, or 53 nucleotides 3' to the last nucleotide of the second complementarity domain; or
(c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length. In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain has, or consists of, 17 nucleotides (e.g., 17 consecutive nucleotides) having complementarity with the target domain, e.g., the targeting domain is 17 nucleotides in length.

In an embodiment, the targeting domain has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 5 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

II. Methods for Designing gRNAs

Methods for designing gRNAs are described herein, including methods for selecting, designing and validating target domains. Exemplary targeting domains are also provided herein. Targeting Domains discussed herein can be incorporated into the gRNAs described herein.

Methods for selection and validation of target sequences as well as off-target analyses are described, e.g., in Mali et al., 2013 Science 339(6121): 823-826; Hsu et al. Nat Biotechnol, 31(9): 827-32; Fu et al., 2014 Nat Biotechnol. doi: 10.1038/nbt.2808. PubMed PMID: 24463574; Heigwer et al., 2014 Nat Methods 11(2):122-3. doi: 10.1038/nmeth.2812. PubMed PMID: 24481216; Bae et al., 2014 Bioinformatics PubMed PMID: 24463181; Xiao A et al., 2014 Bioinformatics PubMed PMID: 24389662.

For example, a software tool can be used to optimize the choice of gRNA within a user's target sequence, e.g., to minimize total off-target activity across the genome. Off target activity may be other than cleavage. For each possible gRNA choice using *S. pyogenes* Cas9, software tools can identify all potential off-target sequences (preceding either NAG or NGG PAMs) across the genome that contain up to a certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible gRNA can then ranked according to its total predicted off-target cleavage; the top-ranked gRNAs represent those that are likely to have the greatest on-target and the least off-target cleavage. Other functions, e.g., automated reagent design for gRNA vector construction, primer design for the on-target Surveyor assay, and primer design for high-throughput detection and quantification of off-target cleavage via next-generation sequencing, can also be included in the tool. Candidate gRNA molecules can be evaluated by art-known methods or as described in Section IV herein.

Guide RNAs (gRNAs) for use with *S. pyogenes, S. aureus* and *N. meningitidis* Cas9s were identified using a DNA sequence searching algorithm. Guide RNA design was carried out using a custom guide RNA design software based on the public tool cas-offinder (reference: Cas-OFFinder: a fast and versatile algorithm that searches for potential off-target sites of Cas9 RNA-guided endonucleases, Bioinformatics. 2014 Feb. 17. Bae S, Park J, Kim J S. PMID:24463181). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality or presence of a 5' G (based on identification of close matches in the human genome containing a relevant PAM (e.g., in the case of *S. pyogenes*, a NGG PAM, in the case of *S. aureus*, a NNGRRT or NNGRRV PAM, and in the case of *N. meningitidis*, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitidis* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprise the 17-mer described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31, e.g., the targeting domains of 18 or more nucleotides may comprise the 17-mer gRNAs described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31. Targeting domains, disclosed herein, may comprises the 18-mer described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31, e.g., the targeting domains of 19 or more nucleotides may comprise the 18-mer gRNAs described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31. Targeting domains, disclosed herein, may comprises the 19-mer described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31, e.g., the targeting domains of 20 or more nucleotides may comprise the 19-mer gRNAs described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31. Targeting domains, disclosed herein, may comprises the 20-mer gRNAs described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31, e.g., the targeting domains of 21 or more nucleotides may comprise the 20-mer gRNAs described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31. Targeting domains, disclosed herein, may comprises the 21-mer described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31, e.g., the targeting domains of 22 or more nucleotides may comprise the 21-mer gRNAs described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31. Targeting domains, disclosed herein, may comprises the 22-mer described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31, e.g., the targeting domains of 23 or more nucleotides may comprise the 22-mer gRNAs described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31. Targeting domains, disclosed herein, may comprises the 23-mer described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31, e.g., the targeting domains of 24 or more nucleotides may comprise the 23-mer gRNAs described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31. Targeting domains, disclosed herein, may comprises the 24-mer described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31, e.g., the targeting domains of 25 or more nucleotides may comprise the 24-mer gRNAs described in Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31.

gRNAs were identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations:

1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The targeting domains discussed herein can be incorporated into the gRNAs described herein.

Strategies to Identify gRNAs for *S. pyogenes*, *S. aureus*, and *N. meningitidis* to Correct a Mutation in the HBB Gene gRNAs were designed for use with *S. pyogenes*, and *S. aureus* Cas9 enzymes to target the E6V mutation in the HBB gene. As an example, three strategies were utilized to identify gRNAs for use with *S. pyogenes*, *S. aureus* and *N. meningitidis* Cas9 enzymes.

In one strategy, the gRNAs were identified and ranked into 3 tiers for *S. pyogenes* (Tables 1A-1C). The targeting domains for tier 1 gRNA molecules for use with the *S. pyogenes* Cas9 to target the E6V mutation in the HBB gene were selected based on (1) a reasonable distance to the target position, and (2) a high level of orthogonality. Tier 2 gRNAs were selected based on (1), a reasonable distance to the target position, and (2) presence of a 5'G. Tier 3 used the same distance restriction, but removed the requirement of good orthogonality and the 5'G. Note that tiers are non-inclusive (each gRNA is listed only once). gRNAs for use with the *S. aureus* (Table 1D), Cas9s were identified manually by scanning genomic DNA sequence for the presence of PAM sequences. These gRNAs were not separated into tiers, but were listed in a single list.

In a second strategy, the gRNAs were identified and ranked into 4 tiers for *S. pyogenes* (Tables 13A-13D) and 5 tiers for *S. aureus* (Tables 14A-14C). The targeting domain for tier 1 gRNA molecules to use with *S. pyogenes* Cas9 were selected based on (1) a short distance to the target position, e.g., within 100 bp upstream and 100 bp downstream of the mutation, (2) a high level of orthogonality, and (3) the presence of a 5' G. For selection of tier 2 gRNAs, a short distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. The targeting domain for tier 1 gRNA molecules to use with *S. aureus* Cas9 were selected based on (1) a short distance to the target position, e.g., within 100 bp upstream and 100 bp downstream of the mutation, (2) a high level of orthogonality, and (3) the presence of a 5' G. For selection of tier 2 gRNAs, a short distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. Tier 5 is selected based on (1) a short distance to the target position, e.g., within 100 bp upstream and 100 bp downstream of the mutation and (2) PAM is NNGRRV. Note that tiers are non-inclusive (each gRNA is listed only once for the strategy). In certain instances, no gRNA was identified based on the criteria of the particular tier. In some instances, there are no corresponding exemplary gRNAs in certain tiers.

In a third strategy, the gRNAs were identified and ranked into 3 tiers for *S. pyogenes* (Tables 24A-24D), 4 tiers for *S. aureus* (Tables 25A-25B) and 3 tiers for *N. meningitidis* (Tables 26). The targeting domain for tier 1 gRNA molecules to use with *S. pyogenes* Cas9 were selected based on (1) distance to the target position, e.g., within 200 bp upstream and 200 bp downstream of the mutation and (2) a high level of orthogonality. The targeting domain for tier 2 gRNA molecules to use with *S. pyogenes* Cas9 were selected based on (1) distance to the target position, e.g., within 200 bp upstream and 200 bp downstream of the mutation and (2) the presence of a 5'G. The targeting domain for tier 3 gRNA molecules to use with *S. pyogenes* Cas9 were selected based on distance to the target position, e.g., within 200 bp upstream and 200 bp downstream of the mutation. The targeting domain for tier 1 gRNA molecules to use with *S. aureus* Cas9 were selected based on (1) distance to the target position, e.g., within 200 bp upstream and 200 bp downstream of the mutation, (2) a high level of orthogonality and (3) PAM is NNGRRT. The targeting domain for tier 2 gRNA molecules to use with *S. aureus* Cas9 were selected based on (1) distance to the target position, e.g., within 200 bp upstream and 200 bp downstream of the mutation, (2) the presence of a 5'G, and (3) PAM is NNGRRT. The targeting domain for tier 3 gRNA molecules to use with *S. aureus* Cas9 were selected based on (1) distance to the target position, e.g., within 200 bp upstream and 200 bp downstream of the mutation and (2) PAM is NNGRRT. The targeting domain for tier 4 gRNA molecules to use with *S. aureus* Cas9 were selected based on (1) distance to the target position, e.g., within 200 bp upstream and 200 bp downstream of the mutation and (2) PAM is NNGRRV. The targeting domain for tier 1 gRNA molecules to use with *N. meningitidis* Cas9 were selected based on (1) distance to the target position, e.g., within 200 bp upstream and 200 bp downstream of the mutation and (2) a high level of orthogonality. The targeting domain for tier 2 gRNA molecules to use with *N. meningitidis* Cas9 were selected based on (1) distance to the target position, e.g., within 200 bp upstream and 200 bp downstream of the mutation and (2) the presence of a 5'G. The targeting domain for tier 3 gRNA molecules to use with *N. meningitidis* Cas9 were selected based on distance to the target position, e.g., within 200 bp upstream and 200 bp downstream of the mutation.

In an embodiment, dual targeting (e.g., dual nicking) is used to create two nicks on opposite DNA strands by using *S. pyogenes*, *S. aureus* and *N. meningitidis* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. Exemplary nickase pairs including selecting a targeting domain from Group A and a second targeting domain from Group B in Table 24D (for *S. pyogenes*). It is contemplated herein that in an embodiment a targeting domain of Group A can be combined with any of the targeting domains of Group B in Table 24D (for *S. pyogenes*). For example, HBB-9, HBB-20 can be combined with HBB-11, HBB-39.

Strategies to Identify gRNAs for *S. pyogenes*, *S. aureus*, and *N. meningitidis* to Knock Out the BCL11A Gene gRNAs were designed for use with *S. pyogenes*, *S. aureus* and *N. meningitidis* Cas9 enzymes to induce an insertion or deletion of one or more nucleotides mediated by NHEJ in close proximity to or within the early coding region. As an example, three strategies were utilized to identify gRNAs for use with *S. pyogenes*, *S. aureus* and *N. meningitidis* Cas9 enzymes.

In one strategy, the gRNAs were identified and ranked into 4 tires for *S. pyogenes* (Tables 2A-2D). The targeting domains for tier 1 gRNA molecules for use with the *S. pyogenes* Cas9 to knockout the BCL11A gene were selected based on (1) a reasonable distance to the target position, and (2) a high level of orthogonality. Tier 2 gRNAs were selected based on (1), a reasonable distance to the target position, and (2) presence of a 5'G. Tier 3 used the same distance restriction, but removed the requirement of good orthogonality and the 5'G. Tier 4 only required the presence in the coding sequence. Note that tiers are non-inclusive (each gRNA is listed only once). gRNAs for use with the *S. aureus* (Table 2E), and *N. meningitidis* (Table 2F) Cas9s were identified manually by scanning genomic DNA sequence for the presence of PAM sequences. These gRNAs were not separated into tiers, but were listed in a single list. Note that tiers are non-inclusive (each gRNA is listed only once for the strategy). In certain instances, no gRNA was identified based on the criteria of the particular tier.

In a second strategy, the gRNAs were identified and ranked into 5 tiers for *S. pyogenes* (Tables 4A-4E), and *S. aureus* (Tables 5A-5E); and 2 tiers for *N. meningitidis* (Tables 6A-6B). For *S. pyogenes*, and *S. aureus*, the targeting domain for tier 1 gRNA molecules were selected based on (1) distance to a target site (e.g., start codon), e.g., within 500 bp (e.g., downstream) of the target site (e.g., start codon), (2) a high level of orthogonality and (3) the presence of 5'G. The targeting domain for tier 2 gRNA molecules were selected based on (1) distance to a target site (e.g., start codon), e.g., within 500 bp (e.g., downstream) of the target site (e.g., start codon) and (2) a high level of orthogonality. The targeting domain for tier 3 gRNA molecules were selected based on (1) distance to a target site (e.g., start codon), e.g., within 500 bp (e.g., downstream) of the target site (e.g., start codon) and (2) the presence of 5'G. The targeting domain for tier 4 gRNA molecules were selected based on distance to a target site (e.g., start codon), e.g., within 500 bp (e.g., downstream) of the target site (e.g., start codon). The targeting domain for tier 5 gRNA molecules were selected based on distance to the target site (e.g., start codon), e.g., within reminder of the coding sequence, e.g., downstream of the first 500 bp of coding sequence (e.g., anywhere from +500 (relative to the start codon) to the stop codon). For *N. meningitidis*, the targeting domain for tier 1 gRNA molecules were selected based on (I) distance to a target site (e.g., start codon), e.g., within 500 bp (e.g., downstream) of the target site (e.g., start codon). The targeting domain for tier 2 gRNA molecules were selected based on distance to the target site (e.g., start codon), e.g., within reminder of the coding sequence, e.g., downstream of the first 500 bp of coding sequence (e.g., anywhere from +500 (relative to the start codon) to the stop codon). Note that tiers are non-inclusive (each gRNA is listed only once for the strategy). In certain instances, no gRNA was identified based on the criteria of the particular tier.

In a third strategy, the gRNAs were identified and ranked into 3 tiers for *S. pyogenes* (Tables 15A-15D), and *N. meningitidis* (Tables 17A-17B); and 5 tiers for *S. aureus* (Tables 16A-16D). The targeting domain to be used with *S. pyogenes* Cas9 enzymes for tier 1 gRNA molecules were selected based on (1) distance to a target site (e.g., start codon), e.g., within 500 bp (e.g., downstream) of the target site (e.g., start codon) and (2) a high level of orthogonality. The targeting domain to be used with *S. pyogenes* Cas9 enzymes for tier 2 gRNA molecules were selected based on (1) distance to the target site (e.g., start codon), e.g., within 500 bp (e.g., downstream) of the target site (e.g., start codon). The targeting domain to be used with *S. pyogenes* Cas9 enzymes for tier 3 gRNA molecules were selected based on distance to the target site (e.g., start codon), e.g., within reminder of the coding sequence, e.g., downstream of the first 500 bp of coding sequence (e.g., anywhere from +500 (relative to the start codon) to the stop codon). The gRNAs were identified and ranked into 5 tiers for *S. aureus*, when the relevant PAM was NNGRRT or NNGRRV. The targeting domain to be used with *S. aureus* Cas9 enzymes for tier 1 gRNA molecules were selected based on (1) distance to the target site (e.g., start codon), e.g., within 500 bp (e.g., downstream) of the target site (e.g., start codon), (2) a high level of orthogonality, and (3) PAM is NNGRRT. The targeting domain to be used with *S. aureus* Cas9 enzymes for tier 2 gRNA molecules were selected based on (1) distance to the target site (e.g., start codon), e.g., within 500 bp (e.g., downstream) of the target site (e.g., start codon), and (2) PAM is NNGRRT. The targeting domain to be used with *S. aureus* Cas9 enzymes for tier 3 gRNA molecules were selected based on (1) distance to a the target site (e.g., start codon) mutation, e.g., within 500 bp (e.g., downstream) of the target site (e.g., start codon), and (2) PAM is NNGRRV. The targeting domain to be used with *S. aureus* Cas9 enzymes for tier 4 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon), and (2) PAM is NNGRRT. The targeting domain to be used with *S. aureus* Cas9 enzymes for tier 5 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon), and (2) PAM is NNGRRV. The gRNAs were identified and ranked into 3 tiers for *N. meningitidis*. The targeting domain to be used with *N. meningitidis* Cas9 enzymes for tier 1 gRNA molecules were selected based on (1) distance to the target site, e.g., within 500 bp (e.g., downstream) of the target site (e.g., start codon) and (2) a high level of orthogonality. The targeting domain to be used with *N. meningitidis* Cas9 enzymes for tier 2 gRNA molecules were selected based on (1) distance to the target site (e.g., start codon), e.g., within 500 bp (e.g., downstream) of the target site (e.g., start codon). The targeting domain to be used with *N.*

*meningitidis* Cas9 enzymes for tier 3 gRNA molecules were selected based on distance to the target site (e.g., start codon), e.g., within reminder of the coding sequence, e.g., downstream of the first 500 bp of coding sequence (e.g., anywhere from +500 (relative to the start codon) to the stop codon). Note that tiers are non-inclusive (each gRNA is listed only once for the strategy). In certain instances, no gRNA was identified based on the criteria of the particular tier.

In an embodiment, when a single gRNA molecule is used to target a Cas9 nickase to create a single strand break in close proximity to the BCL11A target position, e.g., the gRNA is used to target either upstream of (e.g., within 500 bp, e.g., within 200 bp upstream of the BCL11A target position), or downstream of (e.g., within 500 bp, e.g., within 200 bp downstream of the BCL11A target position) in the BCL11A gene.

In an embodiment, when a single gRNA molecule is used to target a Cas9 nuclease to create a double strand break to in close proximity to the BCL11A target position, e.g., the gRNA is used to target either upstream of (e.g., within 500 bp, e.g., within 200 bp upstream of the BCL11A target position), or downstream of (e.g., within 500 bp, e.g., within 200 bp downstream of the BCL11A target position) in the BCL11A gene.

In an embodiment, dual targeting is used to create two double strand breaks to in close proximity to the mutation, e.g., the gRNA is used to target either upstream of (e.g., within 500 bp, e.g., within 200 bp upstream of the BCL11A target position), or downstream of (e.g., within 500 bp, e.g., within 200 bp downstream of the BCL11A target position) in the BCL11A gene. In an embodiment, the first and second gRNAs are used to target two Cas9 nucleases to flank, e.g., the first of gRNA is used to target upstream of (e.g., within 500 bp, e.g., within 200 bp upstream of the BCL11A target position), and the second gRNA is used to target downstream of (e.g., within 500 bp, e.g., within 200 bp downstream of the BCL11A target position) in the BCL11A gene.

In an embodiment, dual targeting is used to create a double strand break and a pair of single strand breaks to delete a genomic sequence including the BCL11A target position. In an embodiment, the first, second and third gRNAs are used to target one Cas9 nuclease and two Cas9 nickases to flank, e.g., the first gRNA that will be used with the Cas9 nuclease is used to target upstream of (e.g., within 500 bp, e.g., within 200 bp upstream of the BCL11A target position) or downstream of (e.g., within 500 bp, e.g., within 200 bp downstream of the BCL11A target position), and the second and third gRNAs that will be used with the Cas9 nickase pair are used to target the opposite side of the mutation (e.g., within 200 bp upstream or downstream of the BCL11A target position) in the BCL11A gene.

In an embodiment, when four gRNAs (e.g., two pairs) are used to target four Cas9 nickases to create four single strand breaks to delete genomic sequence including the mutation, the first pair and second pair of gRNAs are used to target four Cas9 nickases to flank, e.g., the first pair of gRNAs are used to target upstream of (e.g., within 500 bp, e.g., within 200 bp upstream of the BCL11A target position), and the second pair of gRNAs are used to target downstream of (e.g., within 500 bp. e.g., within 200 bp downstream of the BCL11A target position) in the BCL11A gene.

In an embodiment, dual targeting (e.g., dual nicking) is used to create two nicks on opposite DNA strands by using *S. pyogenes, S. aureus* and *N. meningitidis* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. Exemplary nickase pairs including selecting a targeting domain from Group A and a second targeting domain from Group B, or including selecting a targeting domain from Group C and a second targeting domain from Group D in Table 15D (for *S. pyogenes*). It is contemplated herein that in an embodiment a targeting domain of Group A can be combined with any of the targeting domains of Group B; in an embodiment a targeting domain of Group C can be combined with any of the targeting domains of Group D in Table 15D (for *S. pyogenes*). For example, BCL11A-5355 or BCL11A-5380 can be combined with BCL11A-5321 or BCL11A-5416; or BCL11A-5333, BCL11A-5354, or BCL11A-5329 can be combined with BCL11A-5367 or BCL11A-5341.

Strategies to Identify gRNAs for *S. pyogenes, S. aureus*, and *N. meningitidis* to Knock Down the BCL11A Gene gRNAs were designed for use with *S. pyogenes, S. aureus* and *N. meningitidis* one or more Cas9 molecules, e.g., enzymatically inactive Cas9 (eiCas9) molecules or Cas9 fusion proteins (e.g., an eiCas9 fused to a transcription repressor domain or chromatin modifying protein to alter (e.g., to block, reduce, or decrease) the transcription of the BCL11A gene. As an example, three strategies were utilized to identify gRNAs for use with *S. pyogenes, S. aureus* and *N. meningitidis* one or more Cas9 molecules.

In one strategy, the targeting domains for gRNA molecules to knockdown the BCL11A gene were designed to target the 1 kb of sequence 3' of the start codon. They were listed in a single list for *S. pyogenes* (Table 3A), *S. aureus* (Table 3B) and *N. meningitidis* (Table 3C).

In a second strategy, the gRNAs were identified and ranked into 4 tiers for *S. pyogenes* (Tables 10A-10D), and *S. aureus* (Tables 11A-11D). The gRNAs were identified and listed in a single list for *N. meningitidis* (Table 12). For *S. pyogenes*, and *S. aureus*, the targeting domain for tier 1 gRNA molecules were selected based on (1) distance to a target site (e.g., a transcription start site), e.g., within 500 bp (e.g., upstream or downstream) of the target site (e.g., the transcription start site), (2) a high level of orthogonality and (3) the presence of 5'G. The targeting domain for tier 2 gRNA molecules were selected based on (1) distance to a target site (e.g., the transcription start site), e.g., within 500 bp (e.g., upstream or downstream) of the target site (e.g., the transcription start site) and (2) a high level of orthogonality. The targeting domain for tier 3 gRNA molecules were selected based on (1) distance to a target site (e.g., the transcription start site), e.g., within 500 bp (e.g., upstream or downstream) of the target site (e.g., the transcription start site) and (2) the presence of 5'G. The targeting domain for tier 4 gRNA molecules were selected based on distance to a target site (e.g., the transcription start site), e.g., within 500 bp (e.g., upstream or downstream) of the target site (e.g., the transcription start site).

In a third strategy, gRNAs were designed for use with *S. pyogenes, S. aureus* and *N. meningitidis* Cas9 molecules. The gRNAs were identified and ranked into 3 tiers for *S. pyogenes* (Tables 18A-18C). The targeting domain to be used with *S. pyogenes* Cas9 enzymes for tier 1 gRNA molecules were selected based on (1) distance to a target site (e.g., the transcription start site), e.g., within 500 bp (e.g., upstream or downstream) of the target site (e.g., the transcription start site) and (2) a high level of orthogonality. The targeting domain to be used with *S. pyogenes* Cas9 enzymes for tier 2 gRNA molecules were selected based on (1) distance to the target site (e.g., the transcription start site), e.g., within 500 bp (e.g., upstream or downstream) of the target site (e.g., the transcription start site). The targeting domain to be used with *S. pyogenes* Cas9 enzymes for tier 3 gRNA molecules were selected based on distance to the target site (e.g., the transcription start site), e.g., within the additional 500 bp upstream and downstream of the transcription start site (i.e., extending to 1 kb upstream and downstream of the transcription start site. The gRNAs were identified and ranked into 5 tiers for *S. aureus*, when the relevant PAM was NNGRRT or NNGRRV (Tables 19A-19B). The targeting domain to be used with *S. aureus* Cas9 enzymes for tier 1 gRNA molecules were selected based on (1) distance to the target site (e.g., the transcription start site), e.g., within 500 bp (e.g., upstream or downstream) of the target site (e.g., the transcription start site), (2) a high level of orthogonality, and (3) PAM is NNGRRT. The targeting domain to be used with *S. aureus* Cas9 enzymes for tier 2 gRNA molecules were selected based on (1) distance to the target site (e.g., the transcription start site), e.g., within 500 bp (e.g., upstream or downstream) of the target site (e.g., the transcription start site), and (2) PAM is NNGRRT. The targeting domain to be used with *S. aureus* Cas9 enzymes for tier 3 gRNA molecules were selected based on (1) distance to a target site (e.g., the transcription start site), e.g., within 500 bp (e.g., upstream or downstream) of the target site (e.g., the transcription start site), and (2) PAM is NNGRRV. The targeting domain to be used with *S. aureus* Cas9 enzymes for tier 4 gRNA molecules were selected based on (1) distance to the target site (e.g., the transcription start site), e.g., within the additional 500 bp upstream and downstream of the transcription start site (i.e., extending to 1 kb upstream and downstream of the transcription start site, and (2) PAM is NNGRRT. The targeting domain to be used with *S. aureus* Cas9 enzymes for tier 5 gRNA molecules were selected based on (1) distance to the target site (e.g., the transcription start site), e.g., within the additional 500 bp upstream and downstream of the transcription start site (i.e., extending to 1 kb upstream and downstream of the transcription start site, and (2) PAM is NNGRRV. The gRNAs were identified and ranked into 3 tiers for *N. meningitidis* (Tables 20A-20C). The targeting domain to be used with *N. meningitidis* Cas9 enzymes for tier 1 gRNA molecules were selected based on (1) distance to a target site (e.g., the transcription start site), e.g., within 500 bp (e.g., upstream or downstream) of the target site (e.g., the transcription start site) and (2) a high level of orthogonality. The targeting domain to be used with *N. meningitidis* Cas9 enzymes for tier 2 gRNA molecules were selected based on (1) distance to the target site (e.g., the transcription start site), e.g., within 500 bp (e.g., upstream or downstream) of the target site (e.g., the transcription start site). The targeting domain to be used with *N. meningitidis* Cas9 enzymes for tier 3 gRNA molecules were selected based on distance to the target site (e.g., the transcription start site), e.g., within the additional 500 bp upstream and downstream of the transcription start site (i.e., extending to 1 kb upstream and downstream of the transcription start site. Note that tiers are non-inclusive (each gRNA is listed only once for the strategy). In certain instances, no gRNA was identified based on the criteria of the particular tier.

Strategies to Identify gRNAs for *S. pyogenes. S. aureus*, and *N. meningitidis* to Remove (e.g., Delete) the Enhancer Region the BCL11A Gene gRNAs were designed for use with *S. pyogenes, S. aureus* and *N. meningitidis* Cas9 enzymes to remove (e.g., delete) the enhancer region in the BCL11A gene. As an example, two strategies were utilized to identify gRNAs for use with *S. pyogenes, S. aureus* and *N. meningitidis* one or more Cas9 molecules.

In an strategy, the gRNAs were identified and ranked into 4 tiers for *S. pyogenes* (Tables 7A-7D) and for *S. aureus* (Tables 8A-8D). The gRNAs were identified and listed in a single list for *N. meningitidis* (Table 9). The targeting domains for tier 1 gRNA molecules for use with the *S. pyogenes, S. aureus* Cas9 were selected based on (1) a reasonable distance to the target position, e.g., within a region 5' (51.5 to 51.7 kb downstream of transcription start site, TSS) or 3' (65.1 to 65.3 kb downstream of TSS), (2) a high level of orthogonality and (3) presence of a 5'G. For selection of tier 2 gRNAs, reasonable distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. Note that tiers are non-inclusive (each gRNA is listed only once for the strategy). In certain instances, no gRNA was identified based on the criteria of the particular tier.

In a second strategy, gRNAs were designed for use with *S. pyogenes, S. aureus* and *N. meningitidis* Cas9 molecules. The gRNAs were identified and ranked into 4 tiers for *S. pyogenes* (Tables 21A-21E). The targeting domain to be used with *S. pyogenes* Cas9 enzymes for tier 1 gRNA molecules were selected based on (1) within a region 5' (51.5 to 51.7 kb downstream of TSS) or 3' (65.1 to 65.3 kb downstream of TSS), (2) a high level of orthogonality and (3) presence of 5'G. The targeting domain to be used with *S. pyogenes* Cas9 enzymes for tier 2 gRNA molecules were selected based on (1) within a region 5' (51.5 to 51.7 kb downstream of TSS) or 3' (65.1 to 65.3 kb downstream of TSS) and (2) a high level of orthogonality. The targeting domain to be used with *S. pyogenes* Cas9 enzymes for tier 3 gRNA molecules were selected based on (1) within a region 5' (51.5 to 51.7 kb downstream of TSS) or 3' (65.1 to 65.3 kb downstream of TSS) and (2) presence of 5'G. The targeting domain to be used with *S. pyogenes* Cas9 enzymes for tier 4 gRNA molecules were selected based on within a region 5' (51.5 to 51.7 kb downstream of TSS) or 3' (65.1 to 65.3 kb downstream of TSS). The gRNAs were identified and ranked into 5 tiers for *S. aureus*, when the relevant PAM was NNGRRT or NNGRRV (Tables 22A-22E). The targeting domain to be used with *S. aureus* Cas9 enzymes for tier 1 gRNA molecules were selected based on (1) within a region 5' (51.5 to 51.7 kb downstream of TSS) or 3' (65.1 to 65.3 kb downstream of TSS), (2) a high level of orthogonality, (3)) presence of 5'G and (4) PAM is NNGRRT. The targeting domain to be used with *S. aureus* Cas9 enzymes for tier 2 gRNA molecules were selected based on (1) within a region 5' (51.5 to 51.7 kb downstream of TSS) or 3' (65.1 to 65.3 kb downstream of TSS), (2) a high level of orthogonality, and (3) PAM is NNGRRT. The targeting domain to be used with *S. aureus* Cas9 enzymes for tier 3 gRNA molecules were selected based on (1) within a region 5' (51.5 to 51.7 kb downstream of TSS) or 3' (65.1 to 65.3 kb downstream of TSS), (2) presence of 5'G and (3) PAM is NNGRRT. The targeting domain to be used with *S. aureus* Cas9 enzymes for tier 4 gRNA molecules were selected based on (1) within a region 5' (51.5 to 51.7 kb downstream of TSS) or 3' (65.1 to 65.3 kb downstream of TSS), and (2) PAM is NNGRRT. The targeting domain to be used with *S. aureus* Cas9 enzymes for tier 5 gRNA molecules were selected based on (1) within a region 5' (51.5 to 51.7 kb downstream of TSS) or 3' (65.1 to 65.3 kb downstream of TSS), and (2) PAM is NNGRRV. The gRNAs were identified and ranked into 3 tiers for *N. meningitidis* (Tables 23A-23C). The targeting domain to be used with *N. meningitidis* Cas9 enzymes for tier 1 gRNA molecules were selected based on (1) within a region 5' (51.5 to 51.7 kb downstream of TSS) or 3' (65.1 to 65.3 kb downstream of TSS), (2) a high level of orthogonality and (3) presence of 5'G. The targeting domain to be used with *N. meningitidis* Cas9 enzymes for tier 2 gRNA molecules were selected based on (1) within a region 5' (51.5 to 51.7 kb downstream of TSS) or 3' (65.1 to 65.3 kb downstream of TSS) and (2) a high level of orthogonality. The targeting domain to be used with *N. meningitidis* Cas9 enzymes for tier 3 gRNA molecules were selected based on (1) within a region 5' (51.5 to 51.7 kb downstream of TSS) or 3' (65.1 to 65.3 kb downstream of TSS) and (2) presence of 5'G. The targeting domain to be used with *N. meningitidis* Cas9 enzymes for tier 4 gRNA molecules were selected based on within a region 5' (51.5 to 51.7 kb downstream of TSS) or 3' (65.1 to 65.3 kb downstream of TSS). Note that tiers are non-inclusive (each gRNA is listed only once for the strategy). In certain instances, no gRNA was identified based on the criteria of the particular tier.

In an embodiment, dual targeting (e.g., dual nicking) is used to create two nicks on opposite DNA strands by using *S. pyogenes*, *S. aureus* and *N. meningitidis* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. Exemplary nickase pairs including selecting a targeting domain from Group A and a second targeting domain from Group B, or including selecting a targeting domain from Group C and a second targeting domain from Group D in Table 20E (for *S. pyogenes*). It is contemplated herein that in an embodiment a targeting domain of Group A can be combined with any of the targeting domains of Group B; in an embodiment a targeting domain of Group C can be combined with any of the targeting domains of Group D in Table 20E (for *S. pyogenes*). For example, BCL11A-13271 or BCL11A-13264 can be combined with BCL11A-13276; or BCL11A-13262 or BCL11A-13282 can be combined with BCL11A-13290 or BCL11A-13280.

In an embodiment, two or more (e.g., three or four) gRNA molecules are used with one Cas9 molecule. In another embodiment, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

Any of the targeting domains in the tables described herein can be used with a Cas9 nickase molecule to generate a single strand break.

Any of the targeting domains in the tables described herein can be used with a Cas9 nuclease molecule to generate a double strand break.

When two gRNAs designed for use to target two Cas9 molecules, one Cas9 can be one species, the second Cas9 can be from a different species. Both Cas9 species are used to generate a single or double-strand break, as desired.

It is contemplated herein that any upstream gRNA described herein may be paired with any downstream gRNA described herein. When an upstream gRNA designed for use with one species of Cas9 is paired with a downstream gRNA designed for use from a different species of Cas9, both Cas9 species are used to generate a single or double-strand break, as desired.

Exemplary Targeting Domains

Table 1A provides exemplary targeting domains for the E6V target site in the HBB gene selected according to the first tier parameters, and are selected based on the close proximity and orientation to mutation and orthogonality in the human genome. In an embodiment, the targeting domain is the exact complement of the target domain. Any of the targeting domains in the table can be used with a Cas9 molecule (e.g., a *S. pyogenes* Cas9 molecule) that gives double stranded cleavage. Any of the targeting domains in the table can be used with a Cas9 (e.g., a *S. pyogenes* Cas9 nickase) molecule to generate a single strand break. In an embodiment, dual targeting is used to create two nicks on opposite DNA strands by using Cas9 nickases (e.g., a *S. pyogenes* Cas9 nickase) with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. When selecting gRNAs for use in a nickase pair, one gRNA targets a domain in the complementary strand and the second gRNA targets a domain in the non-complementary strand, e.g., a gRNA comprising any minus strand targeting domain may be paired any gRNA comprising a plus strand targeting domain targeting the same target position. In an embodiment, two 20-mer guide RNAs are used to target two Cas9 nucleases (e.g., two *S. pyogenes* Cas9 nucleases) or two Cas9 nickases (e.g., two *S. pyogenes* Cas9 nickases), e.g., HBB-8 and HBB-25 are used. In an embodiment, two 17-mer RNAs are used to target two Cas9 nucleases or two Cas9 nickases, e.g., HBB-35 and HBB-53 are used.

TABLE 1A

1st Tier

| gRNA Name | DNA Strand | Targeting Domain | Target Site Length | SEQ ID NO |
|---|---|---|---|---|
| HBB-8 | − | AAGGUGAACGUGGAUGAAGU | 20 | 387 |
| HBB-25 | + | GUAACGGCAGACUUCUCCUC | 20 | 388 |
| HBB-35 | − | GUGAACGUGGAUGAAGU | 17 | 389 |
| HBB-53 | + | ACGGCAGACUUCUCCUC | 17 | 390 |

Table 1B provides exemplary targeting domains for the E6V target site in the HBB gene selected according to the second tier parameters and are selected based on the presence of a 5' G and reasonable proximity to mutation. In an embodiment, the targeting domain is the exact complement of the target domain. Any of the targeting domains in the table can be used with a *S. pyogenes* Cas9 molecule that gives double stranded cleavage. Any of the targeting domains in the table can be used with *S. pyogenes* single-stranded break nucleases (nickases). In an embodiment, dual targeting is used to create two nicks. When selecting gRNAs for use in a nickase pair, one gRNA targets a domain in the complementary strand and the second gRNA targets a domain in the non-complementary strand, e.g., a gRNA comprising any minus strand targeting domain may be paired any gRNA comprising a plus strand targeting domain targeting the same target position.

TABLE 1B

2nd Tier

| gRNA Name | DNA Strand | Targeting Domain | Target Site Length | SEQ ID NO |
|---|---|---|---|---|
| HBB-12 | − | GAAGUUGGUGGUGAGGCCCU | 20 | 391 |
| HBB-1 | − | GCAACCUCAAACAGACACCA | 20 | 392 |
| HBB-52 | + | GCCCCACAGGGCAGUAA | 17 | 393 |
| HBB-32 | − | GCCGUUACUGCCCUGUG | 17 | 394 |
| HBB-46 | − | GGAGACCAAUAGAAACU | 17 | 395 |
| HBB-37 | − | GGAUGAAGUUGGUGGUG | 17 | 396 |
| HBB-29 | − | GGUGCAUCUGACUCCUG | 17 | 397 |
| HBB-4 | − | GUCUGCCGUUACUGCCCUGU | 20 | 398 |
| HBB-9 | − | GUGAACGUGGAUGAAGUUGG | 20 | 399 |
| HBB-34 | − | GUGGGGCAAGGUGAACG | 17 | 400 |
| HBB-40 | − | GUGGUGAGGCCCUGGGC | 17 | 401 |
| HBB-44 | − | GUUACAAGACAGGUUUA | 17 | 402 |
| HBB-51 | + | GUUCACCUUGCCCCACA | 17 | 403 |
| HBB-39 | − | GUUGGUGGUGAGGCCCU | 17 | 404 |

Table 1C provides exemplary targeting domains for the E6V target site in the HBB gene selected according to the third tier parameters and are selected based on reasonable proximity to mutation. In an embodiment, the targeting domain is the exact complement of the target domain. Any of the targeting domains in the table can be used with a *S. pyogenes* Cas9 molecule that gives double stranded cleavage. Any of the targeting domains in the table can be used with *S. pyogenes* single-stranded break nucleases (nickases). In an embodiment, dual targeting is used to create two nicks. When selecting gRNAs for use in a nickase pair, one gRNA targets a domain in the complementary strand and the second gRNA targets a domain in the non-complementary strand, e.g., a gRNA comprising any minus strand targeting domain may be paired any gRNA comprising a plus strand targeting domain targeting the same target position.

TABLE 1C

3rd Tier

| gRNA Name | DNA Strand | Targeting Domain | Target Site Length | SEQ ID NO |
|---|---|---|---|---|
| HBB-36 | − | AACGUGGAUGAAGUUGG | 17 | 405 |
| HBB-17 | − | AAGGUUACAAGACAGGUUUA | 20 | 406 |
| HBB-47 | + | ACAUGCCCAGUUUCUAU | 17 | 407 |
| HBB-55 | + | ACCAUGGUGUCUGUUUG | 17 | 408 |
| HBB-28 | − | ACCUCAAACAGACACCA | 17 | 409 |
| HBB-20 | + | ACCUUGAUACCAACCUGCCC | 20 | 410 |

TABLE 1C-continued

3rd Tier

| gRNA Name | DNA Strand | Targeting Domain | Target Site Length | SEQ ID NO |
|---|---|---|---|---|
| HBB-45 | − | AGGAGACCAAUAGAAAC | 17 | 411 |
| HBB-54 | + | AGGAGUCAGAUGCACCA | 17 | 412 |
| HBB-3 | − | AGUCUGCCGUUACUGCCCUG | 20 | 413 |
| HBB-38 | − | AGUUGGUGGUGAGGCCC | 17 | 414 |
| HBB-23 | + | CACGUUCACCUUGCCCCACA | 20 | 415 |
| HBB-2 | − | CAUGGUGCAUCUGACUCCUG | 20 | 416 |
| HBB-22 | + | CCACGUUCACCUUGCCCCAC | 20 | 417 |
| HBB-15 | − | CCCUGGGCAGGUUGGUAUCA | 20 | 418 |
| HBB-7 | − | CCUGUGGGGCAAGGUGAACG | 20 | 419 |
| HBB-21 | + | CCUUGAUACCAACCUGCCCA | 20 | 420 |
| HBB-10 | − | CGUGGAUGAAGUUGGUGGUG | 20 | 421 |
| HBB-6 | − | CGUUACUGCCCUGUGGGGCA | 20 | 422 |
| HBB-50 | + | CGUUCACCUUGCCCCAC | 17 | 423 |
| HBB-26 | + | CUCAGGAGUCAGAUGCACCA | 20 | 424 |
| HBB-30 | − | CUGCCGUUACUGCCCUG | 17 | 425 |
| HBB-24 | + | CUUGCCCCACAGGGCAGUAA | 20 | 426 |
| HBB-19 | − | UAAGGAGACCAAUAGAAACU | 20 | 427 |
| HBB-33 | − | UACUGCCCUGUGGGGCA | 17 | 428 |
| HBB-43 | − | UAUCAAGGUUACAAGAC | 17 | 429 |
| HBB-5 | − | UCUGCCGUUACUGCCCUGUG | 20 | 430 |
| HBB-11 | − | UGAAGUUGGUGGUGAGGCCC | 20 | 431 |
| HBB-41 | − | UGAGGCCCUGGGCAGGU | 17 | 432 |
| HBB-49 | + | UGAUACCAACCUGCCCA | 17 | 433 |
| HBB-27 | + | UGCACCAUGGUGUCUGUUUG | 20 | 434 |
| HBB-31 | − | UGCCGUUACUGCCCUGU | 17 | 435 |
| HBB-42 | − | UGGGCAGGUUGGUAUCA | 17 | 436 |
| HBB-16 | − | UGGUAUCAAGGUUACAAGAC | 20 | 437 |
| HBB-14 | − | UGGUGAGGCCCUGGGCAGGU | 20 | 438 |
| HBB-18 | − | UUAAGGAGACCAAUAGAAAC | 20 | 439 |
| HBB-48 | + | UUGAUACCAACCUGCCC | 17 | 440 |
| HBB-13 | − | UUGGUGGUGAGGCCCUGGGC | 20 | 441 |

Table 1D provides exemplary targeting domains for the E6V target site in the HBB gene selected based on close proximity to mutation. In an embodiment, the targeting domain is the exact complement of the target domain. Any of the targeting domains in the table can be used with a *S. aureus* Cas9 molecule that gives double stranded cleavage. Any of the targeting domains in the table can be used with *S. aureus* single-stranded break nucleases (nickases). In an embodiment, dual targeting is used to create two nicks.

When selecting gRNAs for use in a nickase pair, one gRNA targets a domain in the complementary strand and the second gRNA targets a domain in the non-complementary strand, e.g., a gRNA comprising any minus strand targeting domain may be paired any gRNA comprising a plus strand targeting domain targeting the same target position.

TABLE 1D

| gRNA Name | DNA Strand | Targeting Domain | Target Site Length | SEQ ID NO |
|---|---|---|---|---|
| HBB-56 | − | CACCAUGGUGCAUCUGACUC | 20 | 442 |
| HBB-57 | − | CCAUGGUGCAUCUGACUCCU | 20 | 443 |
| HBB-58 | − | CAUGGUGCAUCUGACUCCUG | 20 | 444 |
| HBB-59 | − | UGGUGCAUCUGACUCCUGAG | 20 | 445 |
| HBB-60 | − | AAGUCUGCCGUUACUGCCCU | 20 | 446 |
| HBB-61 | − | AGUCUGCCGUUACUGCCCUG | 20 | 447 |
| HBB-62 | − | UUACUGCCCUGUGGGGCAAG | 20 | 448 |
| HBB-63 | − | CCCUGUGGGGCAAGGUGAAC | 20 | 449 |
| HBB-64 | − | GUGGGGCAAGGUGAACGUGG | 20 | 450 |
| HBB-65 | − | GAACGUGGAUGAAGUUGGUG | 20 | 451 |
| HBB-66 | − | AUGAAGUUGGUGGUGAGGCC | 20 | 452 |
| HBB-67 | − | CAAGGUUACAAGACAGGUUU | 20 | 453 |
| HBB-68 | − | AAGGUUACAAGACAGGUUUA | 20 | 454 |
| HBB-69 | − | GACAGGUUUAAGGAGACCAA | 20 | 455 |
| HBB-70 | − | UUUAAGGAGACCAAUAGAAA | 20 | 456 |
| HBB-71 | − | CAUGGUGCAUCUGACUC | 17 | 457 |
| HBB-72 | − | UGGUGCAUCUGACUCCU | 17 | 458 |
| HBB-73 | − | GGUGCAUCUGACUCCUG | 17 | 459 |
| HBB-74 | − | UGCAUCUGACUCCUGAG | 17 | 460 |
| HBB-75 | − | UCUGCCGUUACUGCCCU | 17 | 461 |
| HBB-76 | − | CUGCCGUUACUGCCCUG | 17 | 462 |
| HBB-77 | − | CUGCCCUGUGGGGCAAG | 17 | 463 |
| HBB-78 | − | UGUGGGGCAAGGUGAAC | 17 | 464 |
| HBB-79 | − | GGGCAAGGUGAACGUGG | 17 | 465 |
| HBB-80 | − | CGUGGAUGAAGUUGGUG | 17 | 466 |
| HBB-81 | − | AAGUUGGUGGUGAGGCC | 17 | 467 |
| HBB-82 | − | GGUUACAAGACAGGUUU | 17 | 468 |
| HBB-83 | − | GUUACAAGACAGGUUUA | 17 | 469 |
| HBB-84 | − | AGGUUUAAGGAGACCAA | 17 | 470 |
| HBB-85 | − | AAGGAGACCAAUAGAAA | 17 | 471 |
| HBB-86 | + | GCUAGUGAACACAGUUGUGU | 20 | 472 |
| HBB-87 | + | GUGUCUGUUUGAGGUUGCUA | 20 | 473 |
| HBB-88 | + | AGAUGCACCAUGGUGUCUGU | 20 | 474 |
| HBB-89 | + | GUAACGGCAGACUUCUCCUC | 20 | 475 |

TABLE 1D-continued

| gRNA Name | DNA Strand | Targeting Domain | Target Site Length | SEQ ID NO |
|---|---|---|---|---|
| HBB-90 | + | AGUAACGGCAGACUUCUCCU | 20 | 476 |
| HBB-91 | + | UCCACGUUCACCUUGCCCCA | 20 | 477 |
| HBB-92 | + | AACCUUGAUACCAACCUGCC | 20 | 478 |
| HBB-93 | + | AGUGAACACAGUUGUGU | 17 | 479 |
| HBB-94 | + | UCUGUUUGAGGUUGCUA | 17 | 480 |
| HBB-95 | + | UGCACCAUGGUGUCUGU | 17 | 481 |
| HBB-96 | + | ACGGCAGACUUCUCCUC | 17 | 482 |
| HBB-97 | + | AACGGCAGACUUCUCCU | 17 | 483 |
| HBB-98 | + | ACGUUCACCUUGCCCCA | 17 | 484 |
| HBB-99 | + | CUUGAUACCAACCUGCC | 17 | 485 |

Table 2A provides exemplary targeting domains for knocking out the BCL11A gene selected according to first tier parameters, and are selected based on close proximity to start of the coding sequence and orthogonality in the human genome. In an embodiment, the targeting domain is the exact complement of the target domain. Any of the targeting domains in the table can be used with a *S. pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks. When selecting gRNAs for use in a nickase pair, one gRNA targets a domain in the complementary strand and the second gRNA targets a domain in the non-complementary strand, e.g., a gRNA comprising any minus strand targeting domain may be paired any gRNA comprising a plus strand targeting domain targeting the same target position. In an embodiment, two 20-mer guide RNAs are used to target two *S. pyogenes* Cas9 nucleases or two *S. pyogenes* Cas9 nickases, e.g., BCL11A-31 and BCL11A-40 BCL11A-30 and BCL11A-42, or BCL11A-24 and BCL11A-53 are used. In an embodiment, two 17-mer RNAs are used to target two Cas9 nucleases or two Cas9 nickases, e.g., BCL11A-79 and BCL11A-90, BCL11A-77 and BCL11A-92, or BCL11A-71 and BCL11A-103 are used.

TABLE 2A

1st Tier

| gRNA Name | DNA Strand | Targeting Domain | Target Site Length | SEQ ID NO |
|---|---|---|---|---|
| BCL11A-32 | − | UGGCAUCCAGGUCACGCCAG | 20 | 486 |
| BCL11A-40 | + | GAUGCUUUUUUCAUCUCGAU | 20 | 487 |
| BCL11A-30 | − | GCAUCCAAUCCCGUGGAGGU | 20 | 488 |
| BCL11A-42 | + | UUUUCAUCUCGAUUGGUGAA | 20 | 489 |
| BCL11A-24 | − | CCAGAUGAACUUCCCAUUGG | 20 | 490 |
| BCL11A-53 | + | AGGAGGUCAUGAUCCCCUUC | 20 | 491 |
| BCL11A-79 | − | CAUCCAGGUCACGCCAG | 17 | 492 |

TABLE 2A-continued

1st Tier

| gRNA Name | DNA Strand | Targeting Domain | Target Site Length | SEQ ID NO |
|---|---|---|---|---|
| BCL11A-90 | + | GCUUUUUCAUCUCGAU | 17 | 493 |
| BCL11A-77 | - | UCCAAUCCCGUGGAGGU | 17 | 494 |
| BCL11A-92 | + | UCAUCUCGAUUGGUGAA | 17 | 495 |
| BCL11A-71 | - | GAUGAACUUCCCAUUGG | 17 | 496 |
| BCL11A-103 | + | AGGUCAUGAUCCCCUUC | 17 | 497 |

Table 2B provides exemplary targeting domains for knocking out the BCL11A gene selected according to the second tier parameters and are selected based on close proximity to start of the coding sequence and presence of a 5' G. In an embodiment, the targeting domain is the exact complement of the target domain. Any of the targeting domains in the table can be used with a *S. pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks. When selecting gRNAs for use in a nickase pair, one gRNA targets a domain in the complementary strand and the second gRNA targets a domain in the non-complementary strand, e.g., a gRNA comprising any minus strand targeting domain may be paired any gRNA comprising a plus strand targeting domain targeting the same target position.

TABLE 2B

2nd Tier

| gRNA Name | DNA Strand | Targeting Domain | Target Site Length | SEQ ID NO |
|---|---|---|---|---|
| BCL11A-28 | - | GAAAAAAGCAUCCAAUCCCG | 20 | 498 |
| BCL11A-15 | - | GAACCAGACCACGGCCCGUU | 20 | 499 |
| BCL11A-37 | + | GACCUGGAUGCCAACCUCCA | 20 | 500 |
| BCL11A-120 | + | GAGCUCCAUGUGCAGAACGA | 20 | 501 |
| BCL11A-106 | + | GAGCUCCCAACGGGCCG | 17 | 502 |
| BCL11A-112 | - | GAGCUCUAAUCCCCACGCCU | 20 | 503 |
| BCL11A-113 | - | GAGUGCAGAAUAUGCCCCGC | 20 | 504 |
| BCL11A-35 | + | GAUAAACAAUCGUCAUCCUC | 20 | 505 |
| BCL11A-19 | - | GAUCAUGACCUCCUCACCUG | 20 | 506 |
| BCL11A-60 | - | GAUGAUGAACCAGACCA | 17 | 507 |
| BCL11A-39 | + | GAUGCCAACCUCCACGGGAU | 20 | 508 |
| BCL11A-133 | + | GCACUCAUCCCAGGCGU | 17 | 509 |
| BCL11A-130 | - | GCAGAAUAUGCCCCGCA | 17 | 510 |
| BCL11A-115 | + | GCAUAUUCUGCACUCAUCCC | 20 | 511 |
| BCL11A-89 | + | GCCAACCUCCACGGGAU | 17 | 512 |
| BCL11A-23 | - | GCCAGAUGAACUUCCCAUUG | 20 | 513 |

TABLE 2B-continued

2nd Tier

| gRNA Name | DNA Strand | Targeting Domain | Target Site Length | SEQ ID NO |
|---|---|---|---|---|
| BCL11A-17 | - | GCCCGUUGGGAGCUCCAGAA | 20 | 514 |
| BCL11A-83 | + | GCUAUGUGUUCCUGUUU | 17 | 515 |
| BCL11A-135 | + | GCUCCAUGUGCAGAACG | 17 | 516 |
| BCL11A-57 | + | GCUCCCAACGGGCCGUGGUC | 20 | 517 |
| BCL11A-127 | - | GCUCUAAUCCCCACGCC | 17 | 518 |
| BCL11A-6 | + | GCUGGGGUUUGCCUUGCUUG | 20 | 519 |
| BCL11A-111 | - | GGAGCUCUAAUCCCCACGCC | 20 | 520 |
| BCL11A-101 | + | GGCACUGCCCACAGGUG | 17 | 521 |
| BCL11A-52 | + | GGCACUGCCCACAGGUGAGG | 20 | 522 |
| BCL11A-16 | - | GGCCCGUUGGGAGCUCCAGA | 20 | 523 |
| BCL11A-12 | + | GGGGUUUGCCUUGCUUG | 17 | 524 |
| BCL11A-109 | + | GUAAGAAUGGCUUCAAG | 17 | 525 |
| BCL11A-123 | + | GUGCAGAACGAGGGGAGGAG | 20 | 526 |
| BCL11A-21 | - | GUGCCAGAUGAACUUCCCAU | 20 | 527 |
| BCL11A-50 | + | GUUCAUCUGGCACUGCCCAC | 20 | 528 |
| BCL11A-65 | - | GUUGGGAGCUCCAGAAG | 17 | 529 |

Table 2C provides exemplary targeting domains for knocking out the BCL11A gene selected according to the third tier parameters and are selected based on close proximity to start of the coding sequence. In an embodiment, the targeting domain is the exact complement of the target domain. Any of the targeting domains in the table can be used with a *S. pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks. When selecting gRNAs for use in a nickase pair, one gRNA targets a domain in the complementary strand and the second gRNA targets a domain in the non-complementary strand, e.g., a gRNA comprising any minus strand targeting domain may be paired any gRNA comprising a plus strand targeting domain targeting the same target position.

TABLE 2C

3rd Tier

| gRNA Name | DNA Strand | Targeting Domain | Target Site Length | SEQ ID NO |
|---|---|---|---|---|
| BCL11A-75 | - | AAAAGCAUCCAAUCCCG | 17 | 530 |
| BCL11A-29 | - | AAAAGCAUCCAAUCCCGUGG | 20 | 531 |
| BCL11A-47 | + | AAAAUAAGAAUGUCCCCCAA | 20 | 532 |
| BCL11A-85 | + | AAACAAUCGUCAUCCUC | 17 | 533 |
| BCL11A-73 | - | AAACGGAAACAAUGCAA | 17 | 534 |

TABLE 2C-continued

3rd Tier

| gRNA Name | DNA Strand | Targeting Domain | Target Site Length | SEQ ID NO |
|---|---|---|---|---|
| BCL11A-125 | − | AAACUUCUGCACUGGAG | 17 | 535 |
| BCL11A-48 | + | AAAUAAGAAUGUCCCCCAAU | 20 | 536 |
| BCL11A-1 | − | AACCCCAGCACUUAAGCAAA | 20 | 537 |
| BCL11A-13 | − | ACAGAUGAUGAACCAGACCA | 20 | 538 |
| BCL11A-61 | − | ACCAGACCACGGCCCGU | 17 | 539 |
| BCL11A-2 | − | ACCCCAGCACUUAAGCAAAC | 20 | 540 |
| BCL11A-38 | + | ACCUGGAUGCCAACCUCCAC | 20 | 541 |
| BCL11A-102 | + | ACUGCCCACAGGUGAGG | 17 | 542 |
| BCL11A-119 | + | AGAGCUCCAUGUGCAGAACG | 20 | 543 |
| BCL11A-70 | − | AGAUGAACUUCCCAUUG | 17 | 544 |
| BCL11A-76 | − | AGCAUCCAAUCCCGUGG | 17 | 545 |
| BCL11A-121 | + | AGCUCCAUGUGCAGAACGAG | 20 | 546 |
| BCL11A-81 | − | AGGAAUUUGCCCCAAAC | 17 | 547 |
| BCL11A-114 | − | AGUGCAGAAUAUGCCCCGCA | 20 | 548 |
| BCL11A-97 | + | AUAAGAAUGUCCCCCAA | 17 | 549 |
| BCL11A-20 | − | AUCAUGACCUCCUCACCUGU | 20 | 550 |
| BCL11A-44 | + | AUCUCGAUUGGUGAAGGGGA | 20 | 551 |
| BCL11A-67 | − | AUGACCUCCUCACCUGU | 17 | 552 |
| BCL11A-138 | + | AUGUGCAGAACGAGGGG | 17 | 553 |
| BCL11A-3 | + | AUUCCCGUUUGCUUAAGUGC | 20 | 554 |
| BCL11A-95 | + | AUUGGUGAAGGGGAAGG | 17 | 555 |
| BCL11A-26 | − | CACAAACGGAAACAAUGCAA | 20 | 556 |
| BCL11A-134 | + | CACUCAUCCCAGGCGUG | 17 | 557 |
| BCL11A-139 | + | CAGAACGAGGGGAGGAG | 17 | 558 |
| BCL11A-69 | − | CAGAUGAACUUCCCAUU | 17 | 559 |
| BCL11A-96 | + | CAGCUUUUCUAAGCAG | 17 | 560 |
| BCL11A-86 | + | CAUCCUCUGGCGUGACC | 17 | 561 |
| BCL11A-93 | + | CAUCUCGAUUGGUGAAG | 17 | 562 |
| BCL11A-100 | + | CAUCUGGCACUGCCCAC | 17 | 563 |
| BCL11A-66 | − | CAUGACCUCCUCACCUG | 17 | 564 |
| BCL11A-99 | + | CCAAUGGGAAGUUCAUC | 17 | 565 |
| BCL11A-46 | + | CCACAGCUUUUCUAAGCAG | 20 | 566 |
| BCL11A-62 | − | CCAGACCACGGCCCGUU | 17 | 567 |
| BCL11A-68 | − | CCAGAUGAACUUCCCAU | 17 | 568 |
| BCL11A-8 | − | CCAGCACUUAAGCAAAC | 17 | 569 |
| BCL11A-107 | + | CCCAACGGGCCGUGGUC | 17 | 570 |
| BCL11A-7 | − | CCCAGCACUUAAGCAAA | 17 | 571 |
| BCL11A-49 | + | CCCCCAAUGGGAAGUUCAUC | 20 | 572 |
| BCL11A-55 | + | CCCCUUCUGGAGCUCCCAAC | 20 | 573 |
| BCL11A-18 | − | CCCGUUGGGAGCUCCAGAAG | 20 | 574 |
| BCL11A-9 | + | CCCGUUUGCUUAAGUGC | 17 | 575 |
| BCL11A-63 | − | CCGUUGGGAGCUCCAGA | 17 | 576 |
| BCL11A-10 | + | CCGUUUGCUUAAGUGCU | 17 | 577 |
| BCL11A-27 | − | CCUCUGCUUAGAAAAGCUG | 20 | 578 |
| BCL11A-104 | + | CCUUCUGGAGCUCCCAA | 17 | 579 |
| BCL11A-36 | + | CGUCAUCCUCUGGCGUGACC | 20 | 580 |
| BCL11A-78 | − | CGUGGAGGUUGGCAUCC | 17 | 581 |
| BCL11A-64 | − | CGUUGGGAGCUCCAGAA | 17 | 582 |
| BCL11A-11 | + | CGUUUGCUUAAGUGCUG | 17 | 583 |
| BCL11A-84 | + | CUAUGUGUUCCUGUUUG | 17 | 584 |
| BCL11A-136 | + | CUCCAUGUGCAGAACGA | 17 | 585 |
| BCL11A-128 | − | CUCUAAUCCCCACGCCU | 17 | 586 |
| BCL11A-118 | + | CUGCACUCAUCCCAGGCGUG | 20 | 587 |
| BCL11A-74 | − | CUGCUUAGAAAAGCUG | 17 | 588 |
| BCL11A-56 | + | CUGGAGCUCCCAACGGGCCG | 20 | 589 |
| BCL11A-87 | + | CUGGAUGCCAACCUCCA | 17 | 590 |
| BCL11A-105 | + | CUUCUGGAGCUCCCAAC | 17 | 591 |
| BCL11A-124 | − | UAAACUUCUGCACUGGA | 17 | 592 |
| BCL11A-98 | + | UAAGAAUGUCCCCCAAU | 17 | 593 |
| BCL11A-34 | − | UAGAGGAAUUUGCCCCAAAC | 20 | 594 |
| BCL11A-131 | + | UAUUCUGCACUCAUCCC | 17 | 595 |
| BCL11A-137 | + | UCCAUGUGCAGAACGAG | 17 | 596 |
| BCL11A-122 | + | UCCAUGUGCAGAACGAGGGG | 20 | 597 |
| BCL11A-126 | − | UCCCCUCGUUCUGCACA | 17 | 598 |
| BCL11A-54 | + | UCCCCUUCUGGAGCUCCCAA | 20 | 599 |
| BCL11A-31 | − | UCCCGUGGAGGUUGGCAUCC | 20 | 600 |
| BCL11A-5 | + | UCCCGUUUGCUUAAGUGCUG | 20 | 601 |
| BCL11A-110 | − | UCCUCCCCUCGUUCUGCACA | 20 | 602 |
| BCL11A-94 | + | UCGAUUGGUGAAGGGGA | 17 | 603 |
| BCL11A-45 | + | UCGAUUGGUGAAGGGGAAGG | 20 | 604 |
| BCL11A-117 | + | UCUGCACUCAUCCCAGGCGU | 20 | 605 |
| BCL11A-51 | + | UCUGGCACUGCCCACAGGUG | 20 | 606 |
| BCL11A-59 | + | UCUGUAAGAAUGGCUUCAAG | 20 | 607 |
| BCL11A-14 | − | UGAACCAGACCACGGCCCGU | 20 | 608 |

TABLE 2C-continued

3rd Tier

| gRNA Name | DNA Strand | Targeting Domain | Target Site Length | SEQ ID NO |
|---|---|---|---|---|
| BCL11A-132 | + | UGCACUCAUCCCAGGCG | 17 | 609 |
| BCL11A-129 | - | UGCAGAAUAUGCCCCGC | 17 | 610 |
| BCL11A-22 | - | UGCCAGAUGAACUUCCCAUU | 20 | 611 |
| BCL11A-82 | + | UGCUAUGUGUUCCUGUU | 17 | 612 |
| BCL11A-88 | + | UGGAUGCCAACCUCCAC | 17 | 613 |
| BCL11A-58 | + | UGGUUCAUCAUCUGUAAGAA | 20 | 614 |
| BCL11A-33 | - | UGUUUAUCAACGUCAUCUAG | 20 | 615 |
| BCL11A-80 | - | UUAUCAACGUCAUCUAG | 17 | 616 |
| BCL11A-25 | - | UUAUUUUAUCGAGCACAAA | 20 | 617 |
| BCL11A-108 | + | UUCAUCAUCUGUAAGAA | 17 | 618 |
| BCL11A-91 | + | UUCAUCUCGAUUGGUGA | 17 | 619 |
| BCL11A-4 | + | UUCCCGUUUGCUUAAGUGCU | 20 | 620 |
| BCL11A-116 | + | UUCUGCACUCAUCCCAGGCG | 20 | 621 |
| BCL11A-43 | + | UUUCAUCUCGAUUGGUGAAG | 20 | 622 |
| BCL11A-72 | - | UUUUUAUCGAGCACAAA | 17 | 623 |
| BCL11A-41 | + | UUUUUCAUCUCGAUUGGUGA | 20 | 624 |

Table 2D provides exemplary targeting domains for knocking out the BCL11A gene selected according to the fourth tier parameters and are selected based on presence in the coding sequence. In an embodiment, the targeting domain is the exact complement of the target domain. Any of the targeting domains in the table can be used with a *S. pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks. When selecting gRNAs for use in a nickase pair, one gRNA targets a domain in the complementary strand and the second gRNA targets a domain in the non-complementary strand, e.g., a gRNA comprising any minus strand targeting domain may be paired any gRNA comprising a plus strand targeting domain targeting the same target position.

TABLE 2D

4th Tier

| gRNA Name | DNA Strand | Targeting domain | Target Site Length | SEQ ID NO |
|---|---|---|---|---|
| BCL11A-140 | - | AACAGCCAUUCACCAGUGCA | 20 | 625 |
| BCL11A-141 | - | CAACACGCACAGAACACUCA | 20 | 626 |
| BCL11A-142 | - | AUCUACUUAGAAAGCGAACA | 20 | 627 |
| BCL11A-143 | - | ACGGAAGUCCCCUGACCCCG | 20 | 628 |
| BCL11A-144 | - | CGGAAGUCCCCUGACCCCGC | 20 | 629 |
| BCL11A-145 | - | AGUCCCCUGACCCCGCGGGU | 20 | 630 |
| BCL11A-146 | - | CCGCGGGUUGGUAUCCCUUC | 20 | 631 |
| BCL11A-147 | - | GUUGGUAUCCCUUCAGGACU | 20 | 632 |
| BCL11A-148 | - | CCUUCCCAGCCACCUCUCCA | 20 | 633 |
| BCL11A-149 | - | CUUCCCAGCCACCUCUCCAU | 20 | 634 |
| BCL11A-150 | - | UUUAACCUGCUAAGAAUACC | 20 | 635 |
| BCL11A-151 | - | ACCAGGAUCAGUAUCGAGAG | 20 | 636 |
| BCL11A-152 | - | UCAGUAUCGAGAGAGGCUUC | 20 | 637 |
| BCL11A-153 | - | AUCGAGAGAGGCUUCCGGCC | 20 | 638 |
| BCL11A-154 | - | GAGGCUUCCGGCCUGGCAGA | 20 | 639 |
| BCL11A-155 | - | AGGCUUCCGGCCUGGCAGAA | 20 | 640 |
| BCL11A-156 | - | UCCACCACCGAGACAUCACU | 20 | 641 |
| BCL11A-157 | - | CCCCCACCGCAUAGAGCGCC | 20 | 642 |
| BCL11A-158 | - | CCCCACCGCAUAGAGCGCCU | 20 | 643 |
| BCL11A-159 | - | CCCACCGCAUAGAGCGCCUG | 20 | 644 |
| BCL11A-160 | - | CCACCGCAUAGAGCGCCUGG | 20 | 645 |
| BCL11A-161 | - | CCGCAUAGAGCGCCUGGGGG | 20 | 646 |
| BCL11A-162 | - | GCGCCUGGGGGCGGAAGAGA | 20 | 647 |
| BCL11A-163 | - | GGGGGCGGAAGAGAUGGCCC | 20 | 648 |
| BCL11A-164 | - | AUCACCCGAGUGCCUUUGAC | 20 | 649 |
| BCL11A-165 | - | UCACCCGAGUGCCUUUGACA | 20 | 650 |
| BCL11A-166 | - | GUGCCUUUGACAGGGUGCUG | 20 | 651 |
| BCL11A-167 | - | GGUGCUGCGGUUGAAUCCAA | 20 | 652 |
| BCL11A-168 | - | GCGGUUGAAUCCAAUGGCUA | 20 | 653 |
| BCL11A-169 | - | GGCUAUGGAGCCUCCCGCCA | 20 | 654 |
| BCL11A-170 | - | CUCCCGCCAUGGAUUUCUCU | 20 | 655 |
| BCL11A-171 | - | CUCUAGGAGACUUAGAGAGC | 20 | 656 |
| BCL11A-172 | - | AGGAGACUUAGAGAGCUGGC | 20 | 657 |
| BCL11A-173 | - | GGAGACUUAGAGAGCUGGCA | 20 | 658 |
| BCL11A-174 | - | UCUAGCCCACCGCUGUCCCC | 20 | 659 |
| BCL11A-175 | - | GCCCACCGCUGUCCCCAGGC | 20 | 660 |
| BCL11A-176 | - | GCCGGCCCAGCCCUAUGCAA | 20 | 661 |
| BCL11A-177 | - | UUACUGCAACCAUUCCAGCC | 20 | 662 |
| BCL11A-178 | - | AGGUAGCAAGCCGCCCUUCC | 20 | 663 |
| BCL11A-179 | - | CCCUCCUCCCUCCCAGCCCC | 20 | 664 |
| BCL11A-180 | - | UCCAAGUCAUGCGAGUUCUG | 20 | 665 |
| BCL11A-181 | - | GUUCAAAUUUCAGAGCAACC | 20 | 666 |

TABLE 2D-continued

4th Tier

| gRNA Name | DNA Strand | Targeting domain | Target Site Length | SEQ ID NO |
|---|---|---|---|---|
| BCL11A-182 | − | CAAAUUUCAGAGCAACCUGG | 20 | 667 |
| BCL11A-183 | − | AGAGCAACCUGGUGGUGCAC | 20 | 668 |
| BCL11A-184 | − | GGUGCACCGGCGCAGCCACA | 20 | 669 |
| BCL11A-185 | − | GUGCACCGGCGCAGCCACAC | 20 | 670 |
| BCL11A-186 | − | GUGCGACCACGCGUGCACCC | 20 | 671 |
| BCL11A-187 | − | GCACAAAUCGUCCCCCAUGA | 20 | 672 |
| BCL11A-188 | − | AUGACGGUCAAGUCCGACGA | 20 | 673 |
| BCL11A-189 | − | UCUCUCCACCGCCAGCUCCC | 20 | 674 |
| BCL11A-190 | − | ACCGCCAGCUCCCCGGAACC | 20 | 675 |
| BCL11A-191 | − | GGAACCCGGCACCAGCGACU | 20 | 676 |
| BCL11A-192 | − | ACCCGGCACCAGCGACUUGG | 20 | 677 |
| BCL11A-193 | − | CCCGGCACCAGCGACUUGGU | 20 | 678 |
| BCL11A-194 | − | CAGCAGCGCGCUCAAGUCCG | 20 | 679 |
| BCL11A-195 | − | CAGCGCGCUCAAGUCCGUGG | 20 | 680 |
| BCL11A-196 | − | GAACGACCCCAACCUGAUCC | 20 | 681 |
| BCL11A-197 | − | CCCAACCUGAUCCCGGAGAA | 20 | 682 |
| BCL11A-198 | − | CCAACCUGAUCCCGGAGAAC | 20 | 683 |
| BCL11A-199 | − | CAACCUGAUCCCGGAGAACG | 20 | 684 |
| BCL11A-200 | − | GAUCCCGGAGAACGGGACG | 20 | 685 |
| BCL11A-201 | − | CCCGGAGAACGGGACGAGG | 20 | 686 |
| BCL11A-202 | − | GAACGGGACGAGGAGGAAG | 20 | 687 |
| BCL11A-203 | − | CGGGGACGAGGAGGAAGAGG | 20 | 688 |
| BCL11A-204 | − | GGAGGAAGAGGAGGACGACG | 20 | 689 |
| BCL11A-205 | − | AGAGGAGGACGACGAGGAAG | 20 | 690 |
| BCL11A-206 | − | CGACGAGGAAGAGGAAGAAG | 20 | 691 |
| BCL11A-207 | − | CGAGGAAGAGGAAGAAGAGG | 20 | 692 |
| BCL11A-208 | − | AGAGGAAGAAGAGGAGGAAG | 20 | 693 |
| BCL11A-209 | − | GGAAGAAGAGGAGGAAGAGG | 20 | 694 |
| BCL11A-210 | − | AGAAGAGGAGGAAGAGGAGG | 20 | 695 |
| BCL11A-211 | − | AGAGGAGGAAGAGGAGGAGG | 20 | 696 |
| BCL11A-212 | + | UCCUCCUCGUCCCCGUUCUC | 20 | 697 |
| BCL11A-213 | + | CCUCCUCGUCCCCGUUCUCC | 20 | 698 |
| BCL11A-214 | + | CGUCCCCGUUCUCCGGGAUC | 20 | 699 |
| BCL11A-215 | + | CCCGUUCUCCGGGAUCAGGU | 20 | 700 |
| BCL11A-216 | + | CCGUUCUCCGGGAUCAGGUU | 20 | 701 |
| BCL11A-217 | + | CGUUCUCCGGGAUCAGGUUG | 20 | 702 |
| BCL11A-218 | + | GUCGUUCUCGCUCUUGAACU | 20 | 703 |
| BCL11A-219 | + | GCUCUUGAACUUGGCCACCA | 20 | 704 |
| BCL11A-220 | + | CACGGACUUGAGCGCGCUGC | 20 | 705 |
| BCL11A-221 | + | GGCGCUGCCCACCAAGUCGC | 20 | 706 |
| BCL11A-222 | + | GCCCACCAAGUCGCUGGUGC | 20 | 707 |
| BCL11A-223 | + | CCCACCAAGUCGCUGGUGCC | 20 | 708 |
| BCL11A-224 | + | AAGUCGCUGGUGCCGGGUUC | 20 | 709 |
| BCL11A-225 | + | AGUCGCUGGUGCCGGGUUCC | 20 | 710 |
| BCL11A-226 | + | GUCGCUGGUGCCGGGUUCCG | 20 | 711 |
| BCL11A-227 | + | GGUGCCGGGUUCCGGGGAGC | 20 | 712 |
| BCL11A-228 | + | GCCGGGUUCCGGGGAGCUGG | 20 | 713 |
| BCL11A-229 | + | GGGUUCCGGGGAGCUGGCGG | 20 | 714 |
| BCL11A-230 | + | GGCGGUGGAGAGACCGUCGU | 20 | 715 |
| BCL11A-231 | + | GUCGUCGGACUUGACCGUCA | 20 | 716 |
| BCL11A-232 | + | UCGUCGGACUUGACCGUCAU | 20 | 717 |
| BCL11A-233 | + | CGUCGGACUUGACCGUCAUG | 20 | 718 |
| BCL11A-234 | + | GUCGGACUUGACCGUCAUGG | 20 | 719 |
| BCL11A-235 | + | UGUGCAUGUGCGUCUUCAUG | 20 | 720 |
| BCL11A-236 | + | CAUGUGGCGCUUCAGCUUGC | 20 | 721 |
| BCL11A-237 | + | GGCGCUUCAGCUUGCUGGCC | 20 | 722 |
| BCL11A-238 | + | GCGCUUCAGCUUGCUGGCCU | 20 | 723 |
| BCL11A-239 | + | UGCUGGCCUGGGUGCACGCG | 20 | 724 |
| BCL11A-240 | + | GGGUGCACGCGUGGUCGCAC | 20 | 725 |
| BCL11A-241 | + | GUCGCACAGGUUGCACUUGU | 20 | 726 |
| BCL11A-242 | + | UCGCACAGGUUGCACUUGUA | 20 | 727 |
| BCL11A-243 | + | UGUAGGGCUUCUCGCCCGUG | 20 | 728 |
| BCL11A-244 | + | UCUCGCCCGUGUGGCUGCGC | 20 | 729 |
| BCL11A-245 | + | GGCUGCGCCGGUGCACCACC | 20 | 730 |
| BCL11A-246 | + | GCCGCAGAACUCGCAUGACU | 20 | 731 |
| BCL11A-247 | + | UCGCAUGACUUGGACUUGAC | 20 | 732 |
| BCL11A-248 | + | CGCAUGACUUGGACUUGACC | 20 | 733 |
| BCL11A-249 | + | GCAUGACUUGGACUUGACCG | 20 | 734 |
| BCL11A-250 | + | CAUGACUUGGACUUGACCGG | 20 | 735 |
| BCL11A-251 | + | ACUUGGACUUGACCGGGGGC | 20 | 736 |
| BCL11A-252 | + | CUUGGACUUGACCGGGGGCU | 20 | 737 |
| BCL11A-253 | + | GGACUUGACCGGGGGCUGGG | 20 | 738 |
| BCL11A-254 | + | GACUUGACCGGGGGCUGGGA | 20 | 739 |
| BCL11A-255 | + | UUGACCGGGGGCUGGGAGGG | 20 | 740 |

TABLE 2D-continued

4th Tier

| gRNA Name | DNA Strand | Targeting domain | Target Site Length | SEQ ID NO |
|---|---|---|---|---|
| BCL11A-256 | + | ACCGGGGCUGGGAGGGAGG | 20 | 741 |
| BCL11A-257 | + | CCGGGGGCUGGGAGGGAGGA | 20 | 742 |
| BCL11A-258 | + | CGGGGGCUGGGAGGGAGGAG | 20 | 743 |
| BCL11A-259 | + | GGGCUGGGAGGGAGGAGGGG | 20 | 744 |
| BCL11A-260 | + | GGAGGAGGGCGGAUUGCAG | 20 | 745 |
| BCL11A-261 | + | GGAGGGGCGGAUUGCAGAGG | 20 | 746 |
| BCL11A-262 | + | GAGGGGCGGAUUGCAGAGGA | 20 | 747 |
| BCL11A-263 | + | GGGCGGAUUGCAGAGGAGGG | 20 | 748 |
| BCL11A-264 | + | GGCGGAUUGCAGAGGAGGGA | 20 | 749 |
| BCL11A-265 | + | GCGGAUUGCAGAGGAGGGAG | 20 | 750 |
| BCL11A-266 | + | CGGAUUGCAGAGGAGGGAGG | 20 | 751 |
| BCL11A-267 | + | GGAUUGCAGAGGAGGGAGGG | 20 | 752 |
| BCL11A-268 | + | GAUUGCAGAGGAGGGAGGGG | 20 | 753 |
| BCL11A-269 | + | GAGGGAGGGGGGCGUCGCC | 20 | 754 |
| BCL11A-270 | + | GAGGGGGGGCGUCGCCAGGA | 20 | 755 |
| BCL11A-271 | + | AGGGGGGGCGUCGCCAGGAA | 20 | 756 |
| BCL11A-272 | + | GGGGGCGUCGCCAGGAAGGG | 20 | 757 |
| BCL11A-273 | + | AGGAAGGGCGGCUUGCUACC | 20 | 758 |
| BCL11A-274 | + | AGGGCGGCUUGCUACCUGGC | 20 | 759 |
| BCL11A-275 | + | GGCUUGCUACCUGGCUGGAA | 20 | 760 |
| BCL11A-276 | + | GGUUGCAGUAACCUUUGCAU | 20 | 761 |
| BCL11A-277 | + | GUUGCAGUAACCUUUGCAUA | 20 | 762 |
| BCL11A-278 | + | CAGUAACCUUUGCAUAGGGC | 20 | 763 |
| BCL11A-279 | + | AGUAACCUUUGCAUAGGGCU | 20 | 764 |
| BCL11A-280 | + | ACCUUUGCAUAGGGCUGGGC | 20 | 765 |
| BCL11A-281 | + | UGCAUAGGGCUGGGCCGGCC | 20 | 766 |
| BCL11A-282 | + | GCAUAGGGCUGGGCCGGCCU | 20 | 767 |
| BCL11A-283 | + | CAUAGGGCUGGGCCGGCCUG | 20 | 768 |
| BCL11A-284 | + | CUGGGCCGGCCUGGGGACAG | 20 | 769 |
| BCL11A-285 | + | GGCCGGCCUGGGGACAGCGG | 20 | 770 |
| BCL11A-286 | + | GCCGGCCUGGGGACAGCGGU | 20 | 771 |
| BCL11A-287 | + | AAGUCUCCAGAGAAAUCCA | 20 | 772 |
| BCL11A-288 | + | UCUCCAGAGAAAUCCAUGG | 20 | 773 |
| BCL11A-289 | + | CUCCAGAGAAAUCCAUGGC | 20 | 774 |
| BCL11A-290 | + | CUAGAGAAAUCCAUGGCGGG | 20 | 775 |
| BCL11A-291 | + | GCGGGAGGCUCCAUAGCCAU | 20 | 776 |
| BCL11A-292 | + | CAACCGCAGCACCCUGUCAA | 20 | 777 |
| BCL11A-293 | + | AGCACCCUGUCAAAGGCACU | 20 | 778 |
| BCL11A-294 | + | GCACCCUGUCAAAGGCACUC | 20 | 779 |
| BCL11A-295 | + | UGUCAAAGGCACUCGGGUGA | 20 | 780 |
| BCL11A-296 | + | GUCAAAGGCACUCGGGUGAU | 20 | 781 |
| BCL11A-297 | + | AAAGGCACUCGGGUGAUGGG | 20 | 782 |
| BCL11A-298 | + | CACUCGGGUGAUGGGUGGCC | 20 | 783 |
| BCL11A-299 | + | ACUCGGGUGAUGGGUGGCCA | 20 | 784 |
| BCL11A-300 | + | GGGCCAUCUCUUCCGCCCCC | 20 | 785 |
| BCL11A-301 | + | CCGCCCCCAGGCGCUCUAUG | 20 | 786 |
| BCL11A-302 | + | CCCCCAGGCGCUCUAUGCGG | 20 | 787 |
| BCL11A-303 | + | CCCCAGGCGCUCUAUGCGGU | 20 | 788 |
| BCL11A-304 | + | CCCAGGCGCUCUAUGCGGUG | 20 | 789 |
| BCL11A-305 | + | CCAGGCGCUCUAUGCGGUGG | 20 | 790 |
| BCL11A-306 | + | UGGGGGUCCAAGUGAUGUCU | 20 | 791 |
| BCL11A-307 | + | GGGUCCAAGUGAUGUCUCGG | 20 | 792 |
| BCL11A-308 | + | UCCAAGUGAUGUCUCGGUGG | 20 | 793 |
| BCL11A-309 | + | GUCUCGGUGGUGGACUAAAC | 20 | 794 |
| BCL11A-310 | + | UCUCGGUGGUGGACUAAACA | 20 | 795 |
| BCL11A-311 | + | CUCGGUGGUGGACUAAACAG | 20 | 796 |
| BCL11A-312 | + | UCGGUGGUGGACUAAACAGG | 20 | 797 |
| BCL11A-313 | + | CGGUGGUGGACUAAACAGGG | 20 | 798 |
| BCL11A-314 | + | GGUGGUGGACUAAACAGGGG | 20 | 799 |
| BCL11A-315 | + | UGGACUAAACAGGGGGGGAG | 20 | 800 |
| BCL11A-316 | + | GGACUAAACAGGGGGGGAGU | 20 | 801 |
| BCL11A-317 | + | CUAAACAGGGGGGAGUGGG | 20 | 802 |
| BCL11A-318 | + | GUGGAAAGCGCCCUUCUGCC | 20 | 803 |
| BCL11A-319 | + | AAAGCGCCCUUCUGCCAGGC | 20 | 804 |
| BCL11A-320 | + | GCCUCUCUCGAUACUGAUCC | 20 | 805 |
| BCL11A-321 | + | CUGAUCCUGGUAUUCUUAGC | 20 | 806 |
| BCL11A-322 | + | UGGUAUUCUUAGCAGGUUAA | 20 | 807 |
| BCL11A-323 | + | GGUAUUCUUAGCAGGUUAAA | 20 | 808 |
| BCL11A-324 | + | GUAUUCUUAGCAGGUUAAAG | 20 | 809 |
| BCL11A-325 | + | UGUCUGCAAUAUGAAUCCCA | 20 | 810 |
| BCL11A-326 | + | GCAAUAUGAAUCCCAUGGAG | 20 | 811 |
| BCL11A-327 | + | AUAUGAAUCCCAUGGAGAGG | 20 | 812 |
| BCL11A-328 | + | GAAUCCCAUGGAGAGGUGGC | 20 | 813 |
| BCL11A-329 | + | AAUCCCAUGGAGAGGUGGCU | 20 | 814 |

TABLE 2D-continued

4th Tier

| gRNA Name | DNA Strand | Targeting domain | Target Site Length | SEQ ID NO |
|---|---|---|---|---|
| BCL11A-330 | + | CCAUGGAGAGGUGGCUGGGA | 20 | 815 |
| BCL11A-331 | + | CAUUCUGCACCUAGUCCUGA | 20 | 816 |
| BCL11A-332 | + | AUUCUGCACCUAGUCCUGAA | 20 | 817 |
| BCL11A-333 | + | CCUGAAGGGAUACCAACCCG | 20 | 818 |
| BCL11A-334 | + | CUGAAGGGAUACCAACCCGC | 20 | 819 |
| BCL11A-335 | + | UGAAGGGAUACCAACCCGCG | 20 | 820 |
| BCL11A-336 | + | GGAUACCAACCCGCGGGGUC | 20 | 821 |
| BCL11A-337 | + | GAUACCAACCCGCGGGGUCA | 20 | 822 |
| BCL11A-338 | + | AUACCAACCCGCGGGGUCAG | 20 | 823 |
| BCL11A-339 | + | UUGCAAGAGAAACCAUGCAC | 20 | 824 |
| BCL11A-340 | + | AGAAACCAUGCACUGGUGAA | 20 | 825 |
| BCL11A-341 | + | AGUUGUACAUGUGUAGCUGC | 20 | 826 |
| BCL11A-342 | + | GUUGUACAUGUGUAGCUGCU | 20 | 827 |
| BCL11A-343 | − | AGCCAUUCACCAGUGCA | 17 | 828 |
| BCL11A-344 | − | CACGCACAGAACACUCA | 17 | 829 |
| BCL11A-345 | − | UACUUAGAAAGCGAACA | 17 | 830 |
| BCL11A-346 | − | GAAGUCCCUGACCCCG | 17 | 831 |
| BCL11A-347 | − | AAGUCCCUGACCCCGC | 17 | 832 |
| BCL11A-348 | − | CCCCUGACCCCGCGGGU | 17 | 833 |
| BCL11A-349 | − | CGGGUUGGUAUCCCUUC | 17 | 834 |
| BCL11A-350 | − | GGUAUCCCUUCAGGACU | 17 | 835 |
| BCL11A-351 | − | UCCCAGCCACCUCUCCA | 17 | 836 |
| BCL11A-352 | − | CCCAGCCACCUCUCCAU | 17 | 837 |
| BCL11A-353 | − | AACCUGCUAAGAAUACC | 17 | 838 |
| BCL11A-354 | − | AGGAUCAGUAUCGAGAG | 17 | 839 |
| BCL11A-355 | − | GUAUCGAGAGAGGCUUC | 17 | 840 |
| BCL11A-356 | − | GAGAGAGGCUUCCGGCC | 17 | 841 |
| BCL11A-357 | − | GCUUCCGGCCUGGCAGA | 17 | 842 |
| BCL11A-358 | − | CUUCCGGCCUGGCAGAA | 17 | 843 |
| BCL11A-359 | − | ACCACCGAGACAUCACU | 17 | 844 |
| BCL11A-360 | − | CCACCGCAUAGAGCGCC | 17 | 845 |
| BCL11A-361 | − | CACCGCAUAGAGCGCCU | 17 | 846 |
| BCL11A-362 | − | ACCGCAUAGAGCGCCUG | 17 | 847 |
| BCL11A-363 | − | CCGCAUAGAGCGCCUGG | 17 | 848 |
| BCL11A-364 | − | CAUAGAGCGCCUGGGGG | 17 | 849 |
| BCL11A-365 | − | CCUGGGGGCGGAAGAGA | 17 | 850 |
| BCL11A-366 | − | GGCGGAAGAGAUGGCCC | 17 | 851 |
| BCL11A-367 | − | ACCCGAGUGCCUUUGAC | 17 | 852 |
| BCL11A-368 | − | CCCGAGUGCCUUUGACA | 17 | 853 |
| BCL11A-369 | − | CCUUUGACAGGGUGCUG | 17 | 854 |
| BCL11A-370 | − | GCUGCGGUUGAAUCCAA | 17 | 855 |
| BCL11A-371 | − | GUUGAAUCCAAUGGCUA | 17 | 856 |
| BCL11A-372 | − | UAUGGAGCCUCCCGCCA | 17 | 857 |
| BCL11A-373 | − | CCGCCAUGGAUUUCUCU | 17 | 858 |
| BCL11A-374 | − | UAGGAGACUUAGAGAGC | 17 | 859 |
| BCL11A-375 | − | AGACUUAGAGAGCUGGC | 17 | 860 |
| BCL11A-376 | − | GACUUAGAGAGCUGGCA | 17 | 861 |
| BCL11A-377 | − | AGCCCACCGCUGUCCCC | 17 | 862 |
| BCL11A-378 | − | CACCGCUGUCCCCAGGC | 17 | 863 |
| BCL11A-379 | − | GGCCCAGCCCUAUGCAA | 17 | 864 |
| BCL11A-380 | − | CUGCAACCAUUCCAGCC | 17 | 865 |
| BCL11A-381 | − | UAGCAAGCCGCCCUUCC | 17 | 866 |
| BCL11A-382 | − | UCCUCCCUCCCAGCCCC | 17 | 867 |
| BCL11A-383 | − | AAGUCAUGCGAGUUCUG | 17 | 868 |
| BCL11A-384 | − | CAAAUUUCAGAGCAACC | 17 | 869 |
| BCL11A-385 | − | AUUUCAGAGCAACCUGG | 17 | 870 |
| BCL11A-386 | − | GCAACCUGGUGGUGCAC | 17 | 871 |
| BCL11A-387 | − | GCACCGGCGCAGCCACA | 17 | 872 |
| BCL11A-388 | − | CACCGGCGCAGCCACAC | 17 | 873 |
| BCL11A-389 | − | CGACCACGCGUGCACCC | 17 | 874 |
| BCL11A-390 | − | CAAAUCGUCCCCAUGA | 17 | 875 |
| BCL11A-391 | − | ACGGUCAAGUCCGACGA | 17 | 876 |
| BCL11A-392 | − | CUCCACCGCCAGCUCCC | 17 | 877 |
| BCL11A-393 | − | GCCAGCUCCCCGGAACC | 17 | 878 |
| BCL11A-394 | − | ACCCGGCACCAGCGACU | 17 | 879 |
| BCL11A-395 | − | CGGCACCAGCGACUUGG | 17 | 880 |
| BCL11A-396 | − | GGCACCAGCGACUUGGU | 17 | 881 |
| BCL11A-397 | − | CAGCGCGCUCAAGUCCG | 17 | 882 |
| BCL11A-398 | − | CGCGCUCAAGUCCGUGG | 17 | 883 |
| BCL11A-399 | − | CGACCCCAACCUGAUCC | 17 | 884 |
| BCL11A-400 | − | AACCUGAUCCCGGAGAA | 17 | 885 |
| BCL11A-401 | − | ACCUGAUCCCGGAGAAC | 17 | 886 |
| BCL11A-402 | − | CCUGAUCCCGGAGAACG | 17 | 887 |
| BCL11A-403 | − | CCCGGAGAACGGGGACG | 17 | 888 |

TABLE 2D-continued

4th Tier

| gRNA Name | DNA Strand | Targeting domain | Target Site Length | SEQ ID NO |
|---|---|---|---|---|
| BCL11A-404 | - | GGAGAACGGGGACGAGG | 17 | 889 |
| BCL11A-405 | - | CGGGGACGAGGAGGAAG | 17 | 890 |
| BCL11A-406 | - | GGACGAGGAGGAAGAGG | 17 | 891 |
| BCL11A-407 | - | GGAAGAGGAGGACGACG | 17 | 892 |
| BCL11A-408 | - | GGAGGACGACGAGGAAG | 17 | 893 |
| BCL11A-409 | - | CGAGGAAGAGGAAGAAG | 17 | 894 |
| BCL11A-410 | - | GGAAGAGGAAGAAGAGG | 17 | 895 |
| BCL11A-411 | - | GGAAGAAGAGGAGGAAG | 17 | 896 |
| BCL11A-412 | - | AGAAGAGGAGGAAGAGG | 17 | 897 |
| BCL11A-413 | - | AGAGGAGGAAGAGGAGG | 17 | 898 |
| BCL11A-414 | - | GGAGGAAGAGGAGGAGG | 17 | 899 |
| BCL11A-415 | + | UCCUCGUCCCCGUUCUC | 17 | 900 |
| BCL11A-416 | + | CCUCGUCCCCGUUCUCC | 17 | 901 |
| BCL11A-417 | + | CCCCGUUCUCCGGGAUC | 17 | 902 |
| BCL11A-418 | + | GUUCUCCGGGAUCAGGU | 17 | 903 |
| BCL11A-419 | + | UUCUCCGGGAUCAGGUU | 17 | 904 |
| BCL11A-420 | + | UCUCCGGGAUCAGGUUG | 17 | 905 |
| BCL11A-421 | + | GUUCUCGCUCUUGAACU | 17 | 906 |
| BCL11A-422 | + | CUUGAACUUGGCCACCA | 17 | 907 |
| BCL11A-423 | + | GGACUUGAGCGCGCUGC | 17 | 908 |
| BCL11A-424 | + | GCUGCCCACCAAGUCGC | 17 | 909 |
| BCL11A-425 | + | CACCAAGUCGCUGGUGC | 17 | 910 |
| BCL11A-426 | + | ACCAAGUCGCUGGUGCC | 17 | 911 |
| BCL11A-427 | + | UCGCUGGUGCCGGGUUC | 17 | 912 |
| BCL11A-428 | + | CGCUGGUGCCGGGUUCC | 17 | 913 |
| BCL11A-429 | + | GCUGGUGCCGGGUUCCG | 17 | 914 |
| BCL11A-430 | + | GCCGGGUUCCGGGGAGC | 17 | 915 |
| BCL11A-431 | + | GGGUUCCGGGGAGCUGG | 17 | 916 |
| BCL11A-432 | + | UUCCGGGGAGCUGGCGG | 17 | 917 |
| BCL11A-433 | + | GGUGGAGAGACCGUCGU | 17 | 918 |
| BCL11A-434 | + | GUCGGACUUGACCGUCA | 17 | 919 |
| BCL11A-435 | + | UCGGACUUGACCGUCAU | 17 | 920 |
| BCL11A-436 | + | CGGACUUGACCGUCAUG | 17 | 921 |
| BCL11A-437 | + | GGACUUGACCGUCAUGG | 17 | 922 |
| BCL11A-438 | + | GCAUGUGCGUCUUCAUG | 17 | 923 |
| BCL11A-439 | + | GUGGCGCUUCAGCUUGC | 17 | 924 |
| BCL11A-440 | + | GCUUCAGCUUGCUGGCC | 17 | 925 |
| BCL11A-441 | + | CUUCAGCUUGCUGGCCU | 17 | 926 |
| BCL11A-442 | + | UGGCCUGGGUGCACGCG | 17 | 927 |
| BCL11A-443 | + | UGCACGCGUGGUCGCAC | 17 | 928 |
| BCL11A-444 | + | GCACAGGUUGCACUUGU | 17 | 929 |
| BCL11A-445 | + | CACAGGUUGCACUUGUA | 17 | 930 |
| BCL11A-446 | + | AGGGCUUCUCGCCCGUG | 17 | 931 |
| BCL11A-447 | + | CGCCCGUGUGGCUGCGC | 17 | 932 |
| BCL11A-448 | + | UGCGCCGGUGCACCACC | 17 | 933 |
| BCL11A-449 | + | GCAGAACUCGCAUGACU | 17 | 934 |
| BCL11A-450 | + | CAUGACUUGGACUUGAC | 17 | 935 |
| BCL11A-451 | + | AUGACUUGGACUUGACC | 17 | 936 |
| BCL11A-452 | + | UGACUUGGACUUGACCG | 17 | 937 |
| BCL11A-453 | + | GACUUGGACUUGACCGG | 17 | 938 |
| BCL11A-454 | + | UGGACUUGACCGGGGGC | 17 | 939 |
| BCL11A-455 | + | GGACUUGACCGGGGGCU | 17 | 940 |
| BCL11A-456 | + | CUUGACCGGGGCUGGG | 17 | 941 |
| BCL11A-457 | + | UUGACCGGGGCUGGGA | 17 | 942 |
| BCL11A-458 | + | ACCGGGGCUGGGAGGG | 17 | 943 |
| BCL11A-459 | + | GGGGGCUGGGAGGGAGG | 17 | 944 |
| BCL11A-460 | + | GGGGCUGGGAGGGAGGA | 17 | 945 |
| BCL11A-461 | + | GGGCUGGGAGGGAGGAG | 17 | 946 |
| BCL11A-462 | + | CUGGGAGGGAGGAGGGG | 17 | 947 |
| BCL11A-463 | + | GGAGGGGCGGAUUGCAG | 17 | 948 |
| BCL11A-464 | + | GGGGCGGAUUGCAGAGG | 17 | 949 |
| BCL11A-465 | + | GGGCGGAUUGCAGAGGA | 17 | 950 |
| BCL11A-466 | + | CGGAUUGCAGAGGAGGG | 17 | 951 |
| BCL11A-467 | + | GGAUUGCAGAGGAGGGA | 17 | 952 |
| BCL11A-468 | + | GAUUGCAGAGGAGGGAG | 17 | 953 |
| BCL11A-469 | + | AUUGCAGAGGAGGGAGG | 17 | 954 |
| BCL11A-470 | + | UUGCAGAGGAGGGAGGG | 17 | 955 |
| BCL11A-471 | + | UGCAGAGGAGGGAGGGG | 17 | 956 |
| BCL11A-472 | + | GGAGGGGGGCGUCGCC | 17 | 957 |
| BCL11A-473 | + | GGGGGCGUCGCCAGGA | 17 | 958 |
| BCL11A-474 | + | GGGGGCGUCGCCAGGAA | 17 | 959 |
| BCL11A-475 | + | GGCGUCGCCAGGAAGGG | 17 | 960 |
| BCL11A-476 | + | AAGGGCGGCUUGCUACC | 17 | 961 |
| BCL11A-477 | + | GCGGCUUGCUACCUGGC | 17 | 962 |

TABLE 2D-continued

4th Tier

| gRNA Name | DNA Strand | Targeting domain | Target Site Length | SEQ ID NO |
|---|---|---|---|---|
| BCL11A-478 | + | UUGCUACCUGGCUGGAA | 17 | 963 |
| BCL11A-479 | + | UGCAGUAACCUUUGCAU | 17 | 964 |
| BCL11A-480 | + | GCAGUAACCUUUGCAUA | 17 | 965 |
| BCL11A-481 | + | UAACCUUUGCAUAGGGC | 17 | 966 |
| BCL11A-482 | + | AACCUUUGCAUAGGGCU | 17 | 967 |
| BCL11A-483 | + | UUUGCAUAGGGCUGGGC | 17 | 968 |
| BCL11A-484 | + | AUAGGGCUGGGCCGGCC | 17 | 969 |
| BCL11A-485 | + | UAGGGCUGGGCCGGCCU | 17 | 970 |
| BCL11A-486 | + | AGGGCUGGGCCGGCCUG | 17 | 971 |
| BCL11A-487 | + | GGCCGGCCUGGGGACAG | 17 | 972 |
| BCL11A-488 | + | CGGCCUGGGGACAGCGG | 17 | 973 |
| BCL11A-489 | + | GGCCUGGGGACAGCGGU | 17 | 974 |
| BCL11A-490 | + | UCUCCUAGAGAAAUCCA | 17 | 975 |
| BCL11A-491 | + | CCUAGAGAAAUCCAUGG | 17 | 976 |
| BCL11A-492 | + | CUAGAGAAAUCCAUGGC | 17 | 977 |
| BCL11A-493 | + | GAGAAAUCCAUGGCGGG | 17 | 978 |
| BCL11A-494 | + | GGAGGCUCCAUAGCCAU | 17 | 979 |
| BCL11A-495 | + | CCGCAGCACCCUGUCAA | 17 | 980 |
| BCL11A-496 | + | ACCCUGUCAAAGGCACU | 17 | 981 |
| BCL11A-497 | + | CCCUGUCAAAGGCACUC | 17 | 982 |
| BCL11A-498 | + | CAAAGGCACUCGGGUGA | 17 | 983 |
| BCL11A-499 | + | AAAGGCACUCGGGUGAU | 17 | 984 |
| BCL11A-500 | + | GGCACUCGGGUGAUGGG | 17 | 985 |
| BCL11A-501 | + | UCGGGUGAUGGGUGGCC | 17 | 986 |
| BCL11A-502 | + | CGGGUGAUGGGUGGCCA | 17 | 987 |
| BCL11A-503 | + | CCAUCUCUUCCGCCCCC | 17 | 988 |
| BCL11A-504 | + | CCCCCAGGCGCUCUAUG | 17 | 989 |
| BCL11A-505 | + | CCAGGCGCUCUAUGCGG | 17 | 990 |
| BCL11A-506 | + | CAGGCGCUCUAUGCGGU | 17 | 991 |
| BCL11A-507 | + | AGGCGCUCUAUGCGGUG | 17 | 992 |
| BCL11A-508 | + | GGCGCUCUAUGCGGUGG | 17 | 993 |
| BCL11A-509 | + | GGGUCCAAGUGAUGUCU | 17 | 994 |
| BCL11A-510 | + | UCCAAGUGAUGUCUCGG | 17 | 995 |
| BCL11A-511 | + | AAGUGAUGUCUCGGUGG | 17 | 996 |
| BCL11A-512 | + | UCGGUGGUGGACUAAAC | 17 | 997 |
| BCL11A-513 | + | CGGUGGUGGACUAAACA | 17 | 998 |
| BCL11A-514 | + | GGUGGUGGACUAAACAG | 17 | 999 |
| BCL11A-515 | + | GUGGUGGACUAAACAGG | 17 | 1000 |
| BCL11A-516 | + | UGGUGGACUAAACAGGG | 17 | 1001 |
| BCL11A-517 | + | GGUGGACUAAACAGGGG | 17 | 1002 |
| BCL11A-518 | + | ACUAAACAGGGGGGGAG | 17 | 1003 |
| BCL11A-519 | + | CUAAACAGGGGGGGAGU | 17 | 1004 |
| BCL11A-520 | + | AACAGGGGGGGAGUGGG | 17 | 1005 |
| BCL11A-521 | + | GAAAGCGCCCUUCUGCC | 17 | 1006 |
| BCL11A-522 | + | GCGCCCUUCUGCCAGGC | 17 | 1007 |
| BCL11A-523 | + | UCUCUCGAUACUGAUCC | 17 | 1008 |
| BCL11A-524 | + | AUCCUGGUAUUCUUAGC | 17 | 1009 |
| BCL11A-525 | + | UAUUCUUAGCAGGUUAA | 17 | 1010 |
| BCL11A-526 | + | AUUCUUAGCAGGUUAAA | 17 | 1011 |
| BCL11A-527 | + | UUCUUAGCAGGUUAAAG | 17 | 1012 |
| BCL11A-528 | + | CUGCAAUAUGAAUCCCA | 17 | 1013 |
| BCL11A-529 | + | AUAUGAAUCCCAUGGAG | 17 | 1014 |
| BCL11A-530 | + | UGAAUCCCAUGGAGAGG | 17 | 1015 |
| BCL11A-531 | + | UCCCAUGGAGAGGUGGC | 17 | 1016 |
| BCL11A-532 | + | CCCAUGGAGAGGUGGCU | 17 | 1017 |
| BCL11A-533 | + | UGGAGAGGUGGCUGGGA | 17 | 1018 |
| BCL11A-534 | + | UCUGCACCUAGUCCUGA | 17 | 1019 |
| BCL11A-535 | + | CUGCACCUAGUCCUGAA | 17 | 1020 |
| BCL11A-536 | + | GAAGGGAUACCAACCCG | 17 | 1021 |
| BCL11A-537 | + | AAGGGAUACCAACCCGC | 17 | 1022 |
| BCL11A-538 | + | AGGGAUACCAACCCGCG | 17 | 1023 |
| BCL11A-539 | + | UACCAACCCGCGGGGUC | 17 | 1024 |
| BCL11A-540 | + | ACCAACCCGCGGGGUCA | 17 | 1025 |
| BCL11A-541 | + | CCAACCCGCGGGGUCAG | 17 | 1026 |
| BCL11A-542 | + | CAAGAGAAACCAUGCAC | 17 | 1027 |
| BCL11A-543 | + | AACCAUGCACUGGUGAA | 17 | 1028 |
| BCL11A-544 | + | UGUACAUGUGUAGCUGC | 17 | 1029 |
| BCL11A-545 | + | GUACAUGUGUAGCUGCU | 17 | 1030 |
| BCL11A-546 | − | AGAGGAGGAGGAGGAGCUGA | 20 | 1031 |
| BCL11A-547 | − | AGGAGCUGACGGAGAGCGAG | 20 | 1032 |
| BCL11A-548 | − | GGAGCUGACGGAGAGCGAGA | 20 | 1033 |
| BCL11A-549 | − | GCUGACGGAGAGCGAGGGG | 20 | 1034 |
| BCL11A-550 | − | GAGAGCGAGGGUGGACUA | 20 | 1035 |
| BCL11A-551 | − | GAGAGGGUGGACUACGGCUU | 20 | 1036 |

TABLE 2D-continued

4th Tier

| gRNA Name | DNA Strand | Targeting domain | Target Site Length | SEQ ID NO |
|---|---|---|---|---|
| BCL11A-552 | − | AGAGGGUGGACUACGGCUUC | 20 | 1037 |
| BCL11A-553 | − | CUACGGCUUCGGGCUGAGCC | 20 | 1038 |
| BCL11A-554 | − | CGGCUUCGGGCUGAGCCUGG | 20 | 1039 |
| BCL11A-555 | − | CUUCGGGCUGAGCCUGGAGG | 20 | 1040 |
| BCL11A-556 | − | GCCACCACGAGAACAGCUCG | 20 | 1041 |
| BCL11A-557 | − | CCACCACGAGAACAGCUCGC | 20 | 1042 |
| BCL11A-558 | − | CACCACGAGAACAGCUCGCG | 20 | 1043 |
| BCL11A-559 | − | CGAGAACAGCUCGCGGGGCG | 20 | 1044 |
| BCL11A-560 | − | CAGCUCGCGGGGCGCGGUCG | 20 | 1045 |
| BCL11A-561 | − | AGCUCGCGGGGCGCGGUCGU | 20 | 1046 |
| BCL11A-562 | − | GCGGGGCGCGGUCGUGGGCG | 20 | 1047 |
| BCL11A-563 | − | CGGGGCGCGGUCGUGGGCGU | 20 | 1048 |
| BCL11A-564 | − | CGCCCUGCCCGACGUCAUGC | 20 | 1049 |
| BCL11A-565 | − | GCCCUGCCCGACGUCAUGCA | 20 | 1050 |
| BCL11A-566 | − | GCCCGACGUCAUGCAGGGCA | 20 | 1051 |
| BCL11A-567 | − | CUCCAUGCAGCACUUCAGCG | 20 | 1052 |
| BCL11A-568 | − | CUUCAGCGAGGCCUUCCACC | 20 | 1053 |
| BCL11A-569 | − | CGAGGCCUUCCACCAGGUCC | 20 | 1054 |
| BCL11A-570 | − | GAGGCCUUCCACCAGGUCCU | 20 | 1055 |
| BCL11A-571 | − | CUGGGCGAGAAGCAUAAGCG | 20 | 1056 |
| BCL11A-572 | − | GAAGCAUAAGCGCGGCCACC | 20 | 1057 |
| BCL11A-573 | − | UAAGCGCGGCCACCUGGCCG | 20 | 1058 |
| BCL11A-574 | − | CGGCCACCUGGCCGAGGCCG | 20 | 1059 |
| BCL11A-575 | − | GGCCACCUGGCCGAGGCCGA | 20 | 1060 |
| BCL11A-576 | − | UGGCCGAGGCCGAGGGCCAC | 20 | 1061 |
| BCL11A-577 | − | GGCCGAGGCCGAGGGCCACA | 20 | 1062 |
| BCL11A-578 | − | GGACACUUGCGACGAAGACU | 20 | 1063 |
| BCL11A-579 | − | CACUUGCGACGAAGACUCGG | 20 | 1064 |
| BCL11A-580 | − | UGCGACGAAGACUCGGUGGC | 20 | 1065 |
| BCL11A-581 | − | AGACUCGGUGGCCGGCGAGU | 20 | 1066 |
| BCL11A-582 | − | GAGUCGGACCGCAUAGACGA | 20 | 1067 |
| BCL11A-583 | − | AUAGACGAUGGCACUGUUAA | 20 | 1068 |
| BCL11A-584 | − | GAUGGCACUGUUAAUGGCCG | 20 | 1069 |
| BCL11A-585 | − | UAAUGGCCGCGGCUGCUCCC | 20 | 1070 |
| BCL11A-586 | − | AAUGGCCGCGGCUGCUCCCC | 20 | 1071 |
| BCL11A-587 | − | CGGCUGCUCCCCGGGCGAGU | 20 | 1072 |
| BCL11A-588 | − | CUCCCCGGGCGAGUCGGCCU | 20 | 1073 |
| BCL11A-589 | − | UCCCCGGGCGAGUCGGCCUC | 20 | 1074 |
| BCL11A-590 | − | CCCCGGGCGAGUCGGCCUCG | 20 | 1075 |
| BCL11A-591 | − | CCCGGGCGAGUCGGCCUCGG | 20 | 1076 |
| BCL11A-592 | − | CCGGGCGAGUCGGCCUCGGG | 20 | 1077 |
| BCL11A-593 | − | CCUGUCCAAAAGCUGCUGC | 20 | 1078 |
| BCL11A-594 | − | CUGUCCAAAAGCUGCUGCU | 20 | 1079 |
| BCL11A-595 | − | UAAGCGCAUCAAGCUCGAGA | 20 | 1080 |
| BCL11A-596 | − | GAAGGAGUUCGACCUGCCCC | 20 | 1081 |
| BCL11A-597 | − | CCCGGCCGCGAUGCCCAACA | 20 | 1082 |
| BCL11A-598 | − | CGGAGAACGUGUACUCGCAG | 20 | 1083 |
| BCL11A-599 | − | GUGUACUCGCAGUGGCUCGC | 20 | 1084 |
| BCL11A-600 | − | GCAGUGGCUCGCCGGCUACG | 20 | 1085 |
| BCL11A-601 | − | UCGCCGGCUACGCGGCCUCC | 20 | 1086 |
| BCL11A-602 | − | AAAGAUCCCUUCCUUAGCUU | 20 | 1087 |
| BCL11A-603 | − | AUCGCCUUUUGCCUCCUCGU | 20 | 1088 |
| BCL11A-604 | − | CUCCUCGUCGGAGCACUCCU | 20 | 1089 |
| BCL11A-605 | − | UCGGAGCACUCCUCGGAGAA | 20 | 1090 |
| BCL11A-606 | − | CGGAGCACUCCUCGGAGAAC | 20 | 1091 |
| BCL11A-607 | − | UUGCGCUUCUCCACACCGCC | 20 | 1092 |
| BCL11A-608 | − | UGCGCUUCUCCACACCGCCC | 20 | 1093 |
| BCL11A-609 | − | GCGCUUCUCCACACCGCCCG | 20 | 1094 |
| BCL11A-610 | − | CUCCACACCGCCCGGGGAGC | 20 | 1095 |
| BCL11A-611 | − | ACACCGCCCGGGGAGCUGGA | 20 | 1096 |
| BCL11A-612 | − | CCGCCCGGGGAGCUGGACGG | 20 | 1097 |
| BCL11A-613 | − | CGCCCGGGGAGCUGGACGGA | 20 | 1098 |
| BCL11A-614 | − | GGAGCUGGACGGAGGGAUCU | 20 | 1099 |
| BCL11A-615 | − | GAGCUGGACGGAGGGAUCUC | 20 | 1100 |
| BCL11A-616 | − | AGCUGGACGGAGGGAUCUCG | 20 | 1101 |
| BCL11A-617 | − | GGAGGGAUCUCGGGGCGCAG | 20 | 1102 |
| BCL11A-618 | − | GAUCUCGGGGCGCAGCGGCA | 20 | 1103 |
| BCL11A-619 | − | AUCUCGGGGCGCAGCGGCAC | 20 | 1104 |
| BCL11A-620 | − | GGGCGCAGCGGCACGGGAAG | 20 | 1105 |
| BCL11A-621 | − | CGCAGCGGCACGGGAAGUGG | 20 | 1106 |
| BCL11A-622 | − | GCAGCGGCACGGGAAGUGGA | 20 | 1107 |
| BCL11A-623 | − | GGGAGCACGCCCCAUAUUAG | 20 | 1108 |
| BCL11A-624 | − | CACGCCCCAUAUUAGUGGUC | 20 | 1109 |
| BCL11A-625 | − | ACGCCCCAUAUUAGUGGUCC | 20 | 1110 |

TABLE 2D-continued

4th Tier

| gRNA Name | DNA Strand | Targeting domain | Target Site Length | SEQ ID NO |
|---|---|---|---|---|
| BCL11A-626 | - | CCAUAUUAGUGGUCCGGGCC | 20 | 1111 |
| BCL11A-627 | - | CAUAUUAGUGGUCCGGGCCC | 20 | 1112 |
| BCL11A-628 | - | UUAGUGGUCCGGGCCCGGGC | 20 | 1113 |
| BCL11A-629 | - | GGGCAGGCCCAGCUCAAAAG | 20 | 1114 |
| BCL11A-630 | - | GGCAGGCCCAGCUCAAAAGA | 20 | 1115 |
| BCL11A-631 | + | GCGUCUGCCCUCUUUUGAGC | 20 | 1116 |
| BCL11A-632 | + | CGUCUGCCCUCUUUUGAGCU | 20 | 1117 |
| BCL11A-633 | + | UCUUUUGAGCUGGGCCUGCC | 20 | 1118 |
| BCL11A-634 | + | CUUUUGAGCUGGGCCUGCCC | 20 | 1119 |
| BCL11A-635 | + | GAGCUGGGCCUGCCCGGGCC | 20 | 1120 |
| BCL11A-636 | + | CCGGGCCCGGACCACUAAUA | 20 | 1121 |
| BCL11A-637 | + | CGGGCCCGGACCACUAAUAU | 20 | 1122 |
| BCL11A-638 | + | GGGCCCGGACCACUAAUAUG | 20 | 1123 |
| BCL11A-639 | + | GAUCCCUCCGUCCAGCUCCC | 20 | 1124 |
| BCL11A-640 | + | AUCCCUCCGUCCAGCUCCCC | 20 | 1125 |
| BCL11A-641 | + | CCUCCGUCCAGCUCCCCGGG | 20 | 1126 |
| BCL11A-642 | + | GUCCAGCUCCCCGGGCGGUG | 20 | 1127 |
| BCL11A-643 | + | GCGCAAACUCCCGUUCUCCG | 20 | 1128 |
| BCL11A-644 | + | CUCCGAGGAGUGCUCCGACG | 20 | 1129 |
| BCL11A-645 | + | CGAGGAGUGCUCCGACGAGG | 20 | 1130 |
| BCL11A-646 | + | UGCUCCGACGAGGAGGCAAA | 20 | 1131 |
| BCL11A-647 | + | GGAGGCAAAAGGCGAUUGUC | 20 | 1132 |
| BCL11A-648 | + | GUCUGGAGUCUCCGAAGCUA | 20 | 1133 |
| BCL11A-649 | + | GGAGUCUCCGAAGCUAAGGA | 20 | 1134 |
| BCL11A-650 | + | GAGUCUCCGAAGCUAAGGAA | 20 | 1135 |
| BCL11A-651 | + | GAAGGGAUCUUUGAGCUGCC | 20 | 1136 |
| BCL11A-652 | + | GGGAUCUUUGAGCUGCCUGG | 20 | 1137 |
| BCL11A-653 | + | CUGCCUGGAGGCCGCGUAGC | 20 | 1138 |
| BCL11A-654 | + | CGAGUACACGUUCUCCGUGU | 20 | 1139 |
| BCL11A-655 | + | GAGUACACGUUCUCCGUGUU | 20 | 1140 |
| BCL11A-656 | + | GUUCUCCGUGUUGGGCAUCG | 20 | 1141 |
| BCL11A-657 | + | UCCGUGUUGGGCAUCGCGGC | 20 | 1142 |
| BCL11A-658 | + | CCGUGUUGGGCAUCGCGGCC | 20 | 1143 |
| BCL11A-659 | + | CGUGUUGGGCAUCGCGGCCG | 20 | 1144 |
| BCL11A-660 | + | GUGUUGGGCAUCGCGGCCGG | 20 | 1145 |
| BCL11A-661 | + | UGGGCAUCGCGGCCGGGGGC | 20 | 1146 |
| BCL11A-662 | + | GAGCUUGAUGCGCUUAGAGA | 20 | 1147 |
| BCL11A-663 | + | AGCUUGAUGCGCUUAGAGAA | 20 | 1148 |
| BCL11A-664 | + | GCUUGAUGCGCUUAGAGAAG | 20 | 1149 |
| BCL11A-665 | + | AGAGAAGGGGCUCAGCGAGC | 20 | 1150 |
| BCL11A-666 | + | GAGAAGGGGCUCAGCGAGCU | 20 | 1151 |
| BCL11A-667 | + | AGAAGGGGCUCAGCGAGCUG | 20 | 1152 |
| BCL11A-668 | + | GCUGCCCAGCAGCAGCUUUU | 20 | 1153 |
| BCL11A-669 | + | CCAGCAGCAGCUUUUUGGAC | 20 | 1154 |
| BCL11A-670 | + | CUUUUUGGACAGGCCCCCCG | 20 | 1155 |
| BCL11A-671 | + | CCCCCCGAGGCCGACUCGCC | 20 | 1156 |
| BCL11A-672 | + | CCCCCGAGGCCGACUCGCCC | 20 | 1157 |
| BCL11A-673 | + | CCCCGAGGCCGACUCGCCCG | 20 | 1158 |
| BCL11A-674 | + | ACUCGCCCGGGGAGCAGCCG | 20 | 1159 |
| BCL11A-675 | + | UAACAGUGCCAUCGUCUAUG | 20 | 1160 |
| BCL11A-676 | + | GUCUAUGCGGUCCGACUCGC | 20 | 1161 |
| BCL11A-677 | + | CUUCGUCGCAAGUGUCCCUG | 20 | 1162 |
| BCL11A-678 | + | GCAAGUGUCCCUGUGGCCCU | 20 | 1163 |
| BCL11A-679 | + | GUCCCUGUGGCCCUCGGCCU | 20 | 1164 |
| BCL11A-680 | + | UGUGGCCCUCGGCCUCGGCC | 20 | 1165 |
| BCL11A-681 | + | GGCCCUCGGCCUCGGCCAGG | 20 | 1166 |
| BCL11A-682 | + | CGCGCUUAUGCUUCUCGCCC | 20 | 1167 |
| BCL11A-683 | + | UAUGCUUCUCGCCCAGGACC | 20 | 1168 |
| BCL11A-684 | + | GCUUCUCGCCCAGGACCUGG | 20 | 1169 |
| BCL11A-685 | + | CUCGCCCAGGACCUGGUGGA | 20 | 1170 |
| BCL11A-686 | + | GGCCUCGCUGAAGUGCUGCA | 20 | 1171 |
| BCL11A-687 | + | CACCAUGCCCUGCAUGACGU | 20 | 1172 |
| BCL11A-688 | + | ACCAUGCCCUGCAUGACGUC | 20 | 1173 |
| BCL11A-689 | + | UGCCCUGCAUGACGUCGGGC | 20 | 1174 |
| BCL11A-690 | + | GCCCUGCAUGACGUCGGGCA | 20 | 1175 |
| BCL11A-691 | + | GCAUGACGUCGGGCAGGGCG | 20 | 1176 |
| BCL11A-692 | + | CGCCCCGCGAGCUGUUCUCG | 20 | 1177 |
| BCL11A-693 | + | CCCGCGAGCUGUUCUCGUGG | 20 | 1178 |
| BCL11A-694 | + | CGUGGUGGCGCGCCGCCUCC | 20 | 1179 |
| BCL11A-695 | - | GGAGGAAGAGGAGGAGG | 17 | 1180 |
| BCL11A-696 | - | GGAGGAGGAGGAGCUGA | 17 | 1181 |
| BCL11A-697 | - | AGCUGACGGAGAGCGAG | 17 | 1182 |
| BCL11A-698 | - | GCUGACGGAGAGCGAGA | 17 | 1183 |
| BCL11A-699 | - | GACGGAGAGCGAGAGGG | 17 | 1184 |

TABLE 2D-continued

4th Tier

| gRNA Name | DNA Strand | Targeting domain | Target Site Length | SEQ ID NO |
|---|---|---|---|---|
| BCL11A-700 | - | AGCGAGAGGGUGGACUA | 17 | 1185 |
| BCL11A-701 | - | AGGGUGGACUACGGCUU | 17 | 1186 |
| BCL11A-702 | - | GGGUGGACUACGGCUUC | 17 | 1187 |
| BCL11A-703 | - | CGGCUUCGGGCUGAGCC | 17 | 1188 |
| BCL11A-704 | - | CUUCGGGCUGAGCCUGG | 17 | 1189 |
| BCL11A-705 | - | CGGGCUGAGCCUGGAGG | 17 | 1190 |
| BCL11A-706 | - | ACCACGAGAACAGCUCG | 17 | 1191 |
| BCL11A-707 | - | CCACGAGAACAGCUCGC | 17 | 1192 |
| BCL11A-708 | - | CACGAGAACAGCUCGCG | 17 | 1193 |
| BCL11A-709 | - | GAACAGCUCGCGGGGCG | 17 | 1194 |
| BCL11A-710 | - | CUCGCGGGGCGCGGUCG | 17 | 1195 |
| BCL11A-711 | - | UCGCGGGGCGCGGUCGU | 17 | 1196 |
| BCL11A-712 | - | GGGCGCGGUCGUGGGCG | 17 | 1197 |
| BCL11A-713 | - | GGCGCGGUCGUGGGCGU | 17 | 1198 |
| BCL11A-714 | - | CCUGCCCGACGUCAUGC | 17 | 1199 |
| BCL11A-715 | - | CUGCCCGACGUCAUGCA | 17 | 1200 |
| BCL11A-716 | - | CGACGUCAUGCAGGGCA | 17 | 1201 |
| BCL11A-717 | - | CAUGCAGCACUUCAGCG | 17 | 1202 |
| BCL11A-718 | - | CAGCGAGGCCUUCCACC | 17 | 1203 |
| BCL11A-719 | - | GGCCUUCCACCAGGUCC | 17 | 1204 |
| BCL11A-720 | - | GCCUUCCACCAGGUCCU | 17 | 1205 |
| BCL11A-721 | - | GGCGAGAAGCAUAAGCG | 17 | 1206 |
| BCL11A-722 | - | GCAUAAGCGCGGCCACC | 17 | 1207 |
| BCL11A-723 | - | GCGCGGCCACCUGGCCG | 17 | 1208 |
| BCL11A-724 | - | CCACCUGGCCGAGGCCG | 17 | 1209 |
| BCL11A-725 | - | CACCUGGCCGAGGCCGA | 17 | 1210 |
| BCL11A-726 | - | CCGAGGCCGAGGGCCAC | 17 | 1211 |
| BCL11A-727 | - | CGAGGCCGAGGGCCACA | 17 | 1212 |
| BCL11A-728 | - | CACUUGCGACGAAGACU | 17 | 1213 |
| BCL11A-729 | - | UUGCGACGAAGACUCGG | 17 | 1214 |
| BCL11A-730 | - | GACGAAGACUCGGUGGC | 17 | 1215 |
| BCL11A-731 | - | CUCGGUGGCCGGCGAGU | 17 | 1216 |
| BCL11A-732 | - | UCGGACCGCAUAGACGA | 17 | 1217 |
| BCL11A-733 | - | GACGAUGGCACUGUUAA | 17 | 1218 |
| BCL11A-734 | - | GGCACUGUUAAUGGCCG | 17 | 1219 |
| BCL11A-735 | - | UGGCCGCGGCUGCUCCC | 17 | 1220 |
| BCL11A-736 | - | GGCCGCGGCUGCUCCCC | 17 | 1221 |
| BCL11A-737 | - | CUGCUCCCCGGGCGAGU | 17 | 1222 |
| BCL11A-738 | - | CCCGGGCGAGUCGGCCU | 17 | 1223 |
| BCL11A-739 | - | CCGGGCGAGUCGGCCUC | 17 | 1224 |
| BCL11A-740 | - | CGGGCGAGUCGGCCUCG | 17 | 1225 |
| BCL11A-741 | - | GGGCGAGUCGGCCUCGG | 17 | 1226 |
| BCL11A-742 | - | GGCGAGUCGGCCUCGGG | 17 | 1227 |
| BCL11A-743 | - | GUCCAAAAAGCUGCUGC | 17 | 1228 |
| BCL11A-744 | - | UCCAAAAAGCUGCUGCU | 17 | 1229 |
| BCL11A-745 | - | GCGCAUCAAGCUCGAGA | 17 | 1230 |
| BCL11A-746 | - | GGAGUUCGACCUGCCCC | 17 | 1231 |
| BCL11A-747 | - | GGCCGCGAUGCCCAACA | 17 | 1232 |
| BCL11A-748 | - | AGAACGUGUACUCGCAG | 17 | 1233 |
| BCL11A-749 | - | UACUCGCAGUGGCUCGC | 17 | 1234 |
| BCL11A-750 | - | GUGGCUCGCCGGCUACG | 17 | 1235 |
| BCL11A-751 | - | CCGGCUACGCGGCCUCC | 17 | 1236 |
| BCL11A-752 | - | GAUCCCUUCCUUAGCUU | 17 | 1237 |
| BCL11A-753 | - | GCCUUUUGCCUCCUCGU | 17 | 1238 |
| BCL11A-754 | - | CUCGUCGGAGCACUCCU | 17 | 1239 |
| BCL11A-755 | - | GAGCACUCCUCGGAGAA | 17 | 1240 |
| BCL11A-756 | - | AGCACUCCUCGGAGAAC | 17 | 1241 |
| BCL11A-757 | - | CGCUUCUCCACACCGCC | 17 | 1242 |
| BCL11A-758 | - | GCUUCUCCACACCGCCC | 17 | 1243 |
| BCL11A-759 | - | CUUCUCCACACCGCCCG | 17 | 1244 |
| BCL11A-760 | - | CACACCGCCCGGGGAGC | 17 | 1245 |
| BCL11A-761 | - | CCGCCCGGGGAGCUGGA | 17 | 1246 |
| BCL11A-762 | - | CCCGGGGAGCUGGACGG | 17 | 1247 |
| BCL11A-763 | - | CCGGGGAGCUGGACGGA | 17 | 1248 |
| BCL11A-764 | - | GCUGGACGGAGGGAUCU | 17 | 1249 |
| BCL11A-765 | - | CUGGACGGAGGGAUCUC | 17 | 1250 |
| BCL11A-766 | - | UGGACGGAGGGAUCUCG | 17 | 1251 |
| BCL11A-767 | - | GGGAUCUCGGGGCGCAG | 17 | 1252 |
| BCL11A-768 | - | CUCGGGGCGCAGCGGCA | 17 | 1253 |
| BCL11A-769 | - | UCGGGGCGCAGCGGCAC | 17 | 1254 |
| BCL11A-770 | - | CGCAGCGGCACGGGAAG | 17 | 1255 |
| BCL11A-771 | - | AGCGGCACGGGAAGUGG | 17 | 1256 |
| BCL11A-772 | - | GCGGCACGGGAAGUGGA | 17 | 1257 |
| BCL11A-773 | - | AGCACGCCCCAUAUUAG | 17 | 1258 |

TABLE 2D-continued

4th Tier

| gRNA Name | DNA Strand | Targeting domain | Target Site Length | SEQ ID NO |
|---|---|---|---|---|
| BCL11A-774 | − | GCCCCAUAUUAGUGGUC | 17 | 1259 |
| BCL11A-775 | − | CCCCAUAUUAGUGGUCC | 17 | 1260 |
| BCL11A-776 | − | UAUUAGUGGUCCGGGCC | 17 | 1261 |
| BCL11A-777 | − | AUUAGUGGUCCGGGCCC | 17 | 1262 |
| BCL11A-778 | − | GUGGUCCGGGCCCGGGC | 17 | 1263 |
| BCL11A-779 | − | CAGGCCCAGCUCAAAAG | 17 | 1264 |
| BCL11A-780 | − | AGGCCCAGCUCAAAAGA | 17 | 1265 |
| BCL11A-781 | + | UCUGCCCUCUUUUGAGC | 17 | 1266 |
| BCL11A-782 | + | CUGCCCUCUUUUGAGCU | 17 | 1267 |
| BCL11A-783 | + | UUUGAGCUGGGCCUGCC | 17 | 1268 |
| BCL11A-784 | + | UUGAGCUGGGCCUGCCC | 17 | 1269 |
| BCL11A-785 | + | CUGGGCCUGCCCGGGCC | 17 | 1270 |
| BCL11A-786 | + | GGCCCGGACCACUAAUA | 17 | 1271 |
| BCL11A-787 | + | GCCCGGACCACUAAUAU | 17 | 1272 |
| BCL11A-788 | + | CCCGGACCACUAAUAUG | 17 | 1273 |
| BCL11A-789 | + | CCCUCCGUCCAGCUCCC | 17 | 1274 |
| BCL11A-790 | + | CCUCCGUCCAGCUCCCC | 17 | 1275 |
| BCL11A-791 | + | CCGUCCAGCUCCCCGGG | 17 | 1276 |
| BCL11A-792 | + | CAGCUCCCCGGCGGUG | 17 | 1277 |
| BCL11A-793 | + | CAAACUCCCGUUCUCCG | 17 | 1278 |
| BCL11A-794 | + | CGAGGAGUGCUCCGACG | 17 | 1279 |
| BCL11A-795 | + | GGAGUGCUCCGACGAGG | 17 | 1280 |
| BCL11A-796 | + | UCCGACGAGGAGGCAAA | 17 | 1281 |
| BCL11A-797 | + | GGCAAAAGGCGAUUGUC | 17 | 1282 |
| BCL11A-798 | + | UGGAGUCUCCGAAGCUA | 17 | 1283 |
| BCL11A-799 | + | GUCUCCGAAGCUAAGGA | 17 | 1284 |
| BCL11A-800 | + | UCUCCGAAGCUAAGGAA | 17 | 1285 |
| BCL11A-801 | + | GGGAUCUUUGAGCUGCC | 17 | 1286 |
| BCL11A-802 | + | AUCUUUGAGCUGCCUGG | 17 | 1287 |
| BCL11A-803 | + | CCUGGAGGCCGCGUAGC | 17 | 1288 |
| BCL11A-804 | + | GUACACGUUCUCCGUGU | 17 | 1289 |
| BCL11A-805 | + | UACACGUUCUCCGUGUU | 17 | 1290 |
| BCL11A-806 | + | CUCCGUGUUGGGCAUCG | 17 | 1291 |
| BCL11A-807 | + | GUGUUGGGCAUCGCGGC | 17 | 1292 |
| BCL11A-808 | + | UGUUGGGCAUCGCGGCC | 17 | 1293 |
| BCL11A-809 | + | GUUGGGCAUCGCGGCCG | 17 | 1294 |
| BCL11A-810 | + | UUGGGCAUCGCGGCCGG | 17 | 1295 |
| BCL11A-811 | + | GCAUCGCGGCCGGGGGC | 17 | 1296 |
| BCL11A-812 | + | CUUGAUGCGCUUAGAGA | 17 | 1297 |
| BCL11A-813 | + | UUGAUGCGCUUAGAGAA | 17 | 1298 |
| BCL11A-814 | + | UGAUGCGCUUAGAGAAG | 17 | 1299 |
| BCL11A-815 | + | GAAGGGGCUCAGCGAGC | 17 | 1300 |
| BCL11A-816 | + | AAGGGGCUCAGCGAGCU | 17 | 1301 |
| BCL11A-817 | + | AGGGGCUCAGCGAGCUG | 17 | 1302 |
| BCL11A-818 | + | GCCCAGCAGCAGCUUUU | 17 | 1303 |
| BCL11A-819 | + | GCAGCAGCUUUUUGGAC | 17 | 1304 |
| BCL11A-820 | + | UUUGGACAGGCCCCCCG | 17 | 1305 |
| BCL11A-821 | + | CCCGAGGCCGACUCGCC | 17 | 1306 |
| BCL11A-822 | + | CCGAGGCCGACUCGCCC | 17 | 1307 |
| BCL11A-823 | + | CGAGGCCGACUCGCCCG | 17 | 1308 |
| BCL11A-824 | + | CGCCCGGGGAGCAGCCG | 17 | 1309 |
| BCL11A-825 | + | CAGUGCCAUCGUCUAUG | 17 | 1310 |
| BCL11A-826 | + | UAUGCGGUCCGACUCGC | 17 | 1311 |
| BCL11A-827 | + | CGUCGCAAGUGUCCCUG | 17 | 1312 |
| BCL11A-828 | + | AGUGUCCCUGUGGCCCU | 17 | 1313 |
| BCL11A-829 | + | CCUGUGGCCCUCGGCCU | 17 | 1314 |
| BCL11A-830 | + | GGCCCUCGGCCUCGGCC | 17 | 1315 |
| BCL11A-831 | + | CCUCGGCCUCGGCCAGG | 17 | 1316 |
| BCL11A-832 | + | GCUUAUGCUUCUCGCCC | 17 | 1317 |
| BCL11A-833 | + | GCUUCUCGCCCAGGACC | 17 | 1318 |
| BCL11A-834 | + | UCUCGCCCAGGACCUGG | 17 | 1319 |
| BCL11A-835 | + | GCCCAGGACCUGGUGGA | 17 | 1320 |
| BCL11A-836 | + | CUCGCUGAAGUGCUGCA | 17 | 1321 |
| BCL11A-837 | + | CAUGCCCUGCAUGACGU | 17 | 1322 |
| BCL11A-838 | + | AUGCCCUGCAUGACGUC | 17 | 1323 |
| BCL11A-839 | + | CCUGCAUGACGUCGGGC | 17 | 1324 |
| BCL11A-840 | + | CUGCAUGACGUCGGGCA | 17 | 1325 |
| BCL11A-841 | + | UGACGUCGGGCAGGGCG | 17 | 1326 |
| BCL11A-842 | + | CCCGCGAGCUGUUCUCG | 17 | 1327 |
| BCL11A-843 | + | GCGAGCUGUUCUCGUGG | 17 | 1328 |
| BCL11A-844 | + | GGUGGCGCCGCCGCUCC | 17 | 1329 |
| BCL11A-845 | − | CCCAGAGAGCUCAAGAUGUG | 20 | 1330 |
| BCL11A-846 | − | UCAAGAUGUGUGGCAGUUUU | 20 | 1331 |
| BCL11A-847 | − | GAUGUGUGGCAGUUUUCGGA | 20 | 1332 |

TABLE 2D-continued

4th Tier

| gRNA Name | DNA Strand | Targeting domain | Target Site Length | SEQ ID NO |
|---|---|---|---|---|
| BCL11A-848 | + | GCCACACAUCUUGAGCUCUC | 20 | 1333 |
| BCL11A-849 | + | CCACACAUCUUGAGCUCUCU | 20 | 1334 |
| BCL11A-850 | + | UCUCUGGGUACUACGCCGAA | 20 | 1335 |
| BCL11A-851 | + | CUCUGGGUACUACGCCGAAU | 20 | 1336 |
| BCL11A-852 | + | UCUGGGUACUACGCCGAAUG | 20 | 1337 |
| BCL11A-853 | + | CUGGGUACUACGCCGAAUGG | 20 | 1338 |
| BCL11A-854 | − | CUUCACACACCCCCAUU | 17 | 1339 |
| BCL11A-855 | − | AGAGAGCUCAAGAUGUG | 17 | 1340 |
| BCL11A-856 | − | AGAUGUGUGGCAGUUUU | 17 | 1341 |
| BCL11A-857 | − | GUGUGGCAGUUUUCGGA | 17 | 1342 |
| BCL11A-858 | + | ACACAUCUUGAGCUCUC | 17 | 1343 |
| BCL11A-859 | + | CACAUCUUGAGCUCUCU | 17 | 1344 |
| BCL11A-860 | + | CUGGGUACUACGCCGAA | 17 | 1345 |
| BCL11A-861 | + | UGGGUACUACGCCGAAU | 17 | 1346 |
| BCL11A-862 | + | GGGUACUACGCCGAAUG | 17 | 1347 |
| BCL11A-863 | + | GGUACUACGCCGAAUGG | 17 | 1348 |

Table 2E provides exemplary targeting domains for knocking out the BCL11A gene. In an embodiment, the targeting domain is the exact complement of the target domain. Any of the targeting domains in the table can be used with a S. aureus Cas9 molecule that gives double stranded cleavage. Any of the targeting domains in the table can be used with a S. aureus Cas9 single-stranded break nucleases (nickases). In an embodiment, dual targeting is used to create two nicks. When selecting gRNAs for use in a nickase pair, one gRNA targets a domain in the complementary strand and the second gRNA targets a domain in the non-complementary strand, e.g., a gRNA comprising any minus strand targeting domain may be paired any gRNA comprising a plus strand targeting domain targeting the same target position.

TABLE 2E

S. aureus gRNA targets for BCL11A knockout

| gRNA Name | DNA Strand | Targeting Domain | Target Site Length | SEQ ID NO |
|---|---|---|---|---|
| BCL11A-864 | − | AAACCCCAGCACUUAAGCAA | 20 | 1349 |
| BCL11A-865 | − | AACCCCAGCACUUAAGCAAA | 20 | 1350 |
| BCL11A-866 | − | ACCCCAGCACUUAAGCAAAC | 20 | 1351 |
| BCL11A-867 | − | CCCCAGCACUUAAGCAA | 17 | 1352 |
| BCL11A-868 | − | CCCAGCACUUAAGCAAA | 17 | 1353 |
| BCL11A-869 | − | CCAGCACUUAAGCAAAC | 17 | 1354 |
| BCL11A-870 | + | UGGGGUUUGCCUUGCUUGCG | 20 | 1355 |
| BCL11A-871 | + | AUUCCCGUUUGCUUAAGUGC | 20 | 1356 |
| BCL11A-872 | + | AAUUCCCGUUUGCUUAAGUG | 20 | 1357 |
| BCL11A-873 | + | GGUUUGCCUUGCUUGCG | 17 | 1358 |
| BCL11A-874 | + | CCCGUUUGCUUAAGUGC | 17 | 1359 |
| BCL11A-875 | + | UCCCGUUUGCUUAAGUG | 17 | 1360 |
| BCL11A-876 | − | UGAAGCCAUUCUUACAGAUG | 20 | 1361 |
| BCL11A-877 | − | AUGAACCAGACCACGGCCCG | 20 | 1362 |
| BCL11A-878 | − | UGAACCAGACCACGGCCCGU | 20 | 1363 |
| BCL11A-879 | − | GAACCAGACCACGGCCCGUU | 20 | 1364 |
| BCL11A-880 | − | CCACGGCCCGUUGGGAGCUC | 20 | 1365 |
| BCL11A-881 | − | CGGCCCGUUGGGAGCUCCAG | 20 | 1366 |
| BCL11A-882 | − | GGCCCGUUGGGAGCUCCAGA | 20 | 1367 |
| BCL11A-883 | − | GCCCGUUGGGAGCUCCAGAA | 20 | 1368 |
| BCL11A-884 | − | GGAUCAUGACCUCCUCACCU | 20 | 1369 |
| BCL11A-885 | − | UCACCUGUGGGCAGUGCCAG | 20 | 1370 |
| BCL11A-886 | − | AGUGCCAGAUGAACUUCCCA | 20 | 1371 |
| BCL11A-887 | − | GUGCCAGAUGAACUUCCCAU | 20 | 1372 |
| BCL11A-888 | − | UGCCAGAUGAACUUCCCAUU | 20 | 1373 |
| BCL11A-889 | − | GCCAGAUGAACUUCCCAUUG | 20 | 1374 |
| BCL11A-890 | − | GGGGGACAUUCUUAUUUUUA | 20 | 1375 |
| BCL11A-891 | − | CUUAUUUUUAUCGAGCACAA | 20 | 1376 |
| BCL11A-892 | − | UUAUUUUUAUCGAGCACAAA | 20 | 1377 |
| BCL11A-893 | − | AUGCAAUGGCAGCCUCUGCU | 20 | 1378 |
| BCL11A-894 | − | GCCUCUGCUUAGAAAAGCU | 20 | 1379 |
| BCL11A-895 | − | GCCACCUUCCCCUUCACCAA | 20 | 1380 |
| BCL11A-896 | − | CUUCCCCUUCACCAAUCGAG | 20 | 1381 |
| BCL11A-897 | − | UGAAAAAGCAUCCAAUCCC | 20 | 1382 |
| BCL11A-898 | − | GAAAAAGCAUCCAAUCCCG | 20 | 1383 |
| BCL11A-899 | − | GGUUGGCAUCCAGGUCACGC | 20 | 1384 |
| BCL11A-900 | − | UUGGCAUCCAGGUCACGCCA | 20 | 1385 |
| BCL11A-901 | − | GAUUGUUUAUCAACGUCAUC | 20 | 1386 |
| BCL11A-902 | − | UUGUUUAUCAACGUCAUCUA | 20 | 1387 |
| BCL11A-903 | − | UGUUUAUCAACGUCAUCUAG | 20 | 1388 |
| BCL11A-904 | − | CUAGAGGAAUUUGCCCCAAA | 20 | 1389 |
| BCL11A-905 | − | UAGAGGAAUUUGCCCCAAAC | 20 | 1390 |
| BCL11A-906 | − | AGCCAUUCUUACAGAUG | 17 | 1391 |

TABLE 2E-continued

S. aureus gRNA targets for BCL11A knockout

| gRNA Name | DNA Strand | Targeting Domain | Target Site Length | SEQ ID NO |
|---|---|---|---|---|
| BCL11A-907 | − | AACCAGACCACGGCCCG | 17 | 1392 |
| BCL11A-908 | − | ACCAGACCACGGCCCGU | 17 | 1393 |
| BCL11A-909 | − | CCAGACCACGGCCCGUU | 17 | 1394 |
| BCL11A-910 | − | CGGCCCGUUGGGAGCUC | 17 | 1395 |
| BCL11A-911 | − | CCCGUUGGGAGCUCCAG | 17 | 1396 |
| BCL11A-912 | − | CCGUUGGGAGCUCCAGA | 17 | 1397 |
| BCL11A-913 | − | CGUUGGGAGCUCCAGAA | 17 | 1398 |
| BCL11A-914 | − | UCAUGACCUCCUCACCU | 17 | 1399 |
| BCL11A-915 | − | CCUGUGGGCAGUGCCAG | 17 | 1400 |
| BCL11A-916 | − | GCCAGAUGAACUUCCCA | 17 | 1401 |
| BCL11A-917 | − | CCAGAUGAACUUCCCAU | 17 | 1402 |
| BCL11A-918 | − | CAGAUGAACUUCCCAUU | 17 | 1403 |
| BCL11A-919 | − | AGAUGAACUUCCCAUUG | 17 | 1404 |
| BCL11A-920 | − | GGACAUUCUUAUUUUUA | 17 | 1405 |
| BCL11A-921 | − | AUUUUUAUCGAGCACAA | 17 | 1406 |
| BCL11A-922 | − | UUUUUAUCGAGCACAAA | 17 | 1407 |
| BCL11A-923 | − | CAAUGGCAGCCUCUGCU | 17 | 1408 |
| BCL11A-924 | − | UCUGCUUAGAAAAAGCU | 17 | 1409 |
| BCL11A-925 | − | ACCUUCCCCUUCACCAA | 17 | 1410 |
| BCL11A-926 | − | CCCCUUCACCAAUCGAG | 17 | 1411 |
| BCL11A-927 | − | AAAAAGCAUCCAAUCCC | 17 | 1412 |
| BCL11A-928 | − | AAAAGCAUCCAAUCCCG | 17 | 1413 |
| BCL11A-929 | − | UGGCAUCCAGGUCACGC | 17 | 1414 |
| BCL11A-930 | − | GCAUCCAGGUCACGCCA | 17 | 1415 |
| BCL11A-931 | − | UGUUUAUCAACGUCAUC | 17 | 1416 |
| BCL11A-932 | − | UUUAUCAACGUCAUCUA | 17 | 1417 |
| BCL11A-933 | − | UUAUCAACGUCAUCUAG | 17 | 1418 |
| BCL11A-934 | − | GAGGAAUUUGCCCCAAA | 17 | 1419 |
| BCL11A-935 | − | AGGAAUUUGCCCCAAAC | 17 | 1420 |
| BCL11A-936 | + | UCAUCGUAAGAAUGGCUUC | 20 | 1421 |
| BCL11A-937 | + | UGGUCUGGUUCAUCAUCUGU | 20 | 1422 |
| BCL11A-938 | + | AUCCCCUUCUGGAGCUCCCA | 20 | 1423 |
| BCL11A-939 | + | AGGAGGUCAUGAUCCCCUUC | 20 | 1424 |
| BCL11A-940 | + | GAGGAGGUCAUGAUCCCCUU | 20 | 1425 |
| BCL11A-941 | + | UCUGGCACUGCCCACAGGUG | 20 | 1426 |
| BCL11A-942 | + | AUCUGGCACUGCCCACAGGU | 20 | 1427 |
| BCL11A-943 | + | UCAUCUGGCACUGCCCACAG | 20 | 1428 |
| BCL11A-944 | + | AAAUAAGAAUGUCCCCCAAU | 20 | 1429 |
| BCL11A-945 | + | AAAAUAAGAAUGUCCCCCAA | 20 | 1430 |
| BCL11A-946 | + | AAAAAUAAGAAUGUCCCCCA | 20 | 1431 |
| BCL11A-947 | + | CGUUUGUGCUCGAUAAAAAU | 20 | 1432 |
| BCL11A-948 | + | UAUCCACAGCUUUUUCUAAG | 20 | 1433 |
| BCL11A-949 | + | UUUCAUCUCGAUUGGUGAAG | 20 | 1434 |
| BCL11A-950 | + | UUUUCAUCUCGAUUGGUGAA | 20 | 1435 |
| BCL11A-951 | + | UUUUUCAUCUCGAUUGGUGA | 20 | 1436 |
| BCL11A-952 | + | UUUUUUCAUCUCGAUUGGUG | 20 | 1437 |
| BCL11A-953 | + | UGCUUUUUCAUCUCGAUUG | 20 | 1438 |
| BCL11A-954 | + | GGAUGCCAACCUCCACGGGA | 20 | 1439 |
| BCL11A-955 | + | GACCUGGAUGCCAACCUCCA | 20 | 1440 |
| BCL11A-956 | + | UGACCUGGAUGCCAACCUCC | 20 | 1441 |
| BCL11A-957 | + | UCGUCAUCCUCUGGCGUGAC | 20 | 1442 |
| BCL11A-958 | + | CUGCUAUGUGUUCCUGUUUG | 20 | 1443 |
| BCL11A-959 | + | CUGCUAUGUGUUCCUGUUUG | 20 | 1444 |
| BCL11A-960 | + | UCUGUAAGAAUGGCUUC | 17 | 1445 |
| BCL11A-961 | + | UCUGGUUCAUCAUCUGU | 17 | 1446 |
| BCL11A-962 | + | CCCUUCUGGAGCUCCCA | 17 | 1447 |
| BCL11A-963 | + | AGGUCAUGAUCCCCUUC | 17 | 1448 |
| BCL11A-964 | + | GAGGUCAUGAUCCCCUU | 17 | 1449 |
| BCL11A-965 | + | GGCACUGCCCACAGGUG | 17 | 1450 |
| BCL11A-966 | + | UGGCACUGCCCACAGGU | 17 | 1451 |
| BCL11A-967 | + | UCUGGCACUGCCCACAG | 17 | 1452 |
| BCL11A-968 | + | UAAGAAUGUCCCCCAAU | 17 | 1453 |
| BCL11A-969 | + | AUAAGAAUGUCCCCCAA | 17 | 1454 |
| BCL11A-970 | + | AAUAAGAAUGUCCCCCA | 17 | 1455 |
| BCL11A-971 | + | UUGUGCUCGAUAAAAAU | 17 | 1456 |
| BCL11A-972 | + | CCACAGCUUUUUCUAAG | 17 | 1457 |
| BCL11A-973 | + | CAUCUCGAUUGGUGAAG | 17 | 1458 |
| BCL11A-974 | + | UCAUCUCGAUUGGUGAA | 17 | 1459 |
| BCL11A-975 | + | UUCAUCUCGAUUGGUGA | 17 | 1460 |
| BCL11A-976 | + | UUUCAUCUCGAUUGGUG | 17 | 1461 |
| BCL11A-977 | + | UUUUUCAUCUCGAUUG | 17 | 1462 |
| BCL11A-978 | + | UGCCAACCUCCACGGGA | 17 | 1463 |
| BCL11A-979 | + | CUGGAUGCCAACCUCCA | 17 | 1464 |
| BCL11A-980 | + | CCUGGAUGCCAACCUCC | 17 | 1465 |

TABLE 2E-continued

S. aureus gRNA targets for BCL11A knockout

| gRNA Name | DNA Strand | Targeting Domain | Target Site Length | SEQ ID NO |
|---|---|---|---|---|
| BCL11A-981 | + | UCAUCCUCUGGCGUGAC | 17 | 1466 |
| BCL11A-982 | + | UGCUAUGUGUUCCUGUU | 17 | 1467 |
| BCL11A-983 | + | CUGCUAUGUGUUCCUGU | 17 | 1468 |
| BCL11A-984 | - | CUCCUCCCCUCGUUCUGCAC | 20 | 1469 |
| BCL11A-985 | - | UCCUCCCCUCGUUCUGCACA | 20 | 1470 |
| BCL11A-986 | - | UGGAGCUCUAAUCCCCACGC | 20 | 1471 |
| BCL11A-987 | - | GGAGCUCUAAUCCCCACGCC | 20 | 1472 |
| BCL11A-988 | - | CUCUAAUCCCCACGCCUGGG | 20 | 1473 |
| BCL11A-989 | - | CCCCACGCCUGGGAUGAGUG | 20 | 1474 |
| BCL11A-990 | - | UGAGUGCAGAAUAUGCCCCG | 20 | 1475 |
| BCL11A-991 | - | CUCCCCUCGUUCUGCAC | 17 | 1476 |
| BCL11A-992 | - | UCCCCUCGUUCUGCACA | 17 | 1477 |
| BCL11A-993 | - | AGCUCUAAUCCCCACGC | 17 | 1478 |
| BCL11A-994 | - | GCUCUAAUCCCCACGCC | 17 | 1479 |
| BCL11A-995 | - | UAAUCCCCACGCCUGGG | 17 | 1480 |
| BCL11A-996 | - | CACGCCUGGGAUGAGUG | 17 | 1481 |
| BCL11A-997 | - | GUGCAGAAUAUGCCCCG | 17 | 1482 |
| BCL11A-998 | + | GAGGAGAGGCCCCUCCAGUG | 20 | 1483 |
| BCL11A-999 | + | CAUGUGCAGAACGAGGGGAG | 20 | 1484 |
| BCL11A-1000 | + | UCCAUGUGCAGAACGAGGGG | 20 | 1485 |
| BCL11A-1001 | + | CUCCAUGUGCAGAACGAGGG | 20 | 1486 |
| BCL11A-1002 | + | AGCUCCAUGUGCAGAACGAG | 20 | 1487 |
| BCL11A-1003 | + | GAGCUCCAUGUGCAGAACGA | 20 | 1488 |
| BCL11A-1004 | + | AGAGCUCCAUGUGCAGAACG | 20 | 1489 |
| BCL11A-1005 | + | UAGAGCUCCAUGUGCAGAAC | 20 | 1490 |
| BCL11A-1006 | + | AUUAGAGCUCCAUGUGCAGA | 20 | 1491 |
| BCL11A-1007 | + | GGGGAUUAGAGCUCCAUGUG | 20 | 1492 |
| BCL11A-1008 | + | CUCAUCCCAGGCGUGGGGAU | 20 | 1493 |
| BCL11A-1009 | + | UCUGCACUCAUCCCAGGCGU | 20 | 1494 |
| BCL11A-1010 | + | UUCUGCACUCAUCCCAGGCG | 20 | 1495 |
| BCL11A-1011 | + | AUUCUGCACUCAUCCCAGGC | 20 | 1496 |
| BCL11A-1012 | + | GAGAGGCCCCUCCAGUG | 17 | 1497 |
| BCL11A-1013 | + | GUGCAGAACGAGGGGAG | 17 | 1498 |
| BCL11A-1014 | + | AUGUGCAGAACGAGGGG | 17 | 1499 |
| BCL11A-1015 | + | CAUGUGCAGAACGAGGG | 17 | 1500 |
| BCL11A-1016 | + | UCCAUGUGCAGAACGAG | 17 | 1501 |
| BCL11A-1017 | + | CUCCAUGUGCAGAACGA | 17 | 1502 |
| BCL11A-1018 | + | GCUCCAUGUGCAGAACG | 17 | 1503 |
| BCL11A-1019 | + | AGCUCCAUGUGCAGAAC | 17 | 1504 |
| BCL11A-1020 | + | AGAGCUCCAUGUGCAGA | 17 | 1505 |
| BCL11A-1021 | + | GAUUAGAGCUCCAUGUG | 17 | 1506 |
| BCL11A-1022 | + | AUCCCAGGCGUGGGGAU | 17 | 1507 |
| BCL11A-1023 | + | GCACUCAUCCCAGGCGU | 17 | 1508 |
| BCL11A-1024 | + | UGCACUCAUCCCAGGCG | 17 | 1509 |
| BCL11A-1025 | + | CUGCACUCAUCCCAGGC | 17 | 1510 |
| BCL11A-1026 | - | GGUUUCUCUUGCAACACGCA | 20 | 1511 |
| BCL11A-1027 | - | GCAACACGCACAGAACACUC | 20 | 1512 |
| BCL11A-1028 | - | GCACAGAACACUCAUGGAUU | 20 | 1513 |
| BCL11A-1029 | - | UCAUGGAUUAAGAAUCUACU | 20 | 1514 |
| BCL11A-1030 | - | AUUAAGAAUCUACUUAGAAA | 20 | 1515 |
| BCL11A-1031 | - | AAUCUACUUAGAAAGCGAAC | 20 | 1516 |
| BCL11A-1032 | - | AUCUACUUAGAAAGCGAACA | 20 | 1517 |
| BCL11A-1033 | - | CACGGAAGUCCCCUGACCCC | 20 | 1518 |
| BCL11A-1034 | - | CCCGCGGGUUGGUAUCCCUU | 20 | 1519 |
| BCL11A-1035 | - | UAUCCCUUCAGGACUAGGUG | 20 | 1520 |
| BCL11A-1036 | - | UCCUUCCCAGCCACCUCUCC | 20 | 1521 |
| BCL11A-1037 | - | CCUUCCCAGCCACCUCUCCA | 20 | 1522 |
| BCL11A-1038 | - | AAUAACCCCUUUAACCUGCU | 20 | 1523 |
| BCL11A-1039 | - | CUUUAACCUGCUAAGAAUAC | 20 | 1524 |
| BCL11A-1040 | - | UAAGAAUACCAGGAUCAGUA | 20 | 1525 |
| BCL11A-1041 | - | AGAAUACCAGGAUCAGUAUC | 20 | 1526 |
| BCL11A-1042 | - | AAUACCAGGAUCAGUAUCGA | 20 | 1527 |
| BCL11A-1043 | - | GAGAGAGGCUUCCGGCCUGG | 20 | 1528 |
| BCL11A-1044 | - | AGAGGCUUCCGGCCUGGCAG | 20 | 1529 |
| BCL11A-1045 | - | CCCCCCUGUUUAGUCCACCA | 20 | 1530 |
| BCL11A-1046 | - | GUCCACCACCGAGACAUCAC | 20 | 1531 |
| BCL11A-1047 | - | UCACUGGACCCCCACCGCA | 20 | 1532 |
| BCL11A-1048 | - | ACCCCCACCGCAUAGAGCGC | 20 | 1533 |
| BCL11A-1049 | - | CCCCCACCGCAUAGAGCGCC | 20 | 1534 |
| BCL11A-1050 | - | CCCCACCGCAUAGAGCGCCU | 20 | 1535 |
| BCL11A-1051 | - | ACCGCAUAGAGCGCCUGGGG | 20 | 1536 |
| BCL11A-1052 | - | CCGCAUAGAGCGCCUGGGGG | 20 | 1537 |
| BCL11A-1053 | - | CAUAGAGCGCCUGGGGGCGG | 20 | 1538 |
| BCL11A-1054 | - | UGGCCCUGGCCACCCAUCAC | 20 | 1539 |

TABLE 2E-continued

S. aureus gRNA targets for BCL11A knockout

| gRNA Name | DNA Strand | Targeting Domain | Target Site Length | SEQ ID NO |
|---|---|---|---|---|
| BCL11A-1055 | - | CAUCACCCGAGUGCCUUUGA | 20 | 1540 |
| BCL11A-1056 | - | CCUUUGACAGGGUGCUGCGG | 20 | 1541 |
| BCL11A-1057 | - | UGCGGUUGAAUCCAAUGGCU | 20 | 1542 |
| BCL11A-1058 | - | GCGGUUGAAUCCAAUGGCUA | 20 | 1543 |
| BCL11A-1059 | - | UGGCUAUGGAGCCUCCCGCC | 20 | 1544 |
| BCL11A-1060 | - | CCUCCCGCCAUGGAUUUCUC | 20 | 1545 |
| BCL11A-1061 | - | CUCCCGCCAUGGAUUUCUCU | 20 | 1546 |
| BCL11A-1062 | - | AUGGAUUUCUCUAGGAGACU | 20 | 1547 |
| BCL11A-1063 | - | GGAUUUCUCUAGGAGACUUA | 20 | 1548 |
| BCL11A-1064 | - | UAGGAGACUUAGAGAGCUGG | 20 | 1549 |
| BCL11A-1065 | - | AGGAGACUUAGAGAGCUGGC | 20 | 1550 |
| BCL11A-1066 | - | GGAGACUUAGAGAGCUGGCA | 20 | 1551 |
| BCL11A-1067 | - | CCCGGUCAAGUCCAAGUCAU | 20 | 1552 |
| BCL11A-1068 | - | GCGGCAAGACGUUCAAAUUU | 20 | 1553 |
| BCL11A-1069 | - | UGGUGCACCGGCGCAGCCAC | 20 | 1554 |
| BCL11A-1070 | - | GCACCGGCGCAGCCACACGG | 20 | 1555 |
| BCL11A-1071 | - | ACCGGCGCAGCCACACGGC | 20 | 1556 |
| BCL11A-1072 | - | CGUGCACCCAGGCCAGCAAG | 20 | 1557 |
| BCL11A-1073 | - | CCAGCAAGCUGAAGCGCCAC | 20 | 1558 |
| BCL11A-1074 | - | GUCUCUCCACCGCCAGCUCC | 20 | 1559 |
| BCL11A-1075 | - | UCUCUCCACCGCCAGCUCCC | 20 | 1560 |
| BCL11A-1076 | - | AACCCGGCACCAGCGACUUG | 20 | 1561 |
| BCL11A-1077 | - | AGUCCGUGGUGGCCAAGUUC | 20 | 1562 |
| BCL11A-1078 | - | CGUGGUGGCCAAGUUCAAGA | 20 | 1563 |
| BCL11A-1079 | - | UGGUGGCCAAGUUCAAGAGC | 20 | 1564 |
| BCL11A-1080 | - | AGAACGACCCCAACCUGAUC | 20 | 1565 |
| BCL11A-1081 | - | GAACGACCCCAACCUGAUCC | 20 | 1566 |
| BCL11A-1082 | - | ACGACCCCAACCUGAUCCCG | 20 | 1567 |
| BCL11A-1083 | - | CCCCAACCUGAUCCCGGAGA | 20 | 1568 |
| BCL11A-1084 | - | CCCAACCUGAUCCCGGAGAA | 20 | 1569 |
| BCL11A-1085 | - | CCAACCUGAUCCCGGAGAAC | 20 | 1570 |
| BCL11A-1086 | - | CCUGAUCCCGGAGAACGGGG | 20 | 1571 |
| BCL11A-1087 | - | UGAUCCCGGAGAACGGGGAC | 20 | 1572 |
| BCL11A-1088 | - | GAUCCCGGAGAACGGGGACG | 20 | 1573 |
| BCL11A-1089 | - | UCCCGGAGAACGGGGACGAG | 20 | 1574 |
| BCL11A-1090 | - | CCCGGAGAACGGGGACGAGG | 20 | 1575 |
| BCL11A-1091 | - | GGAGAACGGGGACGAGGAGG | 20 | 1576 |
| BCL11A-1092 | - | AGAACGGGGACGAGGAGGAA | 20 | 1577 |
| BCL11A-1093 | - | GAACGGGGACGAGGAGGAAG | 20 | 1578 |
| BCL11A-1094 | - | ACGGGGACGAGGAGGAAGAG | 20 | 1579 |
| BCL11A-1095 | - | CGAGGAGGAAGAGGAGGACG | 20 | 1580 |
| BCL11A-1096 | - | AGGAGGAAGAGGAGGACGAC | 20 | 1581 |
| BCL11A-1097 | - | GGAGGAAGAGGAGGACGACG | 20 | 1582 |
| BCL11A-1098 | - | GGAAGAGGAGGACGACGAGG | 20 | 1583 |
| BCL11A-1099 | - | AAGAGGAGGACGACGAGGAA | 20 | 1584 |
| BCL11A-1100 | - | AGAGGAGGACGACGAGGAAG | 20 | 1585 |
| BCL11A-1101 | - | GGGGACGACGAGGAAGAGG | 20 | 1586 |
| BCL11A-1102 | - | GGACGACGAGGAAGAGGAAG | 20 | 1587 |
| BCL11A-1103 | - | ACGACGAGGAAGAGGAAGAA | 20 | 1588 |
| BCL11A-1104 | - | CGACGAGGAAGAGGAAGAAG | 20 | 1589 |
| BCL11A-1105 | - | ACGAGGAAGAGGAAGAAGAG | 20 | 1590 |
| BCL11A-1106 | - | CGAGGAAGAGGAAGAAGAGG | 20 | 1591 |
| BCL11A-1107 | - | GGAAGAGGAAGAAGAGGAGG | 20 | 1592 |
| BCL11A-1108 | - | AAGAGGAAGAAGAGGAGGAA | 20 | 1593 |
| BCL11A-1109 | - | AGAGGAAGAAGAGGAGGAAG | 20 | 1594 |
| BCL11A-1110 | - | AGGAAGAAGAGGAGGAAGAG | 20 | 1595 |
| BCL11A-1111 | - | GGAAGAAGAGGAGGAAGAGG | 20 | 1596 |
| BCL11A-1112 | - | AAGAAGAGGAGGAAGAGGAG | 20 | 1597 |
| BCL11A-1113 | - | AGAAGAGGAGGAAGAGGAGG | 20 | 1598 |
| BCL11A-1114 | - | AAGAGGAGGAAGAGGAGGAG | 20 | 1599 |
| BCL11A-1115 | - | AGAGGAGGAAGAGGAGGAGG | 20 | 1600 |
| BCL11A-1116 | - | AAGAGGAGGAGGAGGAGCUG | 20 | 1601 |
| BCL11A-1117 | - | AGAGGAGGAGGAGGAGCUGA | 20 | 1602 |
| BCL11A-1118 | - | AGGAGGAGGAGGAGCUGACG | 20 | 1603 |
| BCL11A-1119 | - | GGAGGAGGAGCUGACGGAGA | 20 | 1604 |
| BCL11A-1120 | - | AGGAGGAGCUGACGGAGAGC | 20 | 1605 |
| BCL11A-1121 | - | GAGGAGCUGACGGAGAGCGA | 20 | 1606 |
| BCL11A-1122 | - | AGCUGACGGAGAGCGAGAGG | 20 | 1607 |
| BCL11A-1123 | - | CGAGAGGUGGACUACGGCU | 20 | 1608 |
| BCL11A-1124 | - | GGGUGGACUACGGCUUCGGG | 20 | 1609 |
| BCL11A-1125 | - | ACUACGGCUUCGGGCUGAGC | 20 | 1610 |
| BCL11A-1126 | - | CUACGGCUUCGGGCUGAGCC | 20 | 1611 |
| BCL11A-1127 | - | CCUGGAGGCGGCGCGCCACC | 20 | 1612 |
| BCL11A-1128 | - | UGGAGGCGGCGCGCCACCAC | 20 | 1613 |

TABLE 2E-continued

S. aureus gRNA targets for BCL11A knockout

| gRNA Name | DNA Strand | Targeting Domain | Target Site Length | SEQ ID NO |
|---|---|---|---|---|
| BCL11A-1129 | - | CGCCACCACGAGAACAGCUC | 20 | 1614 |
| BCL11A-1130 | - | GCCACCACGAGAACAGCUCG | 20 | 1615 |
| BCL11A-1131 | - | ACAGCUCGCGGGGCGCGGUC | 20 | 1616 |
| BCL11A-1132 | - | CGCGGGGCGCGGUCGUGGGC | 20 | 1617 |
| BCL11A-1133 | - | CGCGGUCGUGGGCGUGGGCG | 20 | 1618 |
| BCL11A-1134 | - | CGGUCGUGGGCGUGGGCGAC | 20 | 1619 |
| BCL11A-1135 | - | GCGCCCUGCCCGACGUCAUG | 20 | 1620 |
| BCL11A-1136 | - | CAGCUCCAUGCAGCACUUCA | 20 | 1621 |
| BCL11A-1137 | - | GCGAGGCCUUCCACCAGGUC | 20 | 1622 |
| BCL11A-1138 | - | GGCCUUCCACCAGGUCCUGG | 20 | 1623 |
| BCL11A-1139 | - | CCUUCCACCAGGUCCUGGGC | 20 | 1624 |
| BCL11A-1140 | - | GCAUAAGCGCGGCCACCUGG | 20 | 1625 |
| BCL11A-1141 | - | GCGCGGCCACCUGGCCGAGG | 20 | 1626 |
| BCL11A-1142 | - | GCGGCCACCUGGCCGAGGCC | 20 | 1627 |
| BCL11A-1143 | - | CUGGCCGAGGCCGAGGGCCA | 20 | 1628 |
| BCL11A-1144 | - | UGGCCGAGGCCGAGGGCCAC | 20 | 1629 |
| BCL11A-1145 | - | GGGCCACAGGGACACUUGCG | 20 | 1630 |
| BCL11A-1146 | - | CGACGAAGACUCGGUGGCCG | 20 | 1631 |
| BCL11A-1147 | - | AAGACUCGGUGGCCGGCGAG | 20 | 1632 |
| BCL11A-1148 | - | UUAAUGGCCGCGGCUGCUCC | 20 | 1633 |
| BCL11A-1149 | - | UGGCCGCGGCUGCUCCCCGG | 20 | 1634 |
| BCL11A-1150 | - | GCUCCCCGGGCGAGUCGGCC | 20 | 1635 |
| BCL11A-1151 | - | CUCCCCGGGCGAGUCGGCCU | 20 | 1636 |
| BCL11A-1152 | - | UCCCCGGGCGAGUCGGCCUC | 20 | 1637 |
| BCL11A-1153 | - | CCCCGGGCGAGUCGGCCUCG | 20 | 1638 |
| BCL11A-1154 | - | GCCUGUCCAAAAAGCUGCUG | 20 | 1639 |
| BCL11A-1155 | - | UGCUGGGCAGCCCCAGCUCG | 20 | 1640 |
| BCL11A-1156 | - | CUUCUCUAAGCGCAUCAAGC | 20 | 1641 |
| BCL11A-1157 | - | UCUCUAAGCGCAUCAAGCUC | 20 | 1642 |
| BCL11A-1158 | - | CUAAGCGCAUCAAGCUCGAG | 20 | 1643 |
| BCL11A-1159 | - | UAAGCGCAUCAAGCUCGAGA | 20 | 1644 |
| BCL11A-1160 | - | CCCCGGCCGCGAUGCCCAAC | 20 | 1645 |
| BCL11A-1161 | - | CCCGGCCGCGAUGCCCAACA | 20 | 1646 |
| BCL11A-1162 | - | CGGCCGCGAUGCCCAACACG | 20 | 1647 |
| BCL11A-1163 | - | CAAAGAUCCCUUCCUUAGCU | 20 | 1648 |
| BCL11A-1164 | - | AAAGAUCCCUUCCUUAGCUU | 20 | 1649 |
| BCL11A-1165 | - | AAUCGCCUUUUGCCUCCUCG | 20 | 1650 |
| BCL11A-1166 | - | AUCGCCUUUUGCCUCCUCGU | 20 | 1651 |
| BCL11A-1167 | - | CCUCCUCGUCGGAGCACUCC | 20 | 1652 |
| BCL11A-1168 | - | CUCCUCGUCGGAGCACUCCU | 20 | 1653 |
| BCL11A-1169 | - | CCUCGUCGGAGCACUCCUCG | 20 | 1654 |
| BCL11A-1170 | - | GUCGGAGCACUCCUCGGAGA | 20 | 1655 |
| BCL11A-1171 | - | UCGGAGCACUCCUCGGAGAA | 20 | 1656 |
| BCL11A-1172 | - | CGGAGCACUCCUCGGAGAAC | 20 | 1657 |
| BCL11A-1173 | - | UUUGCGCUUCUCCACACCGC | 20 | 1658 |
| BCL11A-1174 | - | UUGCGCUUCUCCACACCGCC | 20 | 1659 |
| BCL11A-1175 | - | UGCGCUUCUCCACACCGCCC | 20 | 1660 |
| BCL11A-1176 | - | GCGCUUCUCCACACCGCCCG | 20 | 1661 |
| BCL11A-1177 | - | UCUCCACACCGCCCGGGGAG | 20 | 1662 |
| BCL11A-1178 | - | CACACCGCCCGGGGAGCUGG | 20 | 1663 |
| BCL11A-1179 | - | ACACCGCCCGGGGAGCUGGA | 20 | 1664 |
| BCL11A-1180 | - | ACCGCCCGGGGAGCUGGACG | 20 | 1665 |
| BCL11A-1181 | - | CCGCCCGGGGAGCUGGACGG | 20 | 1666 |
| BCL11A-1182 | - | GGGAGCUGGACGGAGGGAUC | 20 | 1667 |
| BCL11A-1183 | - | GGAGCUGGACGGAGGGAUCU | 20 | 1668 |
| BCL11A-1184 | - | GGAUCUCGGGGCGCAGCGGC | 20 | 1669 |
| BCL11A-1185 | - | GAUCUCGGGGCGCAGCGGCA | 20 | 1670 |
| BCL11A-1186 | - | AUCUCGGGGCGCAGCGGCAC | 20 | 1671 |
| BCL11A-1187 | - | GGGGCGCAGCGGCACGGGAA | 20 | 1672 |
| BCL11A-1188 | - | GGGCGCAGCGGCACGGGAAG | 20 | 1673 |
| BCL11A-1189 | - | GCGCAGCGGCACGGGAAGUG | 20 | 1674 |
| BCL11A-1190 | - | CGCAGCGGCACGGGAAGUGG | 20 | 1675 |
| BCL11A-1191 | - | GCAGCGGCACGGGAAGUGGA | 20 | 1676 |
| BCL11A-1192 | - | GCACGCCCCAUAUUAGUGGU | 20 | 1677 |
| BCL11A-1193 | - | CCCAUAUUAGUGGUCCGGGC | 20 | 1678 |
| BCL11A-1194 | - | CCCGGGCAGGCCCAGCUCAA | 20 | 1679 |
| BCL11A-1195 | - | CGGGCAGGCCCAGCUCAAAA | 20 | 1680 |
| BCL11A-1196 | - | UUCUCUUGCAACACGCA | 17 | 1681 |
| BCL11A-1197 | - | ACACGCACAGAACACUC | 17 | 1682 |
| BCL11A-1198 | - | CAGAACACUCAUGGAUU | 17 | 1683 |
| BCL11A-1199 | - | UGGAUUAAGAAUCUACU | 17 | 1684 |
| BCL11A-1200 | - | AAGAAUCUACUUAGAAA | 17 | 1685 |
| BCL11A-1201 | - | CUACUUAGAAAGCGAAC | 17 | 1686 |
| BCL11A-1202 | - | UACUUAGAAAGCGAACA | 17 | 1687 |

TABLE 2E-continued

S. aureus gRNA targets for BCL11A knockout

| gRNA Name | DNA Strand | Targeting Domain | Target Site Length | SEQ ID NO |
|---|---|---|---|---|
| BCL11A-1203 | - | GGAAGUCCCCUGACCCC | 17 | 1688 |
| BCL11A-1204 | - | GCGGGUUGGUAUCCCUU | 17 | 1689 |
| BCL11A-1205 | - | CCCUUCAGGACUAGGUG | 17 | 1690 |
| BCL11A-1206 | - | UUCCCAGCCACCUCUCC | 17 | 1691 |
| BCL11A-1207 | - | UCCCAGCCACCUCUCCA | 17 | 1692 |
| BCL11A-1208 | - | AACCCCUUUAACCUGCU | 17 | 1693 |
| BCL11A-1209 | - | UAACCUGCUAAGAAUAC | 17 | 1694 |
| BCL11A-1210 | - | GAAUACCAGGAUCAGUA | 17 | 1695 |
| BCL11A-1211 | - | AUACCAGGAUCAGUAUC | 17 | 1696 |
| BCL11A-1212 | - | ACCAGGAUCAGUAUCGA | 17 | 1697 |
| BCL11A-1213 | - | AGAGGCUUCCGGCCUGG | 17 | 1698 |
| BCL11A-1214 | - | GGCUUCCGGCCUGGCAG | 17 | 1699 |
| BCL11A-1215 | - | CCCUGUUUAGUCCACCA | 17 | 1700 |
| BCL11A-1216 | - | CACCACCGAGACAUCAC | 17 | 1701 |
| BCL11A-1217 | - | CUUGGACCCCCACCGCA | 17 | 1702 |
| BCL11A-1218 | - | CCCACCGCAUAGAGCGC | 17 | 1703 |
| BCL11A-1219 | - | CCACCGCAUAGAGCGCC | 17 | 1704 |
| BCL11A-1220 | - | CACCGCAUAGAGCGCCU | 17 | 1705 |
| BCL11A-1221 | - | GCAUAGAGCGCCUGGGG | 17 | 1706 |
| BCL11A-1222 | - | CAUAGAGCGCCUGGGGG | 17 | 1707 |
| BCL11A-1223 | - | AGAGCGCCUGGGGGCGG | 17 | 1708 |
| BCL11A-1224 | - | CCCUGGCCACCCAUCAC | 17 | 1709 |
| BCL11A-1225 | - | CACCCGAGUGCCUUUGA | 17 | 1710 |
| BCL11A-1226 | - | UUGACAGGGUGCUGCGG | 17 | 1711 |
| BCL11A-1227 | - | GGUUGAAUCCAAUGGCU | 17 | 1712 |
| BCL11A-1228 | - | GUUGAAUCCAAUGGCUA | 17 | 1713 |
| BCL11A-1229 | - | CUAUGGAGCCUCCCGCC | 17 | 1714 |
| BCL11A-1230 | - | CCCGCCAUGGAUUUCUC | 17 | 1715 |
| BCL11A-1231 | - | CCGCCAUGGAUUUCUCU | 17 | 1716 |
| BCL11A-1232 | - | GAUUUCUCUAGGAGACU | 17 | 1717 |
| BCL11A-1233 | - | UUUCUCUAGGAGACUUA | 17 | 1718 |
| BCL11A-1234 | - | GAGACUUAGAGAGCUGG | 17 | 1719 |
| BCL11A-1235 | - | AGACUUAGAGAGCUGGC | 17 | 1720 |
| BCL11A-1236 | - | GACUUAGAGAGCUGGCA | 17 | 1721 |
| BCL11A-1237 | - | GGUCAAGUCCAAGUCAU | 17 | 1722 |
| BCL11A-1238 | - | GCAAGACGUUCAAAUUU | 17 | 1723 |
| BCL11A-1239 | - | UGCACCGGCGCAGCCAC | 17 | 1724 |
| BCL11A-1240 | - | CCGGCGCAGCCACACGG | 17 | 1725 |
| BCL11A-1241 | - | GGCGCAGCCACACGGGC | 17 | 1726 |
| BCL11A-1242 | - | GCACCCAGGCCAGCAAG | 17 | 1727 |
| BCL11A-1243 | - | GCAAGCUGAAGCGCCAC | 17 | 1728 |
| BCL11A-1244 | - | UCUCCACCGCCAGCUCC | 17 | 1729 |
| BCL11A-1245 | - | CUCCACCGCCAGCUCCC | 17 | 1730 |
| BCL11A-1246 | - | CCGGCACCAGCGACUUG | 17 | 1731 |
| BCL11A-1247 | - | CCGUGGUGGCCAAGUUC | 17 | 1732 |
| BCL11A-1248 | - | GGUGGCCAAGUUCAAGA | 17 | 1733 |
| BCL11A-1249 | - | UGGCCAAGUUCAAGAGC | 17 | 1734 |
| BCL11A-1250 | - | ACGACCCCAACCUGAUC | 17 | 1735 |
| BCL11A-1251 | - | CGACCCCAACCUGAUCC | 17 | 1736 |
| BCL11A-1252 | - | ACCCCAACCUGAUCCCG | 17 | 1737 |
| BCL11A-1253 | - | CAACCUGAUCCCGGAGA | 17 | 1738 |
| BCL11A-1254 | - | AACCUGAUCCCGGAGAA | 17 | 1739 |
| BCL11A-1255 | - | ACCUGAUCCCGGAGAAC | 17 | 1740 |
| BCL11A-1256 | - | GAUCCCGGAGAACGGGG | 17 | 1741 |
| BCL11A-1257 | - | UCCCGGAGAACGGGGAC | 17 | 1742 |
| BCL11A-1258 | - | CCCGGAGAACGGGGACG | 17 | 1743 |
| BCL11A-1259 | - | CGGAGAACGGGGACGAG | 17 | 1744 |
| BCL11A-1260 | - | GGAGAACGGGGACGAGG | 17 | 1745 |
| BCL11A-1261 | - | GAACGGGGACGAGGAGG | 17 | 1746 |
| BCL11A-1262 | - | ACGGGGACGAGGAGGAA | 17 | 1747 |
| BCL11A-1263 | - | CGGGGACGAGGAGGAAG | 17 | 1748 |
| BCL11A-1264 | - | GGGACGAGGAGGAAGAG | 17 | 1749 |
| BCL11A-1265 | - | GGAGGAAGAGGAGGACG | 17 | 1750 |
| BCL11A-1266 | - | AGGAAGAGGAGGACGAC | 17 | 1751 |
| BCL11A-1267 | - | GGAAGAGGAGGACGACG | 17 | 1752 |
| BCL11A-1268 | - | AGAGGAGGACGACGAGG | 17 | 1753 |
| BCL11A-1269 | - | AGGAGGACGACGAGGAA | 17 | 1754 |
| BCL11A-1270 | - | GGAGGACGACGAGGAAG | 17 | 1755 |
| BCL11A-1271 | - | GGACGACGAGGAAGAGG | 17 | 1756 |
| BCL11A-1272 | - | CGACGAGGAAGAGGAAG | 17 | 1757 |
| BCL11A-1273 | - | ACGAGGAAGAGGAAGAA | 17 | 1758 |
| BCL11A-1274 | - | CGAGGAAGAGGAAGAAG | 17 | 1759 |
| BCL11A-1275 | - | AGGAAGAGGAAGAAGAG | 17 | 1760 |
| BCL11A-1276 | - | GGAAGAGGAAGAAGAGG | 17 | 1761 |

TABLE 2E-continued

*S. aureus* gRNA targets for BCL11A knockout

| gRNA Name | DNA Strand | Targeting Domain | Target Site Length | SEQ ID NO |
|---|---|---|---|---|
| BCL11A-1277 | - | AGAGGAAGAAGAGGAGG | 17 | 1762 |
| BCL11A-1278 | - | AGGAAGAAGAGGAGGAA | 17 | 1763 |
| BCL11A-1279 | - | GGAAGAAGAGGAGGAAG | 17 | 1764 |
| BCL11A-1280 | - | AAGAAGAGGAGGAAGAG | 17 | 1765 |
| BCL11A-1281 | - | AGAAGAGGAGGAAGAGG | 17 | 1766 |
| BCL11A-1282 | - | AAGAGGAGGAAGAGGAG | 17 | 1767 |
| BCL11A-1283 | - | AGAGGAGGAAGAGGAGG | 17 | 1768 |
| BCL11A-1284 | - | AGGAGGAAGAGGAGGAG | 17 | 1769 |
| BCL11A-1285 | - | GGAGGAAGAGGAGGAGG | 17 | 1770 |
| BCL11A-1286 | - | AGGAGGAGGAGGAGCUG | 17 | 1771 |
| BCL11A-1287 | - | GGAGGAGGAGGAGCUGA | 17 | 1772 |
| BCL11A-1288 | - | AGGAGGAGGAGCUGACG | 17 | 1773 |
| BCL11A-1289 | - | GGAGGAGCUGACGGAGA | 17 | 1774 |
| BCL11A-1290 | - | AGGAGCUGACGGAGAGC | 17 | 1775 |
| BCL11A-1291 | - | GAGCUGACGGAGAGCGA | 17 | 1776 |
| BCL11A-1292 | - | UGACGGAGAGCGAGAGG | 17 | 1777 |
| BCL11A-1293 | - | GAGGGUGGACUACGGCU | 17 | 1778 |
| BCL11A-1294 | - | UGGACUACGGCUUCGGG | 17 | 1779 |
| BCL11A-1295 | - | ACGGCUUCGGGCUGAGC | 17 | 1780 |
| BCL11A-1296 | - | CGGCUUCGGGCUGAGCC | 17 | 1781 |
| BCL11A-1297 | - | GGAGGCGGCGCGCCACC | 17 | 1782 |
| BCL11A-1298 | - | AGGCGGCGCGCCACCAC | 17 | 1783 |
| BCL11A-1299 | - | CACCACGAGAACAGCUC | 17 | 1784 |
| BCL11A-1300 | - | ACCACGAGAACAGCUCG | 17 | 1785 |
| BCL11A-1301 | - | GCUCGCGGGGCGCGGUC | 17 | 1786 |
| BCL11A-1302 | - | GGGGCGCGGUCGUGGGC | 17 | 1787 |
| BCL11A-1303 | - | GGUCGUGGGCGUGGGCG | 17 | 1788 |
| BCL11A-1304 | - | UCGUGGGCGUGGGCGAC | 17 | 1789 |
| BCL11A-1305 | - | CCCUGCCCGACGUCAUG | 17 | 1790 |
| BCL11A-1306 | - | CUCCAUGCAGCACUUCA | 17 | 1791 |
| BCL11A-1307 | - | AGGCCUUCCACCAGGUC | 17 | 1792 |
| BCL11A-1308 | - | CUUCCACCAGGUCCUGG | 17 | 1793 |
| BCL11A-1309 | - | UCCACCAGGUCCUGGGC | 17 | 1794 |
| BCL11A-1310 | - | UAAGCGCGGCCACCUGG | 17 | 1795 |
| BCL11A-1311 | - | CGGCCACCUGGCCGAGG | 17 | 1796 |
| BCL11A-1312 | - | GCCACCUGGCCGAGGCC | 17 | 1797 |
| BCL11A-1313 | - | GCCGAGGCCGAGGGCCA | 17 | 1798 |
| BCL11A-1314 | - | CCGAGGCCGAGGGCCAC | 17 | 1799 |
| BCL11A-1315 | - | CCACAGGGACACUUGCG | 17 | 1800 |
| BCL11A-1316 | - | CGAAGACUCGGUGGCCG | 17 | 1801 |
| BCL11A-1317 | - | ACUCGGUGGCCGGCGAG | 17 | 1802 |
| BCL11A-1318 | - | AUGGCCGCGGCUGCUCC | 17 | 1803 |
| BCL11A-1319 | - | CCGCGGCUGCUCCCCGG | 17 | 1804 |
| BCL11A-1320 | - | CCCCGGGCGAGUCGGCC | 17 | 1805 |
| BCL11A-1321 | - | CCCGGGCGAGUCGGCCU | 17 | 1806 |
| BCL11A-1322 | - | CCGGGCGAGUCGGCCUC | 17 | 1807 |
| BCL11A-1323 | - | CGGGCGAGUCGGCCUCG | 17 | 1808 |
| BCL11A-1324 | - | UGUCCAAAAAGCUGCUG | 17 | 1809 |
| BCL11A-1325 | - | UGGGCAGCCCCAGCUCG | 17 | 1810 |
| BCL11A-1326 | - | CUCUAAGCGCAUCAAGC | 17 | 1811 |
| BCL11A-1327 | - | CUAAGCGCAUCAAGCUC | 17 | 1812 |
| BCL11A-1328 | - | AGCGCAUCAAGCUCGAG | 17 | 1813 |
| BCL11A-1329 | - | GCGCAUCAAGCUCGAGA | 17 | 1814 |
| BCL11A-1330 | - | CGGCCGCGAUGCCCAAC | 17 | 1815 |
| BCL11A-1331 | - | GGCCGCGAUGCCCAACA | 17 | 1816 |
| BCL11A-1332 | - | CCGCGAUGCCCAACACG | 17 | 1817 |
| BCL11A-1333 | - | AGAUCCCUUCCUUAGCU | 17 | 1818 |
| BCL11A-1334 | - | GAUCCCUUCCUUAGCUU | 17 | 1819 |
| BCL11A-1335 | - | CGCCUUUUGCCUCCUCG | 17 | 1820 |
| BCL11A-1336 | - | GCCUUUUGCCUCCUCGU | 17 | 1821 |
| BCL11A-1337 | - | CCUCGUCGGAGCACUCC | 17 | 1822 |
| BCL11A-1338 | - | CUCGUCGGAGCACUCCU | 17 | 1823 |
| BCL11A-1339 | - | CGUCGGAGCACUCCUCG | 17 | 1824 |
| BCL11A-1340 | - | GGAGCACUCCUCGGAGA | 17 | 1825 |
| BCL11A-1341 | - | GAGCACUCCUCGGAGAA | 17 | 1826 |
| BCL11A-1342 | - | AGCACUCCUCGGAGAAC | 17 | 1827 |
| BCL11A-1343 | - | GCGCUUCUCCACACCGC | 17 | 1828 |
| BCL11A-1344 | - | CGCUUCUCCACACCGCC | 17 | 1829 |
| BCL11A-1345 | - | GCUUCUCCACACCGCCC | 17 | 1830 |
| BCL11A-1346 | - | CUUCUCCACACCGCCCG | 17 | 1831 |
| BCL11A-1347 | - | CCACACCGCCCGGGGAG | 17 | 1832 |
| BCL11A-1348 | - | ACCGCCCGGGGAGCUGG | 17 | 1833 |
| BCL11A-1349 | - | CCGCCCGGGGAGCUGGA | 17 | 1834 |
| BCL11A-1350 | - | GCCCGGGGAGCUGGACG | 17 | 1835 |

TABLE 2E-continued

S. aureus gRNA targets for BCL11A knockout

| gRNA Name | DNA Strand | Targeting Domain | Target Site Length | SEQ ID NO |
|---|---|---|---|---|
| BCL11A-1351 | - | CCCGGGGAGCUGGACGG | 17 | 1836 |
| BCL11A-1352 | - | AGCUGGACGGAGGGAUC | 17 | 1837 |
| BCL11A-1353 | - | GCUGGACGGAGGGAUCU | 17 | 1838 |
| BCL11A-1354 | - | UCUCGGGGCGCAGCGGC | 17 | 1839 |
| BCL11A-1355 | - | CUCGGGGCGCAGCGGCA | 17 | 1840 |
| BCL11A-1356 | - | UCGGGGCGCAGCGGCAC | 17 | 1841 |
| BCL11A-1357 | - | GCGCAGCGGCACGGGAA | 17 | 1842 |
| BCL11A-1358 | - | CGCAGCGGCACGGGAAG | 17 | 1843 |
| BCL11A-1359 | - | CAGCGGCACGGGAAGUG | 17 | 1844 |
| BCL11A-1360 | - | AGCGGCACGGGAAGUGG | 17 | 1845 |
| BCL11A-1361 | - | GCGGCACGGGAAGUGGA | 17 | 1846 |
| BCL11A-1362 | - | CGCCCCAUAUUAGUGGU | 17 | 1847 |
| BCL11A-1363 | - | AUAUUAGUGGUCCGGGC | 17 | 1848 |
| BCL11A-1364 | - | GGGCAGGCCCAGCUCAA | 17 | 1849 |
| BCL11A-1365 | - | GCAGGCCCAGCUCAAAA | 17 | 1850 |
| BCL11A-1366 | + | AAGUUGUACAUGUGUAGCUG | 20 | 1851 |
| BCL11A-1367 | + | GCAAGAGAAACCAUGCACUG | 20 | 1852 |
| BCL11A-1368 | + | GUGUUCUGUGCGUGUUGCAA | 20 | 1853 |
| BCL11A-1369 | + | GAGUGUUCUGUGCGUGUUGC | 20 | 1854 |
| BCL11A-1370 | + | UCUAAGUAGAUUCUUAAUCC | 20 | 1855 |
| BCL11A-1371 | + | GAUACCAACCCGCGGGGUCA | 20 | 1856 |
| BCL11A-1372 | + | GGAUACCAACCCGCGGGGUC | 20 | 1857 |
| BCL11A-1373 | + | GGGAUACCAACCCGCGGGGU | 20 | 1858 |
| BCL11A-1374 | + | CCUGAAGGGAUACCAACCCG | 20 | 1859 |
| BCL11A-1375 | + | UCCUGAAGGGAUACCAACCC | 20 | 1860 |
| BCL11A-1376 | + | CAUUCUGCACCUAGUCCUGA | 20 | 1861 |
| BCL11A-1377 | + | ACAUUCUGCACCUAGUCCUG | 20 | 1862 |
| BCL11A-1378 | + | AGGACAUUCUGCACCUAGUC | 20 | 1863 |
| BCL11A-1379 | + | CCCAUGGAGAGGUGGCUGGG | 20 | 1864 |
| BCL11A-1380 | + | AAUCCCAUGGAGAGGUGGCU | 20 | 1865 |
| BCL11A-1381 | + | GAAUCCCAUGGAGAGGUGGC | 20 | 1866 |
| BCL11A-1382 | + | UGAAUCCCAUGGAGAGGUGG | 20 | 1867 |
| BCL11A-1383 | + | UCUGCAAUAUGAAUCCCAUG | 20 | 1868 |
| BCL11A-1384 | + | UGUCUGCAAUAUGAAUCCCA | 20 | 1869 |
| BCL11A-1385 | + | UUGUCUGCAAUAUGAAUCCC | 20 | 1870 |
| BCL11A-1386 | + | AAGGGUUAUUGUCUGCAAU | 20 | 1871 |
| BCL11A-1387 | + | UGGUAUUCUUAGCAGGUUAA | 20 | 1872 |
| BCL11A-1388 | + | CUGGUAUUCUUAGCAGGUUA | 20 | 1873 |
| BCL11A-1389 | + | AAAGCGCCCUUCUGCCAGGC | 20 | 1874 |
| BCL11A-1390 | + | GAAAGCGCCCUUCUGCCAGG | 20 | 1875 |
| BCL11A-1391 | + | CUAAACAGGGGGGAGUGGG | 20 | 1876 |
| BCL11A-1392 | + | ACUAAACAGGGGGGAGUGG | 20 | 1877 |
| BCL11A-1393 | + | GUGGACUAAACAGGGGGGA | 20 | 1878 |
| BCL11A-1394 | + | GGUGGUGGACUAAACAGGGG | 20 | 1879 |
| BCL11A-1395 | + | CGGUGGUGGACUAAACAGGG | 20 | 1880 |
| BCL11A-1396 | + | UCGGUGGUGGACUAAACAGG | 20 | 1881 |
| BCL11A-1397 | + | CUCGGUGGUGGACUAAACAG | 20 | 1882 |
| BCL11A-1398 | + | UCUCGGUGGUGGACUAAACA | 20 | 1883 |
| BCL11A-1399 | + | GUCUCGGUGGUGGACUAAAC | 20 | 1884 |
| BCL11A-1400 | + | UGUCUCGGUGGUGGACUAAA | 20 | 1885 |
| BCL11A-1401 | + | GUCCAAGUGAUGUCUCGGUG | 20 | 1886 |
| BCL11A-1402 | + | CCCCAGGCGCUCUAUGCGGU | 20 | 1887 |
| BCL11A-1403 | + | CCCCCAGGCGCUCUAUGCGG | 20 | 1888 |
| BCL11A-1404 | + | GCCCCAGGCGCUCUAUGCG | 20 | 1889 |
| BCL11A-1405 | + | GCACUCGGGUGAUGGGUGGC | 20 | 1890 |
| BCL11A-1406 | + | CUGUCAAAGGCACUCGGGUG | 20 | 1891 |
| BCL11A-1407 | + | CAGCACCCUGUCAAAGGCAC | 20 | 1892 |
| BCL11A-1408 | + | GGCGGGAGGCUCCAUAGCCA | 20 | 1893 |
| BCL11A-1409 | + | CUCCUAGAGAAAUCCAUGGC | 20 | 1894 |
| BCL11A-1410 | + | UCUCCUAGAGAAAUCCAUGG | 20 | 1895 |
| BCL11A-1411 | + | GUCUCCUAGAGAAAUCCAUG | 20 | 1896 |
| BCL11A-1412 | + | CCAGCUCUCUAAGUCUCCUA | 20 | 1897 |
| BCL11A-1413 | + | UGCCAGCUCUCUAAGUCUCC | 20 | 1898 |
| BCL11A-1414 | + | GGGCCGGCCUGGGGACAGCG | 20 | 1899 |
| BCL11A-1415 | + | GCAUAGGGCUGGGCCGGCCU | 20 | 1900 |
| BCL11A-1416 | + | UGCAUAGGGCUGGGCCGGCC | 20 | 1901 |
| BCL11A-1417 | + | UUGCAUAGGGCUGGGCCGGC | 20 | 1902 |
| BCL11A-1418 | + | GCAGUAACCUUUGCAUAGGG | 20 | 1903 |
| BCL11A-1419 | + | UGGUUGCAGUAACCUUUGCA | 20 | 1904 |
| BCL11A-1420 | + | AGGGCGGCUUGCUACCUGGC | 20 | 1905 |
| BCL11A-1421 | + | AAGGGCGGCUUGCUACCUGG | 20 | 1906 |
| BCL11A-1422 | + | GGAGGGGGGCGUCGCCAGG | 20 | 1907 |
| BCL11A-1423 | + | GAGGGAGGGGGGCGUCGCC | 20 | 1908 |
| BCL11A-1424 | + | GGAGGGAGGGGGGCGUCGC | 20 | 1909 |

TABLE 2E-continued

S. aureus gRNA targets for BCL11A knockout

| gRNA Name | DNA Strand | Targeting Domain | Target Site Length | SEQ ID NO |
|---|---|---|---|---|
| BCL11A-1425 | + | CGGAUUGCAGAGGAGGGAGG | 20 | 1910 |
| BCL11A-1426 | + | GCGGAUUGCAGAGGAGGGAG | 20 | 1911 |
| BCL11A-1427 | + | GGCGGAUUGCAGAGGAGGGA | 20 | 1912 |
| BCL11A-1428 | + | GGGCGGAUUGCAGAGGAGGG | 20 | 1913 |
| BCL11A-1429 | + | GGGGCGGAUUGCAGAGGAGG | 20 | 1914 |
| BCL11A-1430 | + | GAGGGGCGGAUUGCAGAGGA | 20 | 1915 |
| BCL11A-1431 | + | GGAGGGGCGGAUUGCAGAGG | 20 | 1916 |
| BCL11A-1432 | + | AGGAGGGGCGGAUUGCAGAG | 20 | 1917 |
| BCL11A-1433 | + | GGAGGAGGGGCGGAUUGCAG | 20 | 1918 |
| BCL11A-1434 | + | GGGAGGAGGGGCGGAUUGCA | 20 | 1919 |
| BCL11A-1435 | + | GAGGGAGGAGGGGCGGAUUG | 20 | 1920 |
| BCL11A-1436 | + | GGGGCUGGGAGGGAGGAGGG | 20 | 1921 |
| BCL11A-1437 | + | ACCGGGGGCUGGGAGGGAGG | 20 | 1922 |
| BCL11A-1438 | + | GACCGGGGGCUGGGAGGGAG | 20 | 1923 |
| BCL11A-1439 | + | UUGACCGGGGGCUGGGAGGG | 20 | 1924 |
| BCL11A-1440 | + | CUUGACCGGGGGCUGGGAGG | 20 | 1925 |
| BCL11A-1441 | + | GACUUGACCGGGGGCUGGGA | 20 | 1926 |
| BCL11A-1442 | + | GGACUUGACCGGGGGCUGGG | 20 | 1927 |
| BCL11A-1443 | + | UGGACUUGACCGGGGGCUGG | 20 | 1928 |
| BCL11A-1444 | + | CUUGGACUUGACCGGGGGCU | 20 | 1929 |
| BCL11A-1445 | + | ACUUGGACUUGACCGGGGGC | 20 | 1930 |
| BCL11A-1446 | + | GACUUGGACUUGACCGGGGG | 20 | 1931 |
| BCL11A-1447 | + | CGCAUGACUUGGACUUGACC | 20 | 1932 |
| BCL11A-1448 | + | UCGCAUGACUUGGACUUGAC | 20 | 1933 |
| BCL11A-1449 | + | CUCGCAUGACUUGGACUUGA | 20 | 1934 |
| BCL11A-1450 | + | UGCCGCAGAACUCGCAUGAC | 20 | 1935 |
| BCL11A-1451 | + | GAAAUUGAACGUCUUGCCG | 20 | 1936 |
| BCL11A-1452 | + | CCACCAGGUUGCUCUGAAAU | 20 | 1937 |
| BCL11A-1453 | + | CGGUGCACCACCAGGUUGCU | 20 | 1938 |
| BCL11A-1454 | + | GGUCGCACAGGUUGCACUUG | 20 | 1939 |
| BCL11A-1455 | + | UGGCGCUUCAGCUUGCUGGC | 20 | 1940 |
| BCL11A-1456 | + | CGUCGGACUUGACCGUCAUG | 20 | 1941 |
| BCL11A-1457 | + | UCGUCGGACUUGACCGUCAU | 20 | 1942 |
| BCL11A-1458 | + | GUCGUCGGACUUGACCGUCA | 20 | 1943 |
| BCL11A-1459 | + | CGUCGUCGGACUUGACCGUC | 20 | 1944 |
| BCL11A-1460 | + | UGGCGGUGGAGAGACCGUCG | 20 | 1945 |
| BCL11A-1461 | + | GUUCCGGGGAGCUGGCGGUG | 20 | 1946 |
| BCL11A-1462 | + | GGGUUCCGGGGAGCUGGCGG | 20 | 1947 |
| BCL11A-1463 | + | CGGGUUCCGGGGAGCUGGCG | 20 | 1948 |
| BCL11A-1464 | + | GUCGCUGGUGCCGGGUUCCG | 20 | 1949 |
| BCL11A-1465 | + | AGUCGCUGGUGCCGGGUUCC | 20 | 1950 |
| BCL11A-1466 | + | AAGUCGCUGGUGCCGGGUUC | 20 | 1951 |
| BCL11A-1467 | + | CAAGUCGCUGGUGCCGGGUU | 20 | 1952 |
| BCL11A-1468 | + | UGCCCACCAAGUCGCUGGUG | 20 | 1953 |
| BCL11A-1469 | + | UGAACUUGGCCACCACGGAC | 20 | 1954 |
| BCL11A-1470 | + | CGCUCUUGAACUUGGCCACC | 20 | 1955 |
| BCL11A-1471 | + | GGUUGGGGUCGUUCUCGCUC | 20 | 1956 |
| BCL11A-1472 | + | CCCGUUCUCCGGGAUCAGGU | 20 | 1957 |
| BCL11A-1473 | + | CCCCGUUCUCCGGGAUCAGG | 20 | 1958 |
| BCL11A-1474 | + | UCCUCCUCGUCCCCGUUCUC | 20 | 1959 |
| BCL11A-1475 | + | UUCCUCCUCGUCCCCGUUCU | 20 | 1960 |
| BCL11A-1476 | + | GCGCCGCCUCCAGGCUCAGC | 20 | 1961 |
| BCL11A-1477 | + | CACGCCCACGACCGCGCCCC | 20 | 1962 |
| BCL11A-1478 | + | AUGCCCUGCAUGACGUCGGG | 20 | 1963 |
| BCL11A-1479 | + | GCACCAUGCCCUGCAUGACG | 20 | 1964 |
| BCL11A-1480 | + | CGCUGAAGUGCUGCAUGGAG | 20 | 1965 |
| BCL11A-1481 | + | GGCCUCGCUGAAGUGCUGCA | 20 | 1966 |
| BCL11A-1482 | + | AGGCCUCGCUGAAGUGCUGC | 20 | 1967 |
| BCL11A-1483 | + | GGACCUGGUGGAAGGCCUCG | 20 | 1968 |
| BCL11A-1484 | + | GCUUCUCGCCCAGGACCUGG | 20 | 1969 |
| BCL11A-1485 | + | UGCUUCUCGCCCAGGACCUG | 20 | 1970 |
| BCL11A-1486 | + | CCGCGCUUAUGCUUCUCGCC | 20 | 1971 |
| BCL11A-1487 | + | GCGGUCCGACUCGCCGGCCA | 20 | 1972 |
| BCL11A-1488 | + | CCCCGAGGCCGACUCGCCCG | 20 | 1973 |
| BCL11A-1489 | + | CCCCCGAGGCCGACUCGCCC | 20 | 1974 |
| BCL11A-1490 | + | CCCCCCGAGGCCGACUCGCC | 20 | 1975 |
| BCL11A-1491 | + | GCCCCCCGAGGCCGACUCGC | 20 | 1976 |
| BCL11A-1492 | + | CAGCUUUUUGGACAGGCCCC | 20 | 1977 |
| BCL11A-1493 | + | GGCUGCCCAGCAGCAGCUUU | 20 | 1978 |
| BCL11A-1494 | + | AGAGAAGGGGCUCAGCGAGC | 20 | 1979 |
| BCL11A-1495 | + | UAGAGAAGGGGCUCAGCGAG | 20 | 1980 |
| BCL11A-1496 | + | GCGCUUAGAGAAGGGGCUCA | 20 | 1981 |
| BCL11A-1497 | + | GAGCUUGAUGCGCUUAGAGA | 20 | 1982 |
| BCL11A-1498 | + | CGAGCUUGAUGCGCUUAGAG | 20 | 1983 |

TABLE 2E-continued

S. aureus gRNA targets for BCL11A knockout

| gRNA Name | DNA Strand | Targeting Domain | Target Site Length | SEQ ID NO |
|---|---|---|---|---|
| BCL11A-1499 | + | UCUCGAGCUUGAUGCGCUUA | 20 | 1984 |
| BCL11A-1500 | + | CUUCUCGAGCUUGAUGCGCU | 20 | 1985 |
| BCL11A-1501 | + | GGGGCAGGUCGAACUCCUUC | 20 | 1986 |
| BCL11A-1502 | + | GCAUCGCGGCCGGGGCAGG | 20 | 1987 |
| BCL11A-1503 | + | CCGUGUUGGGCAUCGCGGCC | 20 | 1988 |
| BCL11A-1504 | + | UCCGUGUUGGGCAUCGCGGC | 20 | 1989 |
| BCL11A-1505 | + | CUCCGUGUUGGGCAUCGCGG | 20 | 1990 |
| BCL11A-1506 | + | GCGAGUACACGUUCUCCGUG | 20 | 1991 |
| BCL11A-1507 | + | CGCGUAGCCGGCGAGCCACU | 20 | 1992 |
| BCL11A-1508 | + | GCCUGGAGGCCGCGUAGCCG | 20 | 1993 |
| BCL11A-1509 | + | GAAGGGAUCUUUGAGCUGCC | 20 | 1994 |
| BCL11A-1510 | + | GGAAGGGAUCUUUGAGCUGC | 20 | 1995 |
| BCL11A-1511 | + | CGAAGCUAAGGAAGGGAUCU | 20 | 1996 |
| BCL11A-1512 | + | GGAGUCUCCGAAGCUAAGGA | 20 | 1997 |
| BCL11A-1513 | + | UGGAGUCUCCGAAGCUAAGG | 20 | 1998 |
| BCL11A-1514 | + | GUCUGGAGUCUCCGAAGCUA | 20 | 1999 |
| BCL11A-1515 | + | UGUCUGGAGUCUCCGAAGCU | 20 | 2000 |
| BCL11A-1516 | + | AAGGCGAUUGUCUGGAGUCU | 20 | 2001 |
| BCL11A-1517 | + | GGAGGCAAAAGGCGAUUGUC | 20 | 2002 |
| BCL11A-1518 | + | AGGAGGCAAAAGGCGAUUGU | 20 | 2003 |
| BCL11A-1519 | + | CUCCGAGGAGUGCUCCGACG | 20 | 2004 |
| BCL11A-1520 | + | UCUCCGAGGAGUGCUCCGAC | 20 | 2005 |
| BCL11A-1521 | + | GUUCUCCGAGGAGUGCUCCG | 20 | 2006 |
| BCL11A-1522 | + | GCGCAAACUCCCGUUCUCCG | 20 | 2007 |
| BCL11A-1523 | + | AGCGCAAACUCCCGUUCUCC | 20 | 2008 |
| BCL11A-1524 | + | GAAGCGCAAACUCCCGUUCU | 20 | 2009 |
| BCL11A-1525 | + | CCAGCUCCCGGGCGUGUG | 20 | 2010 |
| BCL11A-1526 | + | GUCCAGCUCCCGGGCGGUG | 20 | 2011 |
| BCL11A-1527 | + | CGUCCAGCUCCCCGGGCGGU | 20 | 2012 |
| BCL11A-1528 | + | AGAUCCCUCCGUCCAGCUCC | 20 | 2013 |
| BCL11A-1529 | + | ACUUCCCGUGCCGCUGCGCC | 20 | 2014 |
| BCL11A-1530 | + | CCGGGCCCGGACCACUAAUA | 20 | 2015 |
| BCL11A-1531 | + | CCCGGGCCCGGACCACUAAU | 20 | 2016 |
| BCL11A-1532 | + | UGAGCUGGGCCUGCCCGGGC | 20 | 2017 |
| BCL11A-1533 | + | CUCUUUUGAGCUGGGCCUGC | 20 | 2018 |
| BCL11A-1534 | + | UGCGUCUGCCCUCUUUUGAG | 20 | 2019 |
| BCL11A-1535 | + | GUCGCUGCGUCUGCCCUCUU | 20 | 2020 |
| BCL11A-1536 | + | UUGUACAUGUGUAGCUG | 17 | 2021 |
| BCL11A-1537 | + | AGAGAAACCAUGCACUG | 17 | 2022 |
| BCL11A-1538 | + | UUCUGUGCGUGUUGCAA | 17 | 2023 |
| BCL11A-1539 | + | UGUUCUGUGCGUGUUGC | 17 | 2024 |
| BCL11A-1540 | + | AAGUAGAUUCUUAAUCC | 17 | 2025 |
| BCL11A-1541 | + | ACCAACCCGCGGGGUCA | 17 | 2026 |
| BCL11A-1542 | + | UACCAACCCGCGGGGUC | 17 | 2027 |
| BCL11A-1543 | + | AUACCAACCCGCGGGGU | 17 | 2028 |
| BCL11A-1544 | + | GAAGGGAUACCAACCCG | 17 | 2029 |
| BCL11A-1545 | + | UGAAGGGAUACCAACCC | 17 | 2030 |
| BCL11A-1546 | + | UCUGCACCUAGUCCUGA | 17 | 2031 |
| BCL11A-1547 | + | UUCUGCACCUAGUCCUG | 17 | 2032 |
| BCL11A-1548 | + | ACAUUCUGCACCUAGUC | 17 | 2033 |
| BCL11A-1549 | + | AUGGAGAGGUGGCUGGG | 17 | 2034 |
| BCL11A-1550 | + | CCCAUGGAGAGGUGGCU | 17 | 2035 |
| BCL11A-1551 | + | UCCCAUGGAGAGGUGGC | 17 | 2036 |
| BCL11A-1552 | + | AUCCCAUGGAGAGGUGG | 17 | 2037 |
| BCL11A-1553 | + | GCAAUAUGAAUCCCAUG | 17 | 2038 |
| BCL11A-1554 | + | CUGCAAUAUGAAUCCCA | 17 | 2039 |
| BCL11A-1555 | + | UCUGCAAUAUGAAUCCC | 17 | 2040 |
| BCL11A-1556 | + | GGGUUAUUGUCUGCAAU | 17 | 2041 |
| BCL11A-1557 | + | UAUUCUUAGCAGGUUAA | 17 | 2042 |
| BCL11A-1558 | + | GUAUUCUUAGCAGGUUA | 17 | 2043 |
| BCL11A-1559 | + | GCGCCCUUCUGCCAGGC | 17 | 2044 |
| BCL11A-1560 | + | AGCGCCCUUCUGCCAGG | 17 | 2045 |
| BCL11A-1561 | + | AACAGGGGGGAGUGGG | 17 | 2046 |
| BCL11A-1562 | + | AAACAGGGGGGAGUGG | 17 | 2047 |
| BCL11A-1563 | + | GACUAAACAGGGGGGA | 17 | 2048 |
| BCL11A-1564 | + | GGUGGACUAAACAGGGG | 17 | 2049 |
| BCL11A-1565 | + | UGGUGGACUAAACAGGG | 17 | 2050 |
| BCL11A-1566 | + | GUGGUGGACUAAACAGG | 17 | 2051 |
| BCL11A-1567 | + | GGUGGUGGACUAAACAG | 17 | 2052 |
| BCL11A-1568 | + | CGGUGGUGGACUAAACA | 17 | 2053 |
| BCL11A-1569 | + | UCGGUGGUGGACUAAAC | 17 | 2054 |
| BCL11A-1570 | + | CUCGGUGGUGGACUAAA | 17 | 2055 |
| BCL11A-1571 | + | CAAGUGAUGUCUCGGUG | 17 | 2056 |
| BCL11A-1572 | + | CAGGCGCUCUAUGCGGU | 17 | 2057 |

TABLE 2E-continued

S. aureus gRNA targets for BCL11A knockout

| gRNA Name | DNA Strand | Targeting Domain | Target Site Length | SEQ ID NO |
|---|---|---|---|---|
| BCL11A-1573 | + | CCAGGCGCUCUAUGCGG | 17 | 2058 |
| BCL11A-1574 | + | CCCAGGCGCUCUAUGCG | 17 | 2059 |
| BCL11A-1575 | + | CUCGGGUGAUGGGUGGC | 17 | 2060 |
| BCL11A-1576 | + | UCAAAGGCACUCGGGUG | 17 | 2061 |
| BCL11A-1577 | + | CACCCUGUCAAAGGCAC | 17 | 2062 |
| BCL11A-1578 | + | GGGAGGCUCCAUAGCCA | 17 | 2063 |
| BCL11A-1579 | + | CUAGAGAAAUCCAUGGC | 17 | 2064 |
| BCL11A-1580 | + | CCUAGAGAAAUCCAUGG | 17 | 2065 |
| BCL11A-1581 | + | UCCUAGAGAAAUCCAUG | 17 | 2066 |
| BCL11A-1582 | + | GCUCUCUAAGUCUCCUA | 17 | 2067 |
| BCL11A-1583 | + | CAGCUCUCUAAGUCUCC | 17 | 2068 |
| BCL11A-1584 | + | CCGGCCUGGGGACAGCG | 17 | 2069 |
| BCL11A-1585 | + | UAGGGCUGGGCCGGCCU | 17 | 2070 |
| BCL11A-1586 | + | AUAGGGCUGGGCCGGCC | 17 | 2071 |
| BCL11A-1587 | + | CAUAGGGCUGGGCCGGC | 17 | 2072 |
| BCL11A-1588 | + | GUAACCUUUGCAUAGGG | 17 | 2073 |
| BCL11A-1589 | + | UUGCAGUAACCUUUGCA | 17 | 2074 |
| BCL11A-1590 | + | GCGGCUUGCUACCUGGC | 17 | 2075 |
| BCL11A-1591 | + | GGCGGCUUGCUACCUGG | 17 | 2076 |
| BCL11A-1592 | + | GGGGGGGCGUCGCCAGG | 17 | 2077 |
| BCL11A-1593 | + | GGAGGGGGGCGUCGCC | 17 | 2078 |
| BCL11A-1594 | + | GGGAGGGGGGCGUCGC | 17 | 2079 |
| BCL11A-1595 | + | AUUGCAGAGGAGGGAGG | 17 | 2080 |
| BCL11A-1596 | + | GAUUGCAGAGGAGGGAG | 17 | 2081 |
| BCL11A-1597 | + | GGAUUGCAGAGGAGGGA | 17 | 2082 |
| BCL11A-1598 | + | CGGAUUGCAGAGGAGGG | 17 | 2083 |
| BCL11A-1599 | + | GCGGAUUGCAGAGGAGG | 17 | 2084 |
| BCL11A-1600 | + | GGGCGGAUUGCAGAGGA | 17 | 2085 |
| BCL11A-1601 | + | GGGGCGGAUUGCAGAGG | 17 | 2086 |
| BCL11A-1602 | + | AGGGGCGGAUUGCAGAG | 17 | 2087 |
| BCL11A-1603 | + | GGAGGGGCGGAUUGCAG | 17 | 2088 |
| BCL11A-1604 | + | AGGAGGGGCGGAUUGCA | 17 | 2089 |
| BCL11A-1605 | + | GGAGGAGGGGCGGAUUG | 17 | 2090 |
| BCL11A-1606 | + | GCUGGGAGGGAGGAGGG | 17 | 2091 |
| BCL11A-1607 | + | GGGGCUGGGAGGGAGGG | 17 | 2092 |
| BCL11A-1608 | + | CGGGGGCUGGGAGGGAG | 17 | 2093 |
| BCL11A-1609 | + | ACCGGGGGCUGGGAGGG | 17 | 2094 |
| BCL11A-1610 | + | GACCGGGGGCUGGGAGG | 17 | 2095 |
| BCL11A-1611 | + | UUGACCGGGGGCUGGGA | 17 | 2096 |
| BCL11A-1612 | + | CUUGACCGGGGGCUGGG | 17 | 2097 |
| BCL11A-1613 | + | ACUUGACCGGGGGCUGG | 17 | 2098 |
| BCL11A-1614 | + | GGACUUGACCGGGGGCU | 17 | 2099 |
| BCL11A-1615 | + | UGGACUUGACCGGGGGC | 17 | 2100 |
| BCL11A-1616 | + | UUGGACUUGACCGGGGG | 17 | 2101 |
| BCL11A-1617 | + | AUGACUUGGACUUGACC | 17 | 2102 |
| BCL11A-1618 | + | CAUGACUUGGACUUGAC | 17 | 2103 |
| BCL11A-1619 | + | GCAUGACUUGGACUUGA | 17 | 2104 |
| BCL11A-1620 | + | CGCAGAACUCGCAUGAC | 17 | 2105 |
| BCL11A-1621 | + | AUUUGAACGUCUUGCCG | 17 | 2106 |
| BCL11A-1622 | + | CCAGGUUGCUCUGAAAU | 17 | 2107 |
| BCL11A-1623 | + | UGCACCACCAGGUUGCU | 17 | 2108 |
| BCL11A-1624 | + | CGCACAGGUUGCACUUG | 17 | 2109 |
| BCL11A-1625 | + | CGCUUCAGCUUGCUGGC | 17 | 2110 |
| BCL11A-1626 | + | CGGACUUGACCGUCAUG | 17 | 2111 |
| BCL11A-1627 | + | UCGGACUUGACCGUCAU | 17 | 2112 |
| BCL11A-1628 | + | GUCGGACUUGACCGUCA | 17 | 2113 |
| BCL11A-1629 | + | CGUCGGACUUGACCGUC | 17 | 2114 |
| BCL11A-1630 | + | CGGUGGAGAGACCGUCG | 17 | 2115 |
| BCL11A-1631 | + | CCGGGGAGCUGGCGGUG | 17 | 2116 |
| BCL11A-1632 | + | UUCCGGGGAGCUGGCGG | 17 | 2117 |
| BCL11A-1633 | + | GUUCCGGGGAGCUGGCG | 17 | 2118 |
| BCL11A-1634 | + | GCUGGUGCCGGGUUCCG | 17 | 2119 |
| BCL11A-1635 | + | CGCUGGUGCCGGGUUCC | 17 | 2120 |
| BCL11A-1636 | + | UCGCUGGUGCCGGGUUC | 17 | 2121 |
| BCL11A-1637 | + | GUCGCUGGUGCCGGGUU | 17 | 2122 |
| BCL11A-1638 | + | CCACCAAGUCGCUGGUG | 17 | 2123 |
| BCL11A-1639 | + | ACUUGGCCACCACGGAC | 17 | 2124 |
| BCL11A-1640 | + | UCUUGAACUUGGCCACC | 17 | 2125 |
| BCL11A-1641 | + | UGGGGUCGUUCUCGCUC | 17 | 2126 |
| BCL11A-1642 | + | GUUCUCCGGGAUCAGGU | 17 | 2127 |
| BCL11A-1643 | + | CGUUCUCCGGGAUCAGG | 17 | 2128 |
| BCL11A-1644 | + | UCCUCGUCCCCGUUCUC | 17 | 2129 |
| BCL11A-1645 | + | CUCCUCGUCCCCGUUCU | 17 | 2130 |
| BCL11A-1646 | + | CCGCCUCCAGGCUCAGC | 17 | 2131 |

TABLE 2E-continued

S. aureus gRNA targets for BCL11A knockout

| gRNA Name | DNA Strand | Targeting Domain | Target Site Length | SEQ ID NO |
|---|---|---|---|---|
| BCL11A-1647 | + | GCCCACGACCGCGCCCC | 17 | 2132 |
| BCL11A-1648 | + | CCCUGCAUGACGUCGGG | 17 | 2133 |
| BCL11A-1649 | + | CCAUGCCCUGCAUGACG | 17 | 2134 |
| BCL11A-1650 | + | UGAAGUGCUGCAUGGAG | 17 | 2135 |
| BCL11A-1651 | + | CUCGCUGAAGUGCUGCA | 17 | 2136 |
| BCL11A-1652 | + | CCUCGCUGAAGUGCUGC | 17 | 2137 |
| BCL11A-1653 | + | CCUGGUGGAAGGCCUCG | 17 | 2138 |
| BCL11A-1654 | + | UCUCGCCCAGGACCUGG | 17 | 2139 |
| BCL11A-1655 | + | UUCUCGCCCAGGACCUG | 17 | 2140 |
| BCL11A-1656 | + | CGCUUAUGCUUCUCGCC | 17 | 2141 |
| BCL11A-1657 | + | GUCCGACUCGCCGGCCA | 17 | 2142 |
| BCL11A-1658 | + | CGAGGCCGACUCGCCCG | 17 | 2143 |
| BCL11A-1659 | + | CCGAGGCCGACUCGCCC | 17 | 2144 |
| BCL11A-1660 | + | CCCGAGGCCGACUCGCC | 17 | 2145 |
| BCL11A-1661 | + | CCCCGAGGCCGACUCGC | 17 | 2146 |
| BCL11A-1662 | + | CUUUUUGGACAGGCCCC | 17 | 2147 |
| BCL11A-1663 | + | UGCCCAGCAGCAGCUUU | 17 | 2148 |
| BCL11A-1664 | + | GAAGGGGCUCAGCGAGC | 17 | 2149 |
| BCL11A-1665 | + | AGAAGGGGCUCAGCGAG | 17 | 2150 |
| BCL11A-1666 | + | CUUAGAGAAGGGGCUCA | 17 | 2151 |
| BCL11A-1667 | + | CUUGAUGCGCUUAGAGA | 17 | 2152 |
| BCL11A-1668 | + | GCUUGAUGCGCUUAGAG | 17 | 2153 |
| BCL11A-1669 | + | CGAGCUUGAUGCGCUUA | 17 | 2154 |
| BCL11A-1670 | + | CUCGAGCUUGAUGCGCU | 17 | 2155 |
| BCL11A-1671 | + | GCAGGUCGAACUCCUUC | 17 | 2156 |
| BCL11A-1672 | + | UCGCGGCCGGGGGCAGG | 17 | 2157 |
| BCL11A-1673 | + | UGUUGGGCAUCGCGGCC | 17 | 2158 |
| BCL11A-1674 | + | GUGUUGGGCAUCGCGGC | 17 | 2159 |
| BCL11A-1675 | + | CGUGUUGGGCAUCGCGG | 17 | 2160 |
| BCL11A-1676 | + | AGUACACGUUCUCCGUG | 17 | 2161 |
| BCL11A-1677 | + | GUAGCCGGCGAGCCACU | 17 | 2162 |
| BCL11A-1678 | + | UGGAGGCCGCGUAGCCG | 17 | 2163 |
| BCL11A-1679 | + | GGGAUCUUUGAGCUGCC | 17 | 2164 |
| BCL11A-1680 | + | AGGGAUCUUUGAGCUGC | 17 | 2165 |
| BCL11A-1681 | + | AGCUAAGGAAGGGAUCU | 17 | 2166 |
| BCL11A-1682 | + | GUCUCCGAAGCUAAGGA | 17 | 2167 |
| BCL11A-1683 | + | AGUCUCCGAAGCUAAGG | 17 | 2168 |
| BCL11A-1684 | + | UGGAGUCUCCGAAGCUA | 17 | 2169 |
| BCL11A-1685 | + | CUGGAGUCUCCGAAGCU | 17 | 2170 |
| BCL11A-1686 | + | GCGAUUGUCUGGAGUCU | 17 | 2171 |
| BCL11A-1687 | + | GGCAAAAGGCGAUUGUC | 17 | 2172 |
| BCL11A-1688 | + | AGGCAAAAGGCGAUUGU | 17 | 2173 |
| BCL11A-1689 | + | CGAGGAGUGCUCCGACG | 17 | 2174 |
| BCL11A-1690 | + | CCGAGGAGUGCUCCGAC | 17 | 2175 |
| BCL11A-1691 | + | CUCCGAGGAGUGCUCCG | 17 | 2176 |
| BCL11A-1692 | + | CAAACUCCCGUUCUCCG | 17 | 2177 |
| BCL11A-1693 | + | GCAAACUCCCGUUCUCC | 17 | 2178 |
| BCL11A-1694 | + | GCGCAAACUCCCGUUCU | 17 | 2179 |
| BCL11A-1695 | + | GCUCCCCGGGCGGUGUG | 17 | 2180 |
| BCL11A-1696 | + | CAGCUCCCCGGGCGGUG | 17 | 2181 |
| BCL11A-1697 | + | CCAGCUCCCCGGGCGGU | 17 | 2182 |
| BCL11A-1698 | + | UCCCUCCGUCCAGCUCC | 17 | 2183 |
| BCL11A-1699 | + | UCCCGUGCCGCUGCGCC | 17 | 2184 |
| BCL11A-1700 | + | GGCCCGGACCACUAAUA | 17 | 2185 |
| BCL11A-1701 | + | GGGCCCGGACCACUAAU | 17 | 2186 |
| BCL11A-1702 | + | GCUGGGCCUGCCCGGGC | 17 | 2187 |
| BCL11A-1703 | + | UUUUGAGCUGGGCCUGC | 17 | 2188 |
| BCL11A-1704 | + | GUCUGCCCUCUUUUGAG | 17 | 2189 |
| BCL11A-1705 | + | GCUGCGUCUGCCCUCUU | 17 | 2190 |
| BCL11A-1706 | − | CCCCCAUUCGGCGUAGUACC | 20 | 2191 |
| BCL11A-1707 | − | CCCAUUCGGCGUAGUACCCA | 20 | 2192 |
| BCL11A-1708 | − | CUCAAGAUGUGUGGCAGUUU | 20 | 2193 |
| BCL11A-1709 | − | AGAUGUGUGGCAGUUUUCGG | 20 | 2194 |
| BCL11A-1710 | − | GAUGUGUGGCAGUUUUCGGA | 20 | 2195 |
| BCL11A-1711 | − | GGCAGUUUUCGGAUGGAAGC | 20 | 2196 |
| BCL11A-1712 | − | CAGUUUUCGGAUGGAAGCUC | 20 | 2197 |
| BCL11A-1713 | − | CCAUUCGGCGUAGUACC | 17 | 2198 |
| BCL11A-1714 | − | AUUCGGCGUAGUACCCA | 17 | 2199 |
| BCL11A-1715 | − | AAGAUGUGUGGCAGUUU | 17 | 2200 |
| BCL11A-1716 | − | UGUGUGGCAGUUUUCGG | 17 | 2201 |
| BCL11A-1717 | − | GUGUGGCAGUUUUCGGA | 17 | 2202 |
| BCL11A-1718 | − | AGUUUUCGGAUGGAAGC | 17 | 2203 |
| BCL11A-1719 | − | UUUUCGGAUGGAAGCUC | 17 | 2204 |
| BCL11A-1720 | + | ACGCCGAAUGGGGGUGUGUG | 20 | 2205 |

TABLE 2E-continued

S. aureus gRNA targets for BCL11A knockout

| gRNA Name | DNA Strand | Targeting Domain | Target Site Length | SEQ ID NO |
|---|---|---|---|---|
| BCL11A-1721 | + | ACUACGCCGAAUGGGGUGU | 20 | 2206 |
| BCL11A-1722 | + | CUCUGGGUACUACGCCGAAU | 20 | 2207 |
| BCL11A-1723 | + | UCUCUGGGUACUACGCCGAA | 20 | 2208 |
| BCL11A-1724 | + | CUCUCUGGGUACUACGCCGA | 20 | 2209 |
| BCL11A-1725 | + | UGAGCUCUCUGGGUACUACG | 20 | 2210 |
| BCL11A-1726 | + | UGCCACACAUCUUGAGCUCU | 20 | 2211 |
| BCL11A-1727 | + | UCCGAAAACUGCCACACAUC | 20 | 2212 |
| BCL11A-1728 | + | AAGGGCUCUCGAGCUUCCAU | 20 | 2213 |
| BCL11A-1729 | + | CCGAAUGGGGUGUGUG | 17 | 2214 |
| BCL11A-1730 | + | ACGCCGAAUGGGGUGU | 17 | 2215 |
| BCL11A-1731 | + | UGGGUACUACGCCGAAU | 17 | 2216 |
| BCL11A-1732 | + | CUGGGUACUACGCCGAA | 17 | 2217 |
| BCL11A-1733 | + | UCUGGGUACUACGCCGA | 17 | 2218 |
| BCL11A-1734 | + | GCUCUCUGGGUACUACG | 17 | 2219 |
| BCL11A-1735 | + | CACACAUCUUGAGCUCU | 17 | 2220 |
| BCL11A-1736 | + | GAAAACUGCCACACAUC | 17 | 2221 |
| BCL11A-1737 | + | GGCUCUCGAGCUUCCAU | 17 | 2222 |

Table 2F provides exemplary targeting domains for knocking out the BCL11A gene. In an embodiment, the targeting domain is the exact complement of the target domain. Any of the targeting domains in the table can be used with an N. meningitidis Cas9 molecule that gives double stranded cleavage. Any of the targeting domains in the table can be used with an N. meningitidis Cas9 single-stranded break nucleases (nickases). In an embodiment, dual targeting is used to create two nicks. When selecting gRNAs for use in a nickase pair, one gRNA targets a domain in the complementary strand and the second gRNA targets a domain in the non-complementary strand, e.g., a gRNA comprising any minus strand targeting domain may be paired any gRNA comprising a plus strand targeting domain targeting the same target position.

TABLE 2F

N. meningitidis gRNA targets for BCL11A knockout

| gRNA Name | DNA Strand | Targeting Domain | Target Site Length |
|---|---|---|---|
| BCL11A-1738 | − | AUCCAGGUCACGCCAGAGGA | 20 |
| BCL11A-1739 | − | UGCAACACGCACAGAACACU | 20 |
| BCL11A-1740 | − | UCCUUCCCAGCCACCUCUCC | 20 |
| BCL11A-1741 | − | AUGGCUAUGGAGCCUCCCGC | 20 |
| BCL11A-1742 | − | CAGGUCACGCCAGAGGA | 17 |

TABLE 2F-continued

N. meningitidis gRNA targets for BCL11A knockout

| gRNA Name | DNA Strand | Targeting Domain | Target Site Length |
|---|---|---|---|
| BCL11A-1743 | − | AACACGCACAGAACACU | 17 | 2228 |
| BCL11A-1744 | − | UUCCCAGCCACCUCUCC | 17 | 2229 |
| BCL11A-1745 | − | GCUAUGGAGCCUCCCGC | 17 | 2230 |
| BCL11A-1746 | + | UGAAAAAGCAUCCAAUCCC | 20 | 2231 |
| BCL11A-1747 | + | GGAGGUUGGCAUCCAGGUCA | 20 | 2232 |
| BCL11A-1748 | + | CGCCUGGGAUGAGUGCAGAA | 20 | 2233 |
| BCL11A-1749 | + | UAGAAAGCGAACACGGAAGU | 20 | 2234 |
| BCL11A-1750 | + | GGCUAUGGAGCCUCCCGCCA | 20 | 2235 |
| BCL11A-1751 | + | CCUCCUCCCUCCCAGCCCCC | 20 | 2236 |
| BCL11A-1752 | + | CCCAUGACGGUCAAGUCCGA | 20 | 2237 |
| BCL11A-1753 | + | UUUGCCUCCUCGUCGGAGCA | 20 | 2238 |
| BCL11A-1754 | + | UGAAAAAGCAUCCAAU | 17 | 2239 |
| BCL11A-1755 | + | GGAGGUUGGCAUCCAGG | 17 | 2240 |
| BCL11A-1756 | + | CGCCUGGGAUGAGUGCA | 17 | 2241 |
| BCL11A-1757 | + | UAGAAAGCGAACACGGA | 17 | 2242 |
| BCL11A-1758 | + | GGCUAUGGAGCCUCCCG | 17 | 2243 |
| BCL11A-1759 | + | CCUCCUCCCUCCCAGCC | 17 | 2244 |
| BCL11A-1760 | + | CCCAUGACGGUCAAGUC | 17 | 2245 |
| BCL11A-1761 | + | UUUGCCUCCUCGUCGGA | 17 | 2246 |

Table 3A provides exemplary targeting domains for repressing (i.e., knocking down or decreasing) expression of the BCL11A gene. In an embodiment, the targeting domain is the exact complement of the target domain. Any of the targeting domains in the table can be used with a S. pyogenes eiCas9 molecule to cause a steric block at the promoter region to block transcription resulting in the repression of the BCL11A gene. Alternatively, any of the targeting domains in the table can be used with a S. pyogenes eiCas9 fused to a transcriptional repressor to decrease transcription and therefore downregulate gene expression.

TABLE 3A

S. pyogenes gRNA targets for BCL11A knockdown

| gRNA Name | DNA Strand | Targeting Domain | Target Site Length | SEQ ID NO |
|---|---|---|---|---|
| BCL11A-1762 | − | UCUUCUCCUUGCUGCCUCUG | 20 | 2247 |
| BCL11A-1763 | − | UCCUUGCUGCCUCUGAGGUU | 20 | 2248 |
| BCL11A-1764 | − | UGCUGCCUCUGAGGUUCGGU | 20 | 2249 |
| BCL11A-1765 | − | GCUGCCUCUGAGGUUCGGUC | 20 | 2250 |
| BCL11A-1766 | − | GCCUCUGAGGUUCGGUCGGG | 20 | 2251 |
| BCL11A-1767 | − | CCUCUGAGGUUCGGUCGGGA | 20 | 2252 |

TABLE 3A-continued

S. pyogenes gRNA targets for BCL11A knockdown

| gRNA Name | DNA Strand | Targeting Domain | Target Site Length | SEQ ID NO |
|---|---|---|---|---|
| BCL11A-1768 | - | CUCUGAGGUUCGGUCGGGAG | 20 | 2253 |
| BCL11A-1769 | - | UGAGGUUCGGUCGGGAGGGG | 20 | 2254 |
| BCL11A-1770 | - | GAGGUUCGGUCGGGAGGGGA | 20 | 2255 |
| BCL11A-1771 | - | CGGUCGGGAGGGGAGGGCAG | 20 | 2256 |
| BCL11A-1772 | - | GGGGAGGGCAGCGGCAACCC | 20 | 2257 |
| BCL11A-1773 | - | GAGGGCAGCGGCAACCCAGG | 20 | 2258 |
| BCL11A-1774 | - | CAACCCAGGAGGCAGCAGUC | 20 | 2259 |
| BCL11A-1775 | - | AACCCAGGAGGCAGCAGUCC | 20 | 2260 |
| BCL11A-1776 | - | CUCCCUCUCCCGCGUGCCCC | 20 | 2261 |
| BCL11A-1777 | - | CCCCCGGCCGCCUCCUCCCC | 20 | 2262 |
| BCL11A-1778 | - | CGGCCCUAGCUCCUGCCCUU | 20 | 2263 |
| BCL11A-1779 | - | CCCUAGCUCCUGCCCUUCGG | 20 | 2264 |
| BCL11A-1780 | - | UAGCUCCUGCCCUUCGGCGG | 20 | 2265 |
| BCL11A-1781 | - | CUCCUGCCCUUCGGCGGCGG | 20 | 2266 |
| BCL11A-1782 | - | CUGCCCUUCGGCGGCGGCGG | 20 | 2267 |
| BCL11A-1783 | - | CCCUUCGGCGGCGGCGGCGG | 20 | 2268 |
| BCL11A-1784 | - | UUCGGCGGCGGCGGCGGCGG | 20 | 2269 |
| BCL11A-1785 | - | CGGCGGCGGCGGCGGCGGCG | 20 | 2270 |
| BCL11A-1786 | - | GGCGGCGGCGGCGGCGGCGC | 20 | 2271 |
| BCL11A-1787 | - | GGCGGCGGCGGCGGCGCGGG | 20 | 2272 |
| BCL11A-1788 | - | GCGGCGGCGGCGGCGCGGGA | 20 | 2273 |
| BCL11A-1789 | - | GGCGCGGGAGGGCAAGCGCG | 20 | 2274 |
| BCL11A-1790 | - | GGAGGGCAAGCGCGAGGAGC | 20 | 2275 |
| BCL11A-1791 | - | GCGCGAGGAGCCGGCACAAA | 20 | 2276 |
| BCL11A-1792 | - | GGAGCCGGCACAAAAGGCAG | 20 | 2277 |
| BCL11A-1793 | - | GAGCCGGCACAAAAGGCAGC | 20 | 2278 |
| BCL11A-1794 | - | GCGGGACAAACACCCACCUC | 20 | 2279 |
| BCL11A-1795 | - | GACAAACACCCACCUCUGGC | 20 | 2280 |
| BCL11A-1796 | - | CCACCUCUGGCCGGAACAAA | 20 | 2281 |
| BCL11A-1797 | - | CCUCUGGCCGGAACAAAAGG | 20 | 2282 |
| BCL11A-1798 | - | GGAACAAAAGGCGGCAGUGC | 20 | 2283 |
| BCL11A-1799 | - | GCCGCGUCUCCCGUCCUUCC | 20 | 2284 |
| BCL11A-1800 | - | UCCCGUCCUUCCCGGUCCCA | 20 | 2285 |
| BCL11A-1801 | - | CACGGCUCUCCCCGUCGCCG | 20 | 2286 |
| BCL11A-1802 | - | CGGCCCUCUCCCGACUCCG | 20 | 2287 |
| BCL11A-1803 | - | UCUCCCGACUCCGCGGACUC | 20 | 2288 |
| BCL11A-1804 | - | CUCCGCGGACUCAGGAGCGC | 20 | 2289 |
| BCL11A-1805 | - | UCCGCGGACUCAGGAGCGCC | 20 | 2290 |
| BCL11A-1806 | - | CCGCGGACUCAGGAGCGCCG | 20 | 2291 |
| BCL11A-1807 | - | CGCGGACUCAGGAGCGCCGG | 20 | 2292 |
| BCL11A-1808 | - | GUGCCACUUUCUCACUAUUG | 20 | 2293 |
| BCL11A-1809 | - | UGCCACUUUCUCACUAUUGU | 20 | 2294 |
| BCL11A-1810 | - | GCCACUUUCUCACUAUUGUG | 20 | 2295 |
| BCL11A-1811 | - | ACACUUGACCGUGAGCGCGC | 20 | 2296 |
| BCL11A-1812 | - | AGUCUCACCUCUUUUCUCCC | 20 | 2297 |
| BCL11A-1813 | - | GUCUCACCUCUUUUCUCCCC | 20 | 2298 |
| BCL11A-1814 | - | CCUACCCCCCAUUUUCUUA | 20 | 2299 |
| BCL11A-1815 | - | CCCCAUUUUCUUACGGUGAG | 20 | 2300 |
| BCL11A-1816 | - | CCCAUUUUCUUACGGUGAGU | 20 | 2301 |
| BCL11A-1817 | - | CCCCACCAGCUCCCACCCCC | 20 | 2302 |
| BCL11A-1818 | - | UGUUCAUUAUUUGCAAAAC | 20 | 2303 |
| BCL11A-1819 | - | UCAUUAUUUGCAAAACUGG | 20 | 2304 |
| BCL11A-1820 | - | CAUUAUUUGCAAAACUGGC | 20 | 2305 |
| BCL11A-1821 | - | AUUAUUUGCAAAACUGGCG | 20 | 2306 |
| BCL11A-1822 | - | AUUUGCAAAACUGGCGGGG | 20 | 2307 |
| BCL11A-1823 | - | UUUUGCAAAACUGGCGGGGC | 20 | 2308 |
| BCL11A-1824 | - | UUUGCAAAACUGGCGGGGCG | 20 | 2309 |
| BCL11A-1825 | - | UUGCAAAACUGGCGGGGCGG | 20 | 2310 |
| BCL11A-1826 | - | UGCAAAACUGGCGGGGCGGG | 20 | 2311 |
| BCL11A-1827 | - | GCAAAACUGGCGGGGCGGGG | 20 | 2312 |
| BCL11A-1828 | - | CAAAACUGGCGGGGCGGGGG | 20 | 2313 |
| BCL11A-1829 | - | CUGGCGGGGCGGGGGGGAG | 20 | 2314 |
| BCL11A-1830 | - | UUUCGAAAAGAGAAAUAAAG | 20 | 2315 |
| BCL11A-1831 | - | CGAAAAGAGAAAUAAAGCGG | 20 | 2316 |
| BCL11A-1832 | - | AGAGAAAUAAAGCGGCGGAA | 20 | 2317 |
| BCL11A-1833 | - | GAAAUAAAGCGGCGGAAAGG | 20 | 2318 |
| BCL11A-1834 | - | AGCGGCGGAAAGGAGGAAAG | 20 | 2319 |
| BCL11A-1835 | - | GGCGGAAAGGAGGAAAGAGG | 20 | 2320 |
| BCL11A-1836 | - | UAAAAUUAAAUAAAAUUAAA | 20 | 2321 |
| BCL11A-1837 | - | CUGUCUCAAAAGUGCAUACA | 20 | 2322 |
| BCL11A-1838 | - | CAAAAGUGCAUACACGGCAA | 20 | 2323 |
| BCL11A-1839 | - | UACACGGCAAUGGUUCCAGA | 20 | 2324 |
| BCL11A-1840 | - | ACACGGCAAUGGUUCCAGAU | 20 | 2325 |
| BCL11A-1841 | - | CAAUGGUUCCAGAUGGGAUG | 20 | 2326 |

TABLE 3A-continued

S. pyogenes gRNA targets for BCL11A knockdown

| gRNA Name | DNA Strand | Targeting Domain | Target Site Length | SEQ ID NO |
|---|---|---|---|---|
| BCL11A-1842 | − | AAUGGUUCCAGAUGGGAUGA | 20 | 2327 |
| BCL11A-1843 | − | AUCUCUUUUACCUCGACUCU | 20 | 2328 |
| BCL11A-1844 | − | UCUUUUACCUCGACUCUCGG | 20 | 2329 |
| BCL11A-1845 | − | AUAAUUAUUAUUACUAUUAU | 20 | 2330 |
| BCL11A-1846 | − | UAAUUAUUAUUACUAUUAUU | 20 | 2331 |
| BCL11A-1847 | + | UAAUAUCACGAGAGCGCGC | 20 | 2332 |
| BCL11A-1848 | + | CAGGACUAGAAGCAAAAGCG | 20 | 2333 |
| BCL11A-1849 | + | AGGACUAGAAGCAAAAGCGA | 20 | 2334 |
| BCL11A-1850 | + | GGACUAGAAGCAAAAGCGAG | 20 | 2335 |
| BCL11A-1851 | + | GACUAGAAGCAAAAGCGAGG | 20 | 2336 |
| BCL11A-1852 | + | AGCAAAAGCGAGGGGGAGAG | 20 | 2337 |
| BCL11A-1853 | + | GCAAAAGCGAGGGGGAGAGA | 20 | 2338 |
| BCL11A-1854 | + | CAAAAGCGAGGGGGAGAGAG | 20 | 2339 |
| BCL11A-1855 | + | AGAAAAACCUCCGAGAGUCG | 20 | 2340 |
| BCL11A-1856 | + | AGUCGAGGUAAAAGAGAUAA | 20 | 2341 |
| BCL11A-1857 | + | GUCGAGGUAAAAGAGAUAAA | 20 | 2342 |
| BCL11A-1858 | + | UCGAGGUAAAAGAGAUAAAG | 20 | 2343 |
| BCL11A-1859 | + | CGAGGUAAAAGAGAUAAAGG | 20 | 2344 |
| BCL11A-1860 | + | GAAAAAACCCUCAUCCCAUC | 20 | 2345 |
| BCL11A-1861 | + | CUUUAUUUCUCUUUUCGAAA | 20 | 2346 |
| BCL11A-1862 | + | CAAAAUAAUGAACAAUGCUA | 20 | 2347 |
| BCL11A-1863 | + | GAACAACUCACAUGCAAACC | 20 | 2348 |
| BCL11A-1864 | + | AACAACUCACAUGCAAACCU | 20 | 2349 |
| BCL11A-1865 | + | ACAACUCACAUGCAAACCUG | 20 | 2350 |
| BCL11A-1866 | + | CAACUCACAUGCAAACCUGG | 20 | 2351 |
| BCL11A-1867 | + | CUCACAUGCAAACCUGGGGG | 20 | 2352 |
| BCL11A-1868 | + | UCACAUGCAAACCUGGGGGU | 20 | 2353 |
| BCL11A-1869 | + | GCAAACCUGGGGGUGGGAGC | 20 | 2354 |
| BCL11A-1870 | + | AACCUGGGGGUGGGAGCUGG | 20 | 2355 |
| BCL11A-1871 | + | ACCUGGGGGUGGGAGCUGGU | 20 | 2356 |
| BCL11A-1872 | + | CCUGGGGGUGGGAGCUGGUG | 20 | 2357 |
| BCL11A-1873 | + | GGGUGGGAGCUGGUGGGGAA | 20 | 2358 |
| BCL11A-1874 | + | GGUGGGAGCUGGUGGGGAAA | 20 | 2359 |
| BCL11A-1875 | + | GGGAGCUGGUGGGGAAAGGG | 20 | 2360 |
| BCL11A-1876 | + | UCCCACUCACCGUAAGAAAA | 20 | 2361 |
| BCL11A-1877 | + | CCCACUCACCGUAAGAAAAU | 20 | 2362 |
| BCL11A-1878 | + | CCACUCACCGUAAGAAAAUG | 20 | 2363 |
| BCL11A-1879 | + | CACUCACCGUAAGAAAAUGG | 20 | 2364 |
| BCL11A-1880 | + | ACUCACCGUAAGAAAAUGGG | 20 | 2365 |
| BCL11A-1881 | + | CUCACCGUAAGAAAAUGGGG | 20 | 2366 |
| BCL11A-1882 | + | CCGUAAGAAAAUGGGGGGGU | 20 | 2367 |
| BCL11A-1883 | + | CGUAAGAAAAUGGGGGGGUA | 20 | 2368 |
| BCL11A-1884 | + | AAGAAAAUGGGGGGGUAGGG | 20 | 2369 |
| BCL11A-1885 | + | AGAAAAUGGGGGGGUAGGGA | 20 | 2370 |
| BCL11A-1886 | + | CAAGUCUAAAAAACGAUUCC | 20 | 2371 |
| BCL11A-1887 | + | AAGUCUAAAAAACGAUUCCC | 20 | 2372 |
| BCL11A-1888 | + | AGUCUAAAAAACGAUUCCCG | 20 | 2373 |
| BCL11A-1889 | + | ACGAUUCCCGGGGAGAAAAG | 20 | 2374 |
| BCL11A-1890 | + | GGGGAGAAAAGAGGUGAGAC | 20 | 2375 |
| BCL11A-1891 | + | AAAGAGGUGAGACUGGCUUU | 20 | 2376 |
| BCL11A-1892 | + | UUUGGACACCAGCGCGCUCA | 20 | 2377 |
| BCL11A-1893 | + | GCUCACGGUCAAGUGUGCAG | 20 | 2378 |
| BCL11A-1894 | + | CUCACGGUCAAGUGUGCAGC | 20 | 2379 |
| BCL11A-1895 | + | ACGGUCAAGUGUGCAGCGGG | 20 | 2380 |
| BCL11A-1896 | + | UCCCCACAAUAGUGAGAAAG | 20 | 2381 |
| BCL11A-1897 | + | AUAGUGAGAAAGUGGCACUG | 20 | 2382 |
| BCL11A-1898 | + | GAGAAAGUGGCACUGUGGAA | 20 | 2383 |
| BCL11A-1899 | + | AGAAAGUGGCACUGUGGAAA | 20 | 2384 |
| BCL11A-1900 | + | GAAAGUGGCACUGUGGAAAG | 20 | 2385 |
| BCL11A-1901 | + | GCACUGUGGAAAGGGCCCC | 20 | 2386 |
| BCL11A-1902 | + | CCCCGGCGCUCCUGAGUCCG | 20 | 2387 |
| BCL11A-1903 | + | CGCUCCUGAGUCCGCGGAGU | 20 | 2388 |
| BCL11A-1904 | + | GCUCCUGAGUCCGCGGAGUC | 20 | 2389 |
| BCL11A-1905 | + | UGAGUCCGCGGAGUCGGGAG | 20 | 2390 |
| BCL11A-1906 | + | GAGUCCGCGGAGUCGGGAGA | 20 | 2391 |
| BCL11A-1907 | + | AGUCCGCGGAGUCGGGAGAG | 20 | 2392 |
| BCL11A-1908 | + | CGGAGUCGGGAGAGGGGCCG | 20 | 2393 |
| BCL11A-1909 | + | CGGGAGAGGGGCCGCGGCGA | 20 | 2394 |
| BCL11A-1910 | + | GGGAGAGGGGCCGCGGCGAC | 20 | 2395 |
| BCL11A-1911 | + | GGAGAGGGGCCGCGGCGACG | 20 | 2396 |
| BCL11A-1912 | + | CGCGGCGACGGGGAGAGCCG | 20 | 2397 |
| BCL11A-1913 | + | GCGGCGACGGGGAGAGCCGU | 20 | 2398 |
| BCL11A-1914 | + | GACGGGGAGAGCCGUGGGAC | 20 | 2399 |
| BCL11A-1915 | + | ACGGGGAGAGCCGUGGGACC | 20 | 2400 |

TABLE 3A-continued

S. pyogenes gRNA targets for BCL11A knockdown

| gRNA Name | DNA Strand | Targeting Domain | Target Site Length | SEQ ID NO |
|---|---|---|---|---|
| BCL11A-1916 | + | GGAGAGCCGUGGGACCGGGA | 20 | 2401 |
| BCL11A-1917 | + | AGCCGUGGGACCGGGAAGGA | 20 | 2402 |
| BCL11A-1918 | + | GCCGUGGGACCGGGAAGGAC | 20 | 2403 |
| BCL11A-1919 | + | ACCGGGAAGGACGGGAGACG | 20 | 2404 |
| BCL11A-1920 | + | GGAAGGACGGGAGACGCGGC | 20 | 2405 |
| BCL11A-1921 | + | GGCACUGCCGCCUUUUGUUC | 20 | 2406 |
| BCL11A-1922 | + | CCGCCUUUUGUUCCGGCCAG | 20 | 2407 |
| BCL11A-1923 | + | CCUUUUGUUCCGGCCAGAGG | 20 | 2408 |
| BCL11A-1924 | + | CUUUUGUUCCGGCCAGAGGU | 20 | 2409 |
| BCL11A-1925 | + | UGUCCCGCUGCCUUUUGUGC | 20 | 2410 |
| BCL11A-1926 | + | GCCGCCGCCGCCGCCGCCGA | 20 | 2411 |
| BCL11A-1927 | + | CCGCCGCCGCCGCCGCCGAA | 20 | 2412 |
| BCL11A-1928 | + | CGCCGCCGCCGCCGAAGGGC | 20 | 2413 |
| BCL11A-1929 | + | GCCGCCGAAGGGCAGGAGCU | 20 | 2414 |
| BCL11A-1930 | + | CCGCCGAAGGGCAGGAGCUA | 20 | 2415 |
| BCL11A-1931 | + | CGAAGGGCAGGAGCUAGGGC | 20 | 2416 |
| BCL11A-1932 | + | GAAGGGCAGGAGCUAGGGCC | 20 | 2417 |
| BCL11A-1933 | + | AAGGGCAGGAGCUAGGGCCG | 20 | 2418 |
| BCL11A-1934 | + | AGGGCAGGAGCUAGGGCCGG | 20 | 2419 |
| BCL11A-1935 | + | GCAGGAGCUAGGGCCGGGGG | 20 | 2420 |
| BCL11A-1936 | + | GGAGCUAGGGCCGGGGGAGG | 20 | 2421 |
| BCL11A-1937 | + | GCUAGGGCCGGGGGAGGAGG | 20 | 2422 |
| BCL11A-1938 | + | GGGCCGGGGGAGGAGGCGGC | 20 | 2423 |
| BCL11A-1939 | + | GGCCGGGGGAGGAGGCGGCC | 20 | 2424 |
| BCL11A-1940 | + | GCCGGGGGAGGAGGCGGCCG | 20 | 2425 |
| BCL11A-1941 | + | CCGGGGGAGGAGGCGGCCGG | 20 | 2426 |
| BCL11A-1942 | + | AGGAGGCGGCCGGGGGCACG | 20 | 2427 |
| BCL11A-1943 | + | GGAGGCGGCCGGGGGCACGC | 20 | 2428 |
| BCL11A-1944 | + | CGGCCGGGGGCACGCGGGAG | 20 | 2429 |
| BCL11A-1945 | + | GGCCGGGGGCACGCGGGAGA | 20 | 2430 |
| BCL11A-1946 | + | CGGGGGCACGCGGGAGAGGG | 20 | 2431 |
| BCL11A-1947 | + | GGGGGCACGCGGGAGAGGGA | 20 | 2432 |
| BCL11A-1948 | + | GGCACGCGGGAGAGGGAGGG | 20 | 2433 |
| BCL11A-1949 | + | GCACGCGGGAGAGGGAGGGA | 20 | 2434 |
| BCL11A-1950 | + | GGAGAGGGAGGGAGGGAGCC | 20 | 2435 |
| BCL11A-1951 | + | GAGCCCGGACUGCUGCCUCC | 20 | 2436 |
| BCL11A-1952 | + | AGCCCGGACUGCUGCCUCCU | 20 | 2437 |
| BCL11A-1953 | + | CCCUCCCGACCGAACCUCAG | 20 | 2438 |
| BCL11A-1954 | + | ACCGAACCUCAGAGGCAGCA | 20 | 2439 |
| BCL11A-1955 | + | AGAGGCAGCAAGGAGAAGAC | 20 | 2440 |
| BCL11A-1956 | + | AAAAUAAAAUAAAAUAAAACA | 20 | 2441 |
| BCL11A-1957 | − | UCUCCUUGCUGCCUCUG | 17 | 2442 |
| BCL11A-1958 | − | UUGCUGCCUCUGAGGUU | 17 | 2443 |
| BCL11A-1959 | − | UGCCUCUGAGGUUCGGU | 17 | 2444 |
| BCL11A-1960 | − | GCCUCUGAGGUUCGGUC | 17 | 2445 |
| BCL11A-1961 | − | UCUGAGGUUCGGUCGGG | 17 | 2446 |
| BCL11A-1962 | − | CUGAGGUUCGGUCGGGA | 17 | 2447 |
| BCL11A-1963 | − | UGAGGUUCGGUCGGGAG | 17 | 2448 |
| BCL11A-1964 | − | GGUUCGGUCGGGAGGGG | 17 | 2449 |
| BCL11A-1965 | − | GUUCGGUCGGGAGGGGA | 17 | 2450 |
| BCL11A-1966 | − | UCGGGAGGGGAGGGCAG | 17 | 2451 |
| BCL11A-1967 | − | GAGGGCAGCGGCAACCC | 17 | 2452 |
| BCL11A-1968 | − | GGCAGCGGCAACCCAGG | 17 | 2453 |
| BCL11A-1969 | − | CCCAGGAGGCAGCAGUC | 17 | 2454 |
| BCL11A-1970 | − | CCAGGAGGCAGCAGUCC | 17 | 2455 |
| BCL11A-1971 | − | CCUCUCCCGCGUGCCCC | 17 | 2456 |
| BCL11A-1972 | − | CCGGCCGCCUCCUCCCC | 17 | 2457 |
| BCL11A-1973 | − | CCCUAGCUCCUGCCCUU | 17 | 2458 |
| BCL11A-1974 | − | UAGCUCCUGCCCUUCGG | 17 | 2459 |
| BCL11A-1975 | − | CUCCUGCCCUUCGGCGG | 17 | 2460 |
| BCL11A-1976 | − | CUGCCCUUCGGCGGCGG | 17 | 2461 |
| BCL11A-1977 | − | CCCUUCGGCGGCGGCGG | 17 | 2462 |
| BCL11A-1978 | − | UUCGGCGGCGGCGGCGG | 17 | 2463 |
| BCL11A-1979 | − | GGCGGCGCGGCGGCGG | 17 | 2464 |
| BCL11A-1980 | − | CGGCGGCGGCGGCGGCG | 17 | 2465 |
| BCL11A-1981 | − | GGCGGCGGCGGCGGCGC | 17 | 2466 |
| BCL11A-1982 | − | GGCGGCGGCGGCGCGGG | 17 | 2467 |
| BCL11A-1983 | − | GCGGCGGCGGCGCGGGA | 17 | 2468 |
| BCL11A-1984 | − | GCGGGAGGGCAAGCGCG | 17 | 2469 |
| BCL11A-1985 | − | GGGCAAGCGCGAGGAGC | 17 | 2470 |
| BCL11A-1986 | − | CGAGGAGCCGGACACAAA | 17 | 2471 |
| BCL11A-1987 | − | GCCGGCACAAAAGGCAG | 17 | 2472 |
| BCL11A-1988 | − | CCGGCACAAAAGGCAGC | 17 | 2473 |
| BCL11A-1989 | − | GGACAAACACCCACCUC | 17 | 2474 |

TABLE 3A-continued

*S. pyogenes* gRNA targets for BCL11A knockdown

| gRNA Name | DNA Strand | Targeting Domain | Target Site Length | SEQ ID NO |
|---|---|---|---|---|
| BCL11A-1990 | - | AAACACCCACCUCUGGC | 17 | 2475 |
| BCL11A-1991 | - | CCUCUGGCCGGAACAAA | 17 | 2476 |
| BCL11A-1992 | - | CUGGCCGGAACAAAAGG | 17 | 2477 |
| BCL11A-1993 | - | ACAAAAGGCGGCAGUGC | 17 | 2478 |
| BCL11A-1994 | - | GCGUCUCCCGUCCUUCC | 17 | 2479 |
| BCL11A-1995 | - | CGUCCUUCCCGGUCCCA | 17 | 2480 |
| BCL11A-1996 | - | GGCUCUCCCCGUCGCCG | 17 | 2481 |
| BCL11A-1997 | - | CCCCUCUCCCGACUCCG | 17 | 2482 |
| BCL11A-1998 | - | CCCGACUCCGCGGACUC | 17 | 2483 |
| BCL11A-1999 | - | CGCGGACUCAGGAGCGC | 17 | 2484 |
| BCL11A-2000 | - | GCGGACUCAGGAGCGCC | 17 | 2485 |
| BCL11A-2001 | - | CGGACUCAGGAGCGCCG | 17 | 2486 |
| BCL11A-2002 | - | GGACUCAGGAGCGCCGG | 17 | 2487 |
| BCL11A-2003 | - | CCACUUUCUCACUAUUG | 17 | 2488 |
| BCL11A-2004 | - | CACUUUCUCACUAUUGU | 17 | 2489 |
| BCL11A-2005 | - | ACUUUCUCACUAUUGUG | 17 | 2490 |
| BCL11A-2006 | - | CUUGACCGUGAGCGCGC | 17 | 2491 |
| BCL11A-2007 | - | CUCACCUCUUUUCUCCC | 17 | 2492 |
| BCL11A-2008 | - | UCACCUCUUUUCUCCCC | 17 | 2493 |
| BCL11A-2009 | - | ACCCCCCCAUUUUCUUA | 17 | 2494 |
| BCL11A-2010 | - | CAUUUUCUUACGGUGAG | 17 | 2495 |
| BCL11A-2011 | - | AUUUUCUUACGGUGAGU | 17 | 2496 |
| BCL11A-2012 | - | CACCAGCUCCCACCCCC | 17 | 2497 |
| BCL11A-2013 | - | UCAUUAUUUGCAAAAC | 17 | 2498 |
| BCL11A-2014 | - | UUAUUUGCAAAACUGG | 17 | 2499 |
| BCL11A-2015 | - | UAUUUGCAAAACUGGC | 17 | 2500 |
| BCL11A-2016 | - | AUUUGCAAAACUGGCG | 17 | 2501 |
| BCL11A-2017 | - | UUGCAAAACUGGCGGGG | 17 | 2502 |
| BCL11A-2018 | - | UGCAAAACUGGCGGGGC | 17 | 2503 |
| BCL11A-2019 | - | GCAAAACUGGCGGGGCG | 17 | 2504 |
| BCL11A-2020 | - | CAAAACUGGCGGGGCGG | 17 | 2505 |
| BCL11A-2021 | - | AAAACUGGCGGGGCGGG | 17 | 2506 |
| BCL11A-2022 | - | AAACUGGCGGGGCGGGG | 17 | 2507 |
| BCL11A-2023 | - | AACUGGCGGGGCGGGGG | 17 | 2508 |
| BCL11A-2024 | - | GCGGGGCGGGGGGGAG | 17 | 2509 |
| BCL11A-2025 | - | CGAAAAGAGAAAUAAAG | 17 | 2510 |
| BCL11A-2026 | - | AAAGAGAAAUAAAGCGG | 17 | 2511 |
| BCL11A-2027 | - | GAAAUAAAGCGGCGGAA | 17 | 2512 |
| BCL11A-2028 | - | AUAAAGCGGCGGAAAGG | 17 | 2513 |
| BCL11A-2029 | - | GGCGGAAAGGAGGAAAG | 17 | 2514 |
| BCL11A-2030 | - | GGAAAGGAGGAAAGAGG | 17 | 2515 |
| BCL11A-2031 | - | AAUUAAAUAAAAUUAAA | 17 | 2516 |
| BCL11A-2032 | - | UCUCAAAAGUGCAUACA | 17 | 2517 |
| BCL11A-2033 | - | AAGUGCAUACACGGCAA | 17 | 2518 |
| BCL11A-2034 | - | ACGGCAAUGGUUCCAGA | 17 | 2519 |
| BCL11A-2035 | - | CGGCAAUGGUUCCAGAU | 17 | 2520 |
| BCL11A-2036 | - | UGGUUCCAGAUGGGAUG | 17 | 2521 |
| BCL11A-2037 | - | GGUUCCAGAUGGGAUGA | 17 | 2522 |
| BCL11A-2038 | - | UCUUUUACCUCGACUCU | 17 | 2523 |
| BCL11A-2039 | - | UUUACCUCGACUCUCGG | 17 | 2524 |
| BCL11A-2040 | - | AUUAUUAUUACUAUUAU | 17 | 2525 |
| BCL11A-2041 | - | UUAUUAUUACUAUUAUU | 17 | 2526 |
| BCL11A-2042 | + | UAAUCACGAGAGCGCGC | 17 | 2527 |
| BCL11A-2043 | + | GACUAGAAGCAAAAGCG | 17 | 2528 |
| BCL11A-2044 | + | ACUAGAAGCAAAAGCGA | 17 | 2529 |
| BCL11A-2045 | + | CUAGAAGCAAAAGCGAG | 17 | 2530 |
| BCL11A-2046 | + | UAGAAGCAAAAGCGAGG | 17 | 2531 |
| BCL11A-2047 | + | AAAAGCGAGGGGGAGAG | 17 | 2532 |
| BCL11A-2048 | + | AAAGCGAGGGGGAGAGA | 17 | 2533 |
| BCL11A-2049 | + | AAGCGAGGGGGAGAGAG | 17 | 2534 |
| BCL11A-2050 | + | AAAACCUCCGAGAGUCG | 17 | 2535 |
| BCL11A-2051 | + | CGAGGUAAAAGAGAUAA | 17 | 2536 |
| BCL11A-2052 | + | GAGGUAAAAGAGAUAAA | 17 | 2537 |
| BCL11A-2053 | + | AGGUAAAAGAGAUAAAG | 17 | 2538 |
| BCL11A-2054 | + | GGUAAAAGAGAUAAAGG | 17 | 2539 |
| BCL11A-2055 | + | AAAACCCUCAUCCCAUC | 17 | 2540 |
| BCL11A-2056 | + | UAUUUCUCUUUUCGAAA | 17 | 2541 |
| BCL11A-2057 | + | AAUAAUGAACAAUGCUA | 17 | 2542 |
| BCL11A-2058 | + | CAACUCACAUGCAAACC | 17 | 2543 |
| BCL11A-2059 | + | AACUCACAUGCAAACCU | 17 | 2544 |
| BCL11A-2060 | + | ACUCACAUGCAAACCUG | 17 | 2545 |
| BCL11A-2061 | + | CUCACAUGCAAACCUGG | 17 | 2546 |
| BCL11A-2062 | + | ACAUGCAAACCUGGGGG | 17 | 2547 |
| BCL11A-2063 | + | CAUGCAAACCUGGGGGU | 17 | 2548 |

TABLE 3A-continued

S. pyogenes gRNA targets for BCL11A knockdown

| gRNA Name | DNA Strand | Targeting Domain | Target Site Length | SEQ ID NO |
|---|---|---|---|---|
| BCL11A-2064 | + | AACCUGGGGGUGGGAGC | 17 | 2549 |
| BCL11A-2065 | + | CUGGGGGUGGGAGCUGG | 17 | 2550 |
| BCL11A-2066 | + | UGGGGGUGGGAGCUGGU | 17 | 2551 |
| BCL11A-2067 | + | GGGGGUGGGAGCUGGUG | 17 | 2552 |
| BCL11A-2068 | + | UGGGAGCUGGUGGGGAA | 17 | 2553 |
| BCL11A-2069 | + | GGGAGCUGGUGGGGAAA | 17 | 2554 |
| BCL11A-2070 | + | AGCUGGUGGGGAAAGGG | 17 | 2555 |
| BCL11A-2071 | + | CACUCACCGUAAGAAAA | 17 | 2556 |
| BCL11A-2072 | + | ACUCACCGUAAGAAAAU | 17 | 2557 |
| BCL11A-2073 | + | CUCACCGUAAGAAAAUG | 17 | 2558 |
| BCL11A-2074 | + | UCACCGUAAGAAAAUGG | 17 | 2559 |
| BCL11A-2075 | + | CACCGUAAGAAAAUGGG | 17 | 2560 |
| BCL11A-2076 | + | ACCGUAAGAAAAUGGGG | 17 | 2561 |
| BCL11A-2077 | + | UAAGAAAAUGGGGGGU | 17 | 2562 |
| BCL11A-2078 | + | AAGAAAAUGGGGGGUA | 17 | 2563 |
| BCL11A-2079 | + | AAAAUGGGGGGUAGGG | 17 | 2564 |
| BCL11A-2080 | + | AAAUGGGGGGUAGGGA | 17 | 2565 |
| BCL11A-2081 | + | GUCUAAAAACGAUUCC | 17 | 2566 |
| BCL11A-2082 | + | UCUAAAAACGAUUCCC | 17 | 2567 |
| BCL11A-2083 | + | CUAAAAACGAUUCCCG | 17 | 2568 |
| BCL11A-2084 | + | AUUCCGGGGAGAAAAG | 17 | 2569 |
| BCL11A-2085 | + | GAGAAAAGAGGUGAGAC | 17 | 2570 |
| BCL11A-2086 | + | GAGGUGAGACUGGCUUU | 17 | 2571 |
| BCL11A-2087 | + | GGACACCAGCGCGCUCA | 17 | 2572 |
| BCL11A-2088 | + | CACGGUCAAGUGUGCAG | 17 | 2573 |
| BCL11A-2089 | + | ACGGUCAAGUGUGCAGC | 17 | 2574 |
| BCL11A-2090 | + | GUCAAGUGUGCAGCGGG | 17 | 2575 |
| BCL11A-2091 | + | CCACAAUAGUGAGAAAG | 17 | 2576 |
| BCL11A-2092 | + | GUGAGAAAGUGGCACUG | 17 | 2577 |
| BCL11A-2093 | + | AAAGUGGCACUGUGGAA | 17 | 2578 |
| BCL11A-2094 | + | AAGUGGCACUGUGGAAA | 17 | 2579 |
| BCL11A-2095 | + | AGUGGCACUGUGGAAAG | 17 | 2580 |
| BCL11A-2096 | + | CUGUGGAAAGGGGCCCC | 17 | 2581 |
| BCL11A-2097 | + | CGGCGCUCCUGAGUCCG | 17 | 2582 |
| BCL11A-2098 | + | UCCUGAGUCCGCGGAGU | 17 | 2583 |
| BCL11A-2099 | + | CCUGAGUCCGCGGAGUC | 17 | 2584 |
| BCL11A-2100 | + | GUCCGCGGAGUCGGGAG | 17 | 2585 |
| BCL11A-2101 | + | UCCGCGGAGUCGGGAGA | 17 | 2586 |
| BCL11A-2102 | + | CCGCGGAGUCGGGAGAG | 17 | 2587 |
| BCL11A-2103 | + | AGUCGGGAGAGGGGCCG | 17 | 2588 |
| BCL11A-2104 | + | GAGAGGGGCCGCGGCGA | 17 | 2589 |
| BCL11A-2105 | + | AGAGGGGCCGCGGCGAC | 17 | 2590 |
| BCL11A-2106 | + | GAGGGGCCGCGGCGACG | 17 | 2591 |
| BCL11A-2107 | + | GGCGACGGGGAGAGCCG | 17 | 2592 |
| BCL11A-2108 | + | GCGACGGGGAGAGCCGU | 17 | 2593 |
| BCL11A-2109 | + | GGGGAGAGCCGUGGGAC | 17 | 2594 |
| BCL11A-2110 | + | GGGAGAGCCGUGGGACC | 17 | 2595 |
| BCL11A-2111 | + | GAGCCGUGGGACCGGGA | 17 | 2596 |
| BCL11A-2112 | + | CGUGGGACCGGGAAGGA | 17 | 2597 |
| BCL11A-2113 | + | GUGGGACCGGGAAGGAC | 17 | 2598 |
| BCL11A-2114 | + | GGGAAGGACGGGAGACG | 17 | 2599 |
| BCL11A-2115 | + | AGGACGGGAGACGCGGC | 17 | 2600 |
| BCL11A-2116 | + | ACUGCCGCCUUUUGUUC | 17 | 2601 |
| BCL11A-2117 | + | CCUUUUGUUCCGGCCAG | 17 | 2602 |
| BCL11A-2118 | + | UUUGUUCCGGCCAGAGG | 17 | 2603 |
| BCL11A-2119 | + | UUGUUCCGGCCAGAGGU | 17 | 2604 |
| BCL11A-2120 | + | CCCGCUGCCUUUUGUGC | 17 | 2605 |
| BCL11A-2121 | + | GCCGCCGCCGCCGCCGA | 17 | 2606 |
| BCL11A-2122 | + | CCGCCGCCGCCGCCGAA | 17 | 2607 |
| BCL11A-2123 | + | CGCCGCCGCCGAAGGGC | 17 | 2608 |
| BCL11A-2124 | + | GCCGAAGGGCAGGAGCU | 17 | 2609 |
| BCL11A-2125 | + | CCGAAGGGCAGGAGCUA | 17 | 2610 |
| BCL11A-2126 | + | AGGGCAGGAGCUAGGGC | 17 | 2611 |
| BCL11A-2127 | + | GGGCAGGAGCUAGGGCC | 17 | 2612 |
| BCL11A-2128 | + | GGCAGGAGCUAGGGCCG | 17 | 2613 |
| BCL11A-2129 | + | GCAGGAGCUAGGGCCGG | 17 | 2614 |
| BCL11A-2130 | + | GGAGCUAGGGCCGGGGG | 17 | 2615 |
| BCL11A-2131 | + | GCUAGGGCCGGGGAGG | 17 | 2616 |
| BCL11A-2132 | + | AGGGCCGGGGAGGAGG | 17 | 2617 |
| BCL11A-2133 | + | CCGGGGAGGAGGCGGC | 17 | 2618 |
| BCL11A-2134 | + | CGGGGAGGAGGCGGCC | 17 | 2619 |
| BCL11A-2135 | + | GGGGAGGAGGCGGCCG | 17 | 2620 |
| BCL11A-2136 | + | GGGAGGAGGCGGCCGG | 17 | 2621 |
| BCL11A-2137 | + | AGGCGGCCGGGGGCACG | 17 | 2622 |

TABLE 3A-continued

S. pyogenes gRNA targets for BCL11A knockdown

| gRNA Name | DNA Strand | Targeting Domain | Target Site Length | SEQ ID NO |
|---|---|---|---|---|
| BCL11A-2138 | + | GGCGGCCGGGGGCACGC | 17 | 2623 |
| BCL11A-2139 | + | CCGGGGGCACGCGGGAG | 17 | 2624 |
| BCL11A-2140 | + | CGGGGGCACGCGGGAGA | 17 | 2625 |
| BCL11A-2141 | + | GGGCACGCGGGAGAGGG | 17 | 2626 |
| BCL11A-2142 | + | GGCACGCGGGAGAGGGA | 17 | 2627 |
| BCL11A-2143 | + | ACGCGGGAGAGGGAGGG | 17 | 2628 |
| BCL11A-2144 | + | CGCGGGAGAGGGAGGGA | 17 | 2629 |
| BCL11A-2145 | + | GAGGGAGGGAGGGAGCC | 17 | 2630 |
| BCL11A-2146 | + | CCCGGACUGCUGCCUCC | 17 | 2631 |
| BCL11A-2147 | + | CCGGACUGCUGCCUCCU | 17 | 2632 |
| BCL11A-2148 | + | UCCCGACCGAACCUCAG | 17 | 2633 |
| BCL11A-2149 | + | GAACCUCAGAGGCAGCA | 17 | 2634 |
| BCL11A-2150 | + | GGCAGCAAGGAGAAGAC | 17 | 2635 |
| BCL11A-2151 | + | AUAAAAUAAAUAAAACA | 17 | 2636 |

Table 3B provides exemplary targeting domains for repressing (i.e., knocking down or decreasing) expression of the BCL11A gene. Any of the targeting domains in the table can be used with a S. aureus eiCas9 molecule to cause a steric block in the promoter region to block transcription elongation resulting in the repression of the BCL11A gene. Any of the targeting domains in the table can be used with a S. aureus eiCas9 fused to a transcriptional repressor to decrease transcription and therefore downregulate gene expression.

TABLE 3B

S. aureus gRNA targets for BCL11A knockdown

| gRNA Name | DNA Strand | Targeting Domain | Target Site Length | SEQ ID NO |
|---|---|---|---|---|
| BCL11A-2152 | − | CAGUCUUCUCCUUGCUGCCU | 20 | 2637 |
| BCL11A-2153 | − | UUGCUGCCUCUGAGGUUCGG | 20 | 2638 |
| BCL11A-2154 | − | UGCUGCCUCUGAGGUUCGGU | 20 | 2639 |
| BCL11A-2155 | − | GCUGCCUCUGAGGUUCGGUC | 20 | 2640 |
| BCL11A-2156 | − | UGCCUCUGAGGUUCGGUCGG | 20 | 2641 |
| BCL11A-2157 | − | GCCUCUGAGGUUCGGUCGGG | 20 | 2642 |
| BCL11A-2158 | − | CCUCUGAGGUUCGGUCGGGA | 20 | 2643 |
| BCL11A-2159 | − | CUCUGAGGUUCGGUCGGGAG | 20 | 2644 |
| BCL11A-2160 | − | CUGAGGUUCGGUCGGGAGGG | 20 | 2645 |
| BCL11A-2161 | − | AGGGGAGGGCAGCGGCAACC | 20 | 2646 |
| BCL11A-2162 | − | GGGGAGGGCAGCGGCAACCC | 20 | 2647 |
| BCL11A-2163 | − | GCAACCCAGGAGGCAGCAGU | 20 | 2648 |
| BCL11A-2164 | − | GCGGCGGCGGCGGCGGCGGC | 20 | 2649 |
| BCL11A-2165 | − | CGGCGGCGGCGGCGGCGGCG | 20 | 2650 |
| BCL11A-2166 | − | GGCGGCGGCGGCGGCGGCGC | 20 | 2651 |
| BCL11A-2167 | − | CGGCGGCGGCGGCGGCGCGG | 20 | 2652 |
| BCL11A-2168 | − | GGCGGCGCGGGAGGGCAAGC | 20 | 2653 |
| BCL11A-2169 | − | CGGCGCGGGAGGGCAAGCGC | 20 | 2654 |
| BCL11A-2170 | − | GGCGCGGGAGGGCAAGCGCG | 20 | 2655 |
| BCL11A-2171 | − | AGGAGCCGGCACAAAAGGCA | 20 | 2656 |
| BCL11A-2172 | − | GGAGCCGGCACAAAAGGCAG | 20 | 2657 |
| BCL11A-2173 | − | GGACAAACACCCACCUCUGG | 20 | 2658 |
| BCL11A-2174 | − | GACAAACACCCACCUCUGGC | 20 | 2659 |
| BCL11A-2175 | − | GCGGCCCCUCUCCCGACUCC | 20 | 2660 |
| BCL11A-2176 | − | CUCUCCCGACUCCGCGGACU | 20 | 2661 |
| BCL11A-2177 | − | UCUCCCGACUCCGCGGACUC | 20 | 2662 |
| BCL11A-2178 | − | ACUCCGCGGACUCAGGAGCG | 20 | 2663 |
| BCL11A-2179 | − | CUCCGCGGACUCAGGAGCGC | 20 | 2664 |
| BCL11A-2180 | − | UCCGCGGACUCAGGAGCGCC | 20 | 2665 |
| BCL11A-2181 | − | AGUGCCACUUUCUCACUAUU | 20 | 2666 |
| BCL11A-2182 | − | GUGCCACUUUCUCACUAUUG | 20 | 2667 |
| BCL11A-2183 | − | UGCCACUUUCUCACUAUUGU | 20 | 2668 |
| BCL11A-2184 | − | CUCCCGCUGCACACUUGACC | 20 | 2669 |
| BCL11A-2185 | − | CAGUCUCACCUCUUUUCUCC | 20 | 2670 |
| BCL11A-2186 | − | AGUCUCACCUCUUUUCUCCC | 20 | 2671 |
| BCL11A-2187 | − | GUCUCACCUCUUUUCUCCCC | 20 | 2672 |
| BCL11A-2188 | − | UACCCCCCAUUUUCUUACG | 20 | 2673 |
| BCL11A-2189 | − | CCCCCAUUUUCUUACGGUGA | 20 | 2674 |
| BCL11A-2190 | − | CCCCAUUUUCUUACGGUGAG | 20 | 2675 |
| BCL11A-2191 | − | CCCAUUUUCUUACGGUGAGU | 20 | 2676 |
| BCL11A-2192 | − | UCCCACCCCCAGGUUUGCAU | 20 | 2677 |
| BCL11A-2193 | − | UUCAUUAUUUGCAAAACUG | 20 | 2678 |
| BCL11A-2194 | − | UCAUUAUUUGCAAAACUGG | 20 | 2679 |
| BCL11A-2195 | − | UAUUUGCAAAACUGGCGGG | 20 | 2680 |
| BCL11A-2196 | − | AUUUGCAAAACUGGCGGGG | 20 | 2681 |
| BCL11A-2197 | − | UUUUGCAAAACUGGCGGGGC | 20 | 2682 |
| BCL11A-2198 | − | UUUGCAAAACUGGCGGGGCG | 20 | 2683 |
| BCL11A-2199 | − | UUGCAAAACUGGCGGGGCGG | 20 | 2684 |

TABLE 3B-continued

S. aureus gRNA targets for BCL11A knockdown

| gRNA Name | DNA Strand | Targeting Domain | Target Site Length | SEQ ID NO |
|---|---|---|---|---|
| BCL11A-2200 | - | UGCAAAACUGGCGGGGCGGG | 20 | 2685 |
| BCL11A-2201 | - | GCAAAACUGGCGGGGCGGGG | 20 | 2686 |
| BCL11A-2202 | - | CAAAACUGGCGGGGCGGGGG | 20 | 2687 |
| BCL11A-2203 | - | ACUGGCGGGGCGGGGGGGA | 20 | 2688 |
| BCL11A-2204 | - | CUGGCGGGGCGGGGGGGAG | 20 | 2689 |
| BCL11A-2205 | - | UGGAAUCAUUGCAUUCCUUU | 20 | 2690 |
| BCL11A-2206 | - | UCAUUGCAUUCCUUUUCGAA | 20 | 2691 |
| BCL11A-2207 | - | AUUGCAUUCCUUUUCGAAAA | 20 | 2692 |
| BCL11A-2208 | - | UCGAAAGAGAAAUAAAGCG | 20 | 2693 |
| BCL11A-2209 | - | CGAAAAGAGAAAUAAAGCGG | 20 | 2694 |
| BCL11A-2210 | - | AAGAGAAAUAAAGCGGCGGA | 20 | 2695 |
| BCL11A-2211 | - | AGAGAAAUAAAGCGGCGGAA | 20 | 2696 |
| BCL11A-2212 | - | AGAAAUAAAGCGGCGGAAAG | 20 | 2697 |
| BCL11A-2213 | - | GAAAUAAAGCGGCGGAAAGG | 20 | 2698 |
| BCL11A-2214 | - | UAAAGCGGCGGAAAGGAGGA | 20 | 2699 |
| BCL11A-2215 | - | AAGCGGCGGAAAGGAGGAAA | 20 | 2700 |
| BCL11A-2216 | - | AGCGGCGGAAAGGAGGAAAG | 20 | 2701 |
| BCL11A-2217 | - | CGGCGGAAAGGAGGAAAGAG | 20 | 2702 |
| BCL11A-2218 | - | GGCGGAAAGGAGGAAAGAGG | 20 | 2703 |
| BCL11A-2219 | - | AUACACGGCAAUGGUUCCAG | 20 | 2704 |
| BCL11A-2220 | - | UACACGGCAAUGGUUCCAGA | 20 | 2705 |
| BCL11A-2221 | - | CGGCAAUGGUUCCAGAUGGG | 20 | 2706 |
| BCL11A-2222 | - | GCAAUGGUUCCAGAUGGGAU | 20 | 2707 |
| BCL11A-2223 | - | UAUCUCUUUUACCUCGACUC | 20 | 2708 |
| BCL11A-2224 | - | AUCUCUUUUACCUCGACUCU | 20 | 2709 |
| BCL11A-2225 | - | GACUCUCGGAGGUUUUUCUC | 20 | 2710 |
| BCL11A-2226 | - | AAUAAUUAUUAUUACUAUUA | 20 | 2711 |
| BCL11A-2227 | - | ACUAUUAUUGGGUUACUUAC | 20 | 2712 |
| BCL11A-2228 | - | UAUUAUUGGGUUACUUACGC | 20 | 2713 |
| BCL11A-2229 | - | UCUUCUCCUUGCUGCCU | 17 | 2714 |
| BCL11A-2230 | - | CUGCCUCUGAGGUUCGG | 17 | 2715 |
| BCL11A-2231 | - | UGCCUCUGAGGUUCGGU | 17 | 2716 |
| BCL11A-2232 | - | GCCUCUGAGGUUCGGUC | 17 | 2717 |
| BCL11A-2233 | - | CUCUGAGGUUCGGUCGG | 17 | 2718 |
| BCL11A-2234 | - | UCUGAGGUUCGGUCGGG | 17 | 2719 |
| BCL11A-2235 | - | CUGAGGUUCGGUCGGGA | 17 | 2720 |
| BCL11A-2236 | - | UGAGGUUCGGUCGGGAG | 17 | 2721 |
| BCL11A-2237 | - | AGGUUCGGUCGGGAGGG | 17 | 2722 |
| BCL11A-2238 | - | GGAGGGCAGCGGCAACC | 17 | 2723 |
| BCL11A-2239 | - | GAGGGCAGCGGCAACCC | 17 | 2724 |
| BCL11A-2240 | - | ACCCAGGAGGCAGCAGU | 17 | 2725 |
| BCL11A-2241 | - | GCGGCGGCGGCGGCGGC | 17 | 2726 |
| BCL11A-2242 | - | CGGCGGCGGCGGCGGCG | 17 | 2727 |
| BCL11A-2243 | - | GGCGGCGGCGGCGGCGC | 17 | 2728 |
| BCL11A-2244 | - | CGGCGGCGGCGGCGCGG | 17 | 2729 |
| BCL11A-2245 | - | GGCGCGGGAGGGCAAGC | 17 | 2730 |
| BCL11A-2246 | - | CGCGGGAGGGCAAGCGC | 17 | 2731 |
| BCL11A-2247 | - | GCGGGAGGGCAAGCGCG | 17 | 2732 |
| BCL11A-2248 | - | AGCCGGCACAAAAGGCA | 17 | 2733 |
| BCL11A-2249 | - | GCCGGCACAAAAGGCAG | 17 | 2734 |
| BCL11A-2250 | - | CAAACACCCACCUCUGG | 17 | 2735 |
| BCL11A-2251 | - | AAACACCCACCUCUGGC | 17 | 2736 |
| BCL11A-2252 | - | GCCCCUCUCCCGACUCC | 17 | 2737 |
| BCL11A-2253 | - | UCCCGACUCCGCGGACU | 17 | 2738 |
| BCL11A-2254 | - | CCCGACUCCGCGGACUC | 17 | 2739 |
| BCL11A-2255 | - | CCGCGGACUCAGGAGCG | 17 | 2740 |
| BCL11A-2256 | - | CGCGGACUCAGGAGCGC | 17 | 2741 |
| BCL11A-2257 | - | GCGGACUCAGGAGCGCC | 17 | 2742 |
| BCL11A-2258 | - | GCCACUUUCUCACUAUU | 17 | 2743 |
| BCL11A-2259 | - | CCACUUUCUCACUAUUG | 17 | 2744 |
| BCL11A-2260 | - | CACUUUCUCACUAUUGU | 17 | 2745 |
| BCL11A-2261 | - | CCGCUGCACACUUGACC | 17 | 2746 |
| BCL11A-2262 | - | UCUCACCUCUUUUCUCC | 17 | 2747 |
| BCL11A-2263 | - | CUCACCUCUUUUCUCCC | 17 | 2748 |
| BCL11A-2264 | - | UCACCUCUUUUCUCCCC | 17 | 2749 |
| BCL11A-2265 | - | CCCCCCAUUUUCUUACG | 17 | 2750 |
| BCL11A-2266 | - | CCAUUUUCUUACGGUGA | 17 | 2751 |
| BCL11A-2267 | - | CAUUUUCUUACGGUGAG | 17 | 2752 |
| BCL11A-2268 | - | AUUUUCUUACGGUGAGU | 17 | 2753 |
| BCL11A-2269 | - | CACCCCCAGGUUUGCAU | 17 | 2754 |
| BCL11A-2270 | - | AUUAUUUGCAAAACUG | 17 | 2755 |
| BCL11A-2271 | - | UUAUUUGCAAAACUGG | 17 | 2756 |
| BCL11A-2272 | - | UUUGCAAAACUGGCGGG | 17 | 2757 |
| BCL11A-2273 | - | UUGCAAAACUGGCGGGG | 17 | 2758 |

TABLE 3B-continued

*S. aureus* gRNA targets for BCL11A knockdown

| gRNA Name | DNA Strand | Targeting Domain | Target Site Length | SEQ ID NO |
|---|---|---|---|---|
| BCL11A-2274 | − | UGCAAAACUGGCGGGGC | 17 | 2759 |
| BCL11A-2275 | − | GCAAAACUGGCGGGGCG | 17 | 2760 |
| BCL11A-2276 | − | CAAAACUGGCGGGGCGG | 17 | 2761 |
| BCL11A-2277 | − | AAAACUGGCGGGGCGGG | 17 | 2762 |
| BCL11A-2278 | − | AAACUGGCGGGGCGGGG | 17 | 2763 |
| BCL11A-2279 | − | AACUGGCGGGGCGGGGG | 17 | 2764 |
| BCL11A-2280 | − | GGCGGGGCGGGGGGGA | 17 | 2765 |
| BCL11A-2281 | − | GCGGGGCGGGGGGGAG | 17 | 2766 |
| BCL11A-2282 | − | AAUCAUUGCAUUCCUUU | 17 | 2767 |
| BCL11A-2283 | − | UUGCAUUCCUUUUCGAA | 17 | 2768 |
| BCL11A-2284 | − | GCAUUCCUUUUCGAAAA | 17 | 2769 |
| BCL11A-2285 | − | AAAAGAGAAAUAAAGCG | 17 | 2770 |
| BCL11A-2286 | − | AAAGAGAAAUAAAGCGG | 17 | 2771 |
| BCL11A-2287 | − | AGAAAUAAAGCGGCGGA | 17 | 2772 |
| BCL11A-2288 | − | GAAAUAAAGCGGCGGAA | 17 | 2773 |
| BCL11A-2289 | − | AAUAAAGCGGCGGAAAG | 17 | 2774 |
| BCL11A-2290 | − | AUAAAGCGGCGGAAAGG | 17 | 2775 |
| BCL11A-2291 | − | AGCGGCGGAAAGGAGGA | 17 | 2776 |
| BCL11A-2292 | − | CGGCGGAAAGGAGGAAA | 17 | 2777 |
| BCL11A-2293 | − | GGCGGAAAGGAGGAAAG | 17 | 2778 |
| BCL11A-2294 | − | CGGAAAGGAGGAAAGAG | 17 | 2779 |
| BCL11A-2295 | − | GGAAAGGAGGAAAGAGG | 17 | 2780 |
| BCL11A-2296 | − | CACGGCAAUGGUUCCAG | 17 | 2781 |
| BCL11A-2297 | − | ACGGCAAUGGUUCCAGA | 17 | 2782 |
| BCL11A-2298 | − | CAAUGGUUCCAGAUGGG | 17 | 2783 |
| BCL11A-2299 | − | AUGGUUCCAGAUGGGAU | 17 | 2784 |
| BCL11A-2300 | − | CUCUUUUACCUCGACUC | 17 | 2785 |
| BCL11A-2301 | − | UCUUUUACCUCGACUCU | 17 | 2786 |
| BCL11A-2302 | − | UCUCGGAGGUUUUUCUC | 17 | 2787 |
| BCL11A-2303 | − | AAUUAUUAUUACUAUUA | 17 | 2788 |
| BCL11A-2304 | − | AUUAUUGGGUUACUUAC | 17 | 2789 |
| BCL11A-2305 | − | UAUUGGGUUACUUACGC | 17 | 2790 |
| BCL11A-2306 | + | CGAACCUCAGAGGCAGCAAG | 20 | 2791 |
| BCL11A-2307 | + | ACCGAACCUCAGAGGCAGCA | 20 | 2792 |
| BCL11A-2308 | + | GACCGAACCUCAGAGGCAGC | 20 | 2793 |
| BCL11A-2309 | + | CUCCCCUCCCGACCGAACCU | 20 | 2794 |
| BCL11A-2310 | + | CCGCUGCCCUCCCCUCCCGA | 20 | 2795 |
| BCL11A-2311 | + | GGAGCCCGGACUGCUGCCUC | 20 | 2796 |
| BCL11A-2312 | + | GGGAGAGGGAGGGAGGGAGC | 20 | 2797 |
| BCL11A-2313 | + | GCACGCGGGAGAGGGAGGGA | 20 | 2798 |
| BCL11A-2314 | + | GGCACGCGGGAGAGGGAGGG | 20 | 2799 |
| BCL11A-2315 | + | GGGCACGCGGGAGAGGGAGG | 20 | 2800 |
| BCL11A-2316 | + | GGGGGCACGCGGGAGAGGGA | 20 | 2801 |
| BCL11A-2317 | + | CGGGGGCACGCGGGAGAGGG | 20 | 2802 |
| BCL11A-2318 | + | CCGGGGGCACGCGGGAGAGG | 20 | 2803 |
| BCL11A-2319 | + | GGCCGGGGGCACGCGGGAGA | 20 | 2804 |
| BCL11A-2320 | + | CGGCCGGGGGCACGCGGGAG | 20 | 2805 |
| BCL11A-2321 | + | GCGGCCGGGGGCACGCGGGA | 20 | 2806 |
| BCL11A-2322 | + | AGGCGGCCGGGGGCACGCGG | 20 | 2807 |
| BCL11A-2323 | + | GGAGGCGGCCGGGGGCACGC | 20 | 2808 |
| BCL11A-2324 | + | AGGAGGCGGCCGGGGGCACG | 20 | 2809 |
| BCL11A-2325 | + | GAGGAGGCGGCCGGGGGCAC | 20 | 2810 |
| BCL11A-2326 | + | GGCCGGGGAGGAGGCGGCC | 20 | 2811 |
| BCL11A-2327 | + | GGGCCGGGGAGGAGGCGGC | 20 | 2812 |
| BCL11A-2328 | + | AGGGCCGGGGAGGAGGCGG | 20 | 2813 |
| BCL11A-2329 | + | GCAGGAGCUAGGGCCGGGG | 20 | 2814 |
| BCL11A-2330 | + | GGCAGGAGCUAGGGCCGGG | 20 | 2815 |
| BCL11A-2331 | + | AGGGCAGGAGCUAGGGCCGG | 20 | 2816 |
| BCL11A-2332 | + | AAGGGCAGGAGCUAGGGCCG | 20 | 2817 |
| BCL11A-2333 | + | GAAGGGCAGGAGCUAGGGCC | 20 | 2818 |
| BCL11A-2334 | + | CGAAGGGCAGGAGCUAGGGC | 20 | 2819 |
| BCL11A-2335 | + | CCGAAGGGCAGGAGCUAGGG | 20 | 2820 |
| BCL11A-2336 | + | CGCCGCCGAAGGGCAGGAGC | 20 | 2821 |
| BCL11A-2337 | + | CGCCGCCGCCGCCGAAGGGC | 20 | 2822 |
| BCL11A-2338 | + | CCGCCGCCGCCGCCGAAGGG | 20 | 2823 |
| BCL11A-2339 | + | CGCCGCCGCCGCCGCCGCCG | 20 | 2824 |
| BCL11A-2340 | + | CGCCGCCGCCGCCGCCGCCG | 20 | 2825 |
| BCL11A-2341 | + | GCCUUUGUUCCGGCCAGAG | 20 | 2826 |
| BCL11A-2342 | + | CUGCCGCCUUUUGUUCCGGC | 20 | 2827 |
| BCL11A-2343 | + | GCCGUGGGACCGGGAAGGAC | 20 | 2828 |
| BCL11A-2344 | + | AGCCGUGGGACCGGGAAGGA | 20 | 2829 |
| BCL11A-2345 | + | GAGCCGUGGGACCGGGAAGG | 20 | 2830 |
| BCL11A-2346 | + | GGGAGAGCCGUGGGACCGGG | 20 | 2831 |
| BCL11A-2347 | + | ACGGGGAGAGCCGUGGGACC | 20 | 2832 |

TABLE 3B-continued

S. aureus gRNA targets for BCL11A knockdown

| gRNA Name | DNA Strand | Targeting Domain | Target Site Length | SEQ ID NO |
|---|---|---|---|---|
| BCL11A-2348 | + | GACGGGGAGAGCCGUGGGAC | 20 | 2833 |
| BCL11A-2349 | + | CGACGGGGAGAGCCGUGGGA | 20 | 2834 |
| BCL11A-2350 | + | CGCGGCGACGGGGAGAGCCG | 20 | 2835 |
| BCL11A-2351 | + | CCGCGGCGACGGGGAGAGCC | 20 | 2836 |
| BCL11A-2352 | + | AGAGGGCCGCGGCGACGGG | 20 | 2837 |
| BCL11A-2353 | + | GGAGAGGGGCCGCGGCGACG | 20 | 2838 |
| BCL11A-2354 | + | GGGAGAGGGGCCGCGGCGAC | 20 | 2839 |
| BCL11A-2355 | + | CGGGAGAGGGGCCGCGGCGA | 20 | 2840 |
| BCL11A-2356 | + | UCGGGAGAGGGGCCGCGGCG | 20 | 2841 |
| BCL11A-2357 | + | UGAGUCCGCGGAGUCGGGAG | 20 | 2842 |
| BCL11A-2358 | + | CUGAGUCCGCGGAGUCGGGA | 20 | 2843 |
| BCL11A-2359 | + | UCCUGAGUCCGCGGAGUCGG | 20 | 2844 |
| BCL11A-2360 | + | GCUCCUGAGUCCGCGGAGUC | 20 | 2845 |
| BCL11A-2361 | + | CGCUCCUGAGUCCGCGGAGU | 20 | 2846 |
| BCL11A-2362 | + | GCGCUCCUGAGUCCGCGGAG | 20 | 2847 |
| BCL11A-2363 | + | CCCCGGCGCUCCUGAGUCCG | 20 | 2848 |
| BCL11A-2364 | + | CCCCCGGCGCUCCUGAGUCC | 20 | 2849 |
| BCL11A-2365 | + | GAAAGGGGCCCCCGGCGCUC | 20 | 2850 |
| BCL11A-2366 | + | GAGAAAGUGGCACUGUGGAA | 20 | 2851 |
| BCL11A-2367 | + | UGAGAAAGUGGCACUGUGGA | 20 | 2852 |
| BCL11A-2368 | + | AUAGUGAGAAAGUGGCACUG | 20 | 2853 |
| BCL11A-2369 | + | AAUAGUGAGAAAGUGGCACU | 20 | 2854 |
| BCL11A-2370 | + | GUAGUCAUCCCCACAAUAGU | 20 | 2855 |
| BCL11A-2371 | + | AAGUAGUCAUCCCCACAAUA | 20 | 2856 |
| BCL11A-2372 | + | ACGGUCAAGUGUGCAGCGGG | 20 | 2857 |
| BCL11A-2373 | + | CACGGUCAAGUGUGCAGCGG | 20 | 2858 |
| BCL11A-2374 | + | CUCACGGUCAAGUGUGCAGC | 20 | 2859 |
| BCL11A-2375 | + | GCUCACGGUCAAGUGUGCAG | 20 | 2860 |
| BCL11A-2376 | + | CGCUCACGGUCAAGUGUGCA | 20 | 2861 |
| BCL11A-2377 | + | AAAAGAGGUGAGACUGGCUU | 20 | 2862 |
| BCL11A-2378 | + | GAUUCCCGGGGAGAAAAGAG | 20 | 2863 |
| BCL11A-2379 | + | AAAACGAUUCCCGGGGAGAA | 20 | 2864 |
| BCL11A-2380 | + | UCUAAAAACGAUUCCCGGG | 20 | 2865 |
| BCL11A-2381 | + | AGUCUAAAAACGAUUCCCG | 20 | 2866 |
| BCL11A-2382 | + | AAGUCUAAAAACGAUUCCC | 20 | 2867 |
| BCL11A-2383 | + | CAAGUCUAAAAACGAUUCC | 20 | 2868 |
| BCL11A-2384 | + | ACAAGUCUAAAAACGAUUC | 20 | 2869 |
| BCL11A-2385 | + | AAUGGGGGGUAGGGAGGGA | 20 | 2870 |
| BCL11A-2386 | + | AGAAAAUGGGGGGUAGGGA | 20 | 2871 |
| BCL11A-2387 | + | AAGAAAAUGGGGGGUAGGG | 20 | 2872 |
| BCL11A-2388 | + | UAAGAAAAUGGGGGGUAGG | 20 | 2873 |
| BCL11A-2389 | + | CGUAAGAAAAUGGGGGGUA | 20 | 2874 |
| BCL11A-2390 | + | CCGUAAGAAAAUGGGGGGU | 20 | 2875 |
| BCL11A-2391 | + | ACCGUAAGAAAAUGGGGGG | 20 | 2876 |
| BCL11A-2392 | + | CACUCACCGUAAGAAAAUGG | 20 | 2877 |
| BCL11A-2393 | + | CCACUCACCGUAAGAAAAUG | 20 | 2878 |
| BCL11A-2394 | + | CCCACUCACCGUAAGAAAAU | 20 | 2879 |
| BCL11A-2395 | + | UCCCACUCACCGUAAGAAAA | 20 | 2880 |
| BCL11A-2396 | + | UUCCCACUCACCGUAAGAAA | 20 | 2881 |
| BCL11A-2397 | + | GGUUGCUUCCCACUCACCGU | 20 | 2882 |
| BCL11A-2398 | + | GGUGGGAGCUGGUGGGGAAA | 20 | 2883 |
| BCL11A-2399 | + | GGGUGGGAGCUGGUGGGGAA | 20 | 2884 |
| BCL11A-2400 | + | GGGGUGGGAGCUGGUGGGGA | 20 | 2885 |
| BCL11A-2401 | + | CCUGGGGGUGGGAGCUGGUG | 20 | 2886 |
| BCL11A-2402 | + | ACCUGGGGGUGGGAGCUGGU | 20 | 2887 |
| BCL11A-2403 | + | AACCUGGGGGUGGGAGCUGG | 20 | 2888 |
| BCL11A-2404 | + | AAACCUGGGGGUGGGAGCUG | 20 | 2889 |
| BCL11A-2405 | + | UCACAUGCAAACCUGGGGGU | 20 | 2890 |
| BCL11A-2406 | + | CUCACAUGCAAACCUGGGGG | 20 | 2891 |
| BCL11A-2407 | + | ACUCACAUGCAAACCUGGGG | 20 | 2892 |
| BCL11A-2408 | + | AACAACUCACAUGCAAACCU | 20 | 2893 |
| BCL11A-2409 | + | GAACAACUCACAUGCAAACC | 20 | 2894 |
| BCL11A-2410 | + | CGAACAACUCACAUGCAAAC | 20 | 2895 |
| BCL11A-2411 | + | UAAUGAACAAUGCUAAGGUU | 20 | 2896 |
| BCL11A-2412 | + | CCCGCCAGUUUUGCAAAAUA | 20 | 2897 |
| BCL11A-2413 | + | CUUUAUUUCUCUUUUCGAAA | 20 | 2898 |
| BCL11A-2414 | + | GCUUUAUUUCUCUUUUCGAA | 20 | 2899 |
| BCL11A-2415 | + | CCGCCGCUUUAUUUCUCUUU | 20 | 2900 |
| BCL11A-2416 | + | CCAUUGCCGUGUAUGCACUU | 20 | 2901 |
| BCL11A-2417 | + | GAAAAAACCCUCAUCCCAUC | 20 | 2902 |
| BCL11A-2418 | + | GGAAAAAACCCUCAUCCCAU | 20 | 2903 |
| BCL11A-2419 | + | CGAGGUAAAAGAGAUAAAGG | 20 | 2904 |
| BCL11A-2420 | + | UCGAGGUAAAAGAGAUAAAG | 20 | 2905 |
| BCL11A-2421 | + | GUCGAGGUAAAAGAGAUAAA | 20 | 2906 |

TABLE 3B-continued

*S. aureus* gRNA targets for BCL11A knockdown

| gRNA Name | DNA Strand | Targeting Domain | Target Site Length | SEQ ID NO |
|---|---|---|---|---|
| BCL11A-2422 | + | AGUCGAGGUAAAAGAGAUAA | 20 | 2907 |
| BCL11A-2423 | + | GAGUCGAGGUAAAAGAGAUA | 20 | 2908 |
| BCL11A-2424 | + | ACCUCCGAGAGUCGAGGUAA | 20 | 2909 |
| BCL11A-2425 | + | ACGAGAAAAACCUCCGAGAG | 20 | 2910 |
| BCL11A-2426 | + | UUUUCACGAGAAAAACCUCC | 20 | 2911 |
| BCL11A-2427 | + | AUUUUUCACGAGAAAAACCU | 20 | 2912 |
| BCL11A-2428 | + | UGCAUUUUUAAAUUUUUCAC | 20 | 2913 |
| BCL11A-2429 | + | CAUGCAUUUUUAAAUUUUUC | 20 | 2914 |
| BCL11A-2430 | + | AGCAAAAGCGAGGGGGAGAG | 20 | 2915 |
| BCL11A-2431 | + | AAGCAAAAGCGAGGGGGAGA | 20 | 2916 |
| BCL11A-2432 | + | AGAAGCAAAAGCGAGGGGGA | 20 | 2917 |
| BCL11A-2433 | + | CUAGAAGCAAAAGCGAGGGG | 20 | 2918 |
| BCL11A-2434 | + | GACUAGAAGCAAAAGCGAGG | 20 | 2919 |
| BCL11A-2435 | + | GGACUAGAAGCAAAAGCGAG | 20 | 2920 |
| BCL11A-2436 | + | AGGACUAGAAGCAAAAGCGA | 20 | 2921 |
| BCL11A-2437 | + | CAGGACUAGAAGCAAAAGCG | 20 | 2922 |
| BCL11A-2438 | + | GCAGGACUAGAAGCAAAAGC | 20 | 2923 |
| BCL11A-2439 | + | GCGCAGGACUAGAAGCAAAA | 20 | 2924 |
| BCL11A-2440 | + | AUCACGAGAGCGCGCAGGAC | 20 | 2925 |
| BCL11A-2441 | + | UUAAUAAUCACGAGAGCGCG | 20 | 2926 |
| BCL11A-2442 | + | UAAUAAUUAUUAAUAAUCAC | 20 | 2927 |
| BCL11A-2443 | + | AAUAAUAAUUAUUAAUAAUC | 20 | 2928 |
| BCL11A-2444 | + | ACCUCAGAGGCAGCAAG | 17 | 2929 |
| BCL11A-2445 | + | GAACCUCAGAGGCAGCA | 17 | 2930 |
| BCL11A-2446 | + | CGAACCUCAGAGGCAGC | 17 | 2931 |
| BCL11A-2447 | + | CCCUCCCGACCGAACCU | 17 | 2932 |
| BCL11A-2448 | + | CUGCCCUCCCCUCCCGA | 17 | 2933 |
| BCL11A-2449 | + | GCCCGGACUGCUGCCUC | 17 | 2934 |
| BCL11A-2450 | + | AGAGGGAGGGAGGGAGC | 17 | 2935 |
| BCL11A-2451 | + | CGCGGGAGAGGGAGGGA | 17 | 2936 |
| BCL11A-2452 | + | ACGCGGGAGAGGGAGGG | 17 | 2937 |
| BCL11A-2453 | + | CACGCGGGAGAGGGAGG | 17 | 2938 |
| BCL11A-2454 | + | GGCACGCGGGAGAGGGA | 17 | 2939 |
| BCL11A-2455 | + | GGGCACGCGGGAGAGGG | 17 | 2940 |
| BCL11A-2456 | + | GGGGCACGCGGGAGAGG | 17 | 2941 |
| BCL11A-2457 | + | CGGGGCACGCGGGAGA | 17 | 2942 |
| BCL11A-2458 | + | CCGGGGGCACGCGGGAG | 17 | 2943 |
| BCL11A-2459 | + | GCCGGGGCACGCGGGA | 17 | 2944 |
| BCL11A-2460 | + | CGGCCGGGGCACGCGG | 17 | 2945 |
| BCL11A-2461 | + | GGCGGCCGGGGGCACGC | 17 | 2946 |
| BCL11A-2462 | + | AGGCGGCCGGGGGCACG | 17 | 2947 |
| BCL11A-2463 | + | GAGGCGGCCGGGGGCAC | 17 | 2948 |
| BCL11A-2464 | + | CGGGGGAGGAGGCGGCC | 17 | 2949 |
| BCL11A-2465 | + | CCGGGGGAGGAGGCGGC | 17 | 2950 |
| BCL11A-2466 | + | GCCGGGGAGGAGGCGG | 17 | 2951 |
| BCL11A-2467 | + | GGAGCUAGGGCCGGGGG | 17 | 2952 |
| BCL11A-2468 | + | AGGAGCUAGGGCCGGGG | 17 | 2953 |
| BCL11A-2469 | + | GCAGGAGCUAGGGCCGG | 17 | 2954 |
| BCL11A-2470 | + | GGCAGGAGCUAGGGCCG | 17 | 2955 |
| BCL11A-2471 | + | GGGCAGGAGCUAGGGCC | 17 | 2956 |
| BCL11A-2472 | + | AGGGCAGGAGCUAGGGC | 17 | 2957 |
| BCL11A-2473 | + | AAGGGCAGGAGCUAGGG | 17 | 2958 |
| BCL11A-2474 | + | CGCCGAAGGGCAGGAGC | 17 | 2959 |
| BCL11A-2475 | + | CGCCGCCGCCGAAGGGC | 17 | 2960 |
| BCL11A-2476 | + | CCGCCGCCGCCGAAGGG | 17 | 2961 |
| BCL11A-2477 | + | CGCCGCCGCCGCCGCC | 17 | 2962 |
| BCL11A-2478 | + | CGCCGCCGCCGCCGCCG | 17 | 2963 |
| BCL11A-2479 | + | UUUUGUUCCGGCCAGAG | 17 | 2964 |
| BCL11A-2480 | + | CCGCCUUUUGUUCCGGC | 17 | 2965 |
| BCL11A-2481 | + | GUGGGACCGGGAAGGAC | 17 | 2966 |
| BCL11A-2482 | + | CGUGGGACCGGGAAGGA | 17 | 2967 |
| BCL11A-2483 | + | CCGUGGGACCGGGAAGG | 17 | 2968 |
| BCL11A-2484 | + | AGAGCCGUGGGACCGGG | 17 | 2969 |
| BCL11A-2485 | + | GGGAGAGCCGUGGGACC | 17 | 2970 |
| BCL11A-2486 | + | GGGGAGAGCCGUGGGAC | 17 | 2971 |
| BCL11A-2487 | + | CGGGGAGAGCCGUGGGA | 17 | 2972 |
| BCL11A-2488 | + | GGCGACGGGAGAGCCG | 17 | 2973 |
| BCL11A-2489 | + | CGGCGACGGGAGAGCC | 17 | 2974 |
| BCL11A-2490 | + | GGGGCCGCGGCGACGGG | 17 | 2975 |
| BCL11A-2491 | + | GAGGGGCCGCGGCGACG | 17 | 2976 |
| BCL11A-2492 | + | AGAGGGGCCGCGGCGAC | 17 | 2977 |
| BCL11A-2493 | + | GAGAGGGGCCGCGGCGA | 17 | 2978 |
| BCL11A-2494 | + | GGAGAGGGGCCGCGGCG | 17 | 2979 |
| BCL11A-2495 | + | GUCCGCGGAGUCGGGAG | 17 | 2980 |

TABLE 3B-continued

S. aureus gRNA targets for BCL11A knockdown

| gRNA Name | DNA Strand | Targeting Domain | Target Site Length | SEQ ID NO |
|---|---|---|---|---|
| BCL11A-2496 | + | AGUCCGCGGAGUCGGGA | 17 | 2981 |
| BCL11A-2497 | + | UGAGUCCGCGGAGUCGG | 17 | 2982 |
| BCL11A-2498 | + | CCUGAGUCCGCGGAGUC | 17 | 2983 |
| BCL11A-2499 | + | UCCUGAGUCCGCGGAGU | 17 | 2984 |
| BCL11A-2500 | + | CUCCUGAGUCCGCGGAG | 17 | 2985 |
| BCL11A-2501 | + | CGGCGCUCCUGAGUCCG | 17 | 2986 |
| BCL11A-2502 | + | CCGGCGCUCCUGAGUCC | 17 | 2987 |
| BCL11A-2503 | + | AGGGGCCCCCGGCGCUC | 17 | 2988 |
| BCL11A-2504 | + | AAAGUGGCACUGUGGAA | 17 | 2989 |
| BCL11A-2505 | + | GAAAGUGGCACUGUGGA | 17 | 2990 |
| BCL11A-2506 | + | GUGAGAAAGUGGCACUG | 17 | 2991 |
| BCL11A-2507 | + | AGUGAGAAAGUGGCACU | 17 | 2992 |
| BCL11A-2508 | + | GUCAUCCCCACAAUAGU | 17 | 2993 |
| BCL11A-2509 | + | UAGUCAUCCCCACAAUA | 17 | 2994 |
| BCL11A-2510 | + | GUCAAGUGUGCAGCGGG | 17 | 2995 |
| BCL11A-2511 | + | GGUCAAGUGUGCAGCGG | 17 | 2996 |
| BCL11A-2512 | + | ACGGUCAAGUGUGCAGC | 17 | 2997 |
| BCL11A-2513 | + | CACGGUCAAGUGUGCAG | 17 | 2998 |
| BCL11A-2514 | + | UCACGGUCAAGUGUGCA | 17 | 2999 |
| BCL11A-2515 | + | AGAGGUGAGACUGGCUU | 17 | 3000 |
| BCL11A-2516 | + | UCCCGGGGAGAAAAGAG | 17 | 3001 |
| BCL11A-2517 | + | ACGAUUCCGGGGAGAA | 17 | 3002 |
| BCL11A-2518 | + | AAAAAACGAUUCCCGGG | 17 | 3003 |
| BCL11A-2519 | + | CUAAAAACGAUUCCCG | 17 | 3004 |
| BCL11A-2520 | + | UCUAAAAACGAUUCCC | 17 | 3005 |
| BCL11A-2521 | + | GUCUAAAAACGAUUCC | 17 | 3006 |
| BCL11A-2522 | + | AGUCUAAAAACGAUUC | 17 | 3007 |
| BCL11A-2523 | + | GGGGGGGUAGGGAGGGA | 17 | 3008 |
| BCL11A-2524 | + | AAAUGGGGGGUAGGGA | 17 | 3009 |
| BCL11A-2525 | + | AAAAUGGGGGGUAGGG | 17 | 3010 |
| BCL11A-2526 | + | GAAAAUGGGGGGUAGG | 17 | 3011 |
| BCL11A-2527 | + | AAGAAAUGGGGGGUA | 17 | 3012 |
| BCL11A-2528 | + | UAAGAAAUGGGGGGU | 17 | 3013 |
| BCL11A-2529 | + | GUAAGAAAUGGGGGG | 17 | 3014 |
| BCL11A-2530 | + | UCACCGUAAGAAAUGG | 17 | 3015 |
| BCL11A-2531 | + | CUCACCGUAAGAAAUG | 17 | 3016 |
| BCL11A-2532 | + | ACUCACCGUAAGAAAU | 17 | 3017 |
| BCL11A-2533 | + | CACUCACCGUAAGAAAA | 17 | 3018 |
| BCL11A-2534 | + | CCACUCACCGUAAGAAA | 17 | 3019 |
| BCL11A-2535 | + | UGCUUCCCACUCACCGU | 17 | 3020 |
| BCL11A-2536 | + | GGGAGCUGGUGGGAAA | 17 | 3021 |
| BCL11A-2537 | + | UGGGAGCUGGUGGGAA | 17 | 3022 |
| BCL11A-2538 | + | GUGGGAGCUGGUGGGA | 17 | 3023 |
| BCL11A-2539 | + | GGGGGUGGGAGCUGGUG | 17 | 3024 |
| BCL11A-2540 | + | UGGGGGUGGGAGCUGGU | 17 | 3025 |
| BCL11A-2541 | + | CUGGGGGUGGGAGCUGG | 17 | 3026 |
| BCL11A-2542 | + | CCUGGGGGUGGGAGCUG | 17 | 3027 |
| BCL11A-2543 | + | CAUGCAAACCUGGGGGU | 17 | 3028 |
| BCL11A-2544 | + | ACAUGCAAACCUGGGG | 17 | 3029 |
| BCL11A-2545 | + | CACAUGCAAACCUGGGG | 17 | 3030 |
| BCL11A-2546 | + | AACUCACAUGCAAACCU | 17 | 3031 |
| BCL11A-2547 | + | CAACUCACAUGCAAACC | 17 | 3032 |
| BCL11A-2548 | + | ACAACUCACAUGCAAAC | 17 | 3033 |
| BCL11A-2549 | + | UGAACAAUGCUAAGGUU | 17 | 3034 |
| BCL11A-2550 | + | GCCAGUUUUGCAAAAUA | 17 | 3035 |
| BCL11A-2551 | + | UAUUUCUCUUUUCGAAA | 17 | 3036 |
| BCL11A-2552 | + | UUAUUUCUCUUUUCGAA | 17 | 3037 |
| BCL11A-2553 | + | CCGCUUUAUUUCUCUUU | 17 | 3038 |
| BCL11A-2554 | + | UUGCCGUGUAUGCACUU | 17 | 3039 |
| BCL11A-2555 | + | AAAACCCUCAUCCCAUC | 17 | 3040 |
| BCL11A-2556 | + | AAAAACCCUCAUCCCAU | 17 | 3041 |
| BCL11A-2557 | + | GGUAAAGAGAUAAAGG | 17 | 3042 |
| BCL11A-2558 | + | AGGUAAAAGAGAUAAAG | 17 | 3043 |
| BCL11A-2559 | + | GAGGUAAAAGAGAUAAA | 17 | 3044 |
| BCL11A-2560 | + | CGAGGUAAAAGAGAUAA | 17 | 3045 |
| BCL11A-2561 | + | UCGAGGUAAAAGAGAUA | 17 | 3046 |
| BCL11A-2562 | + | UCCGAGAGUCGAGGUAA | 17 | 3047 |
| BCL11A-2563 | + | AGAAAACCUCCGAGAG | 17 | 3048 |
| BCL11A-2564 | + | UCACGAGAAAACCUCC | 17 | 3049 |
| BCL11A-2565 | + | UUUCACGAGAAAACCU | 17 | 3050 |
| BCL11A-2566 | + | AUUUUAAAUUUUCAC | 17 | 3051 |
| BCL11A-2567 | + | GCAUUUUAAAUUUUUC | 17 | 3052 |
| BCL11A-2568 | + | AAAAGCGAGGGGGAGAG | 17 | 3053 |
| BCL11A-2569 | + | CAAAAGCGAGGGGGAGA | 17 | 3054 |

TABLE 3B-continued

S. aureus gRNA targets for BCL11A knockdown

| gRNA Name | DNA Strand | Targeting Domain | Target Site Length | SEQ ID NO |
|---|---|---|---|---|
| BCL11A-2570 | + | AGCAAAAGCGAGGGGA | 17 | 3055 |
| BCL11A-2571 | + | GAAGCAAAAGCGAGGG | 17 | 3056 |
| BCL11A-2572 | + | UAGAAGCAAAAGCGAGG | 17 | 3057 |
| BCL11A-2573 | + | CUAGAAGCAAAAGCGAG | 17 | 3058 |
| BCL11A-2574 | + | ACUAGAAGCAAAAGCGA | 17 | 3059 |
| BCL11A-2575 | + | GACUAGAAGCAAAAGCG | 17 | 3060 |
| BCL11A-2576 | + | GGACUAGAAGCAAAAGC | 17 | 3061 |
| BCL11A-2577 | + | CAGGACUAGAAGCAAAA | 17 | 3062 |
| BCL11A-2578 | + | ACGAGAGCGCGCAGGAC | 17 | 3063 |
| BCL11A-2579 | + | AUAAUCACGAGAGCGCG | 17 | 3064 |
| BCL11A-2580 | + | UAAUUAUUAAUAAUCAC | 17 | 3065 |
| BCL11A-2581 | + | AAUAAUUAUUAAUAAUC | 17 | 3066 |

Table 3C provides exemplary targeting domains for repressing (i.e., knocking down or decreasing) expression of the BCL11A gene. Any of the targeting domains in the table can be used with an N. meningitidis eiCas9 molecule to cause a steric block in the promoter region to block transcription elongation resulting in the repression of the BCL11A gene. Any of the targeting domains in the table can be used with an N. meningitidis eiCas9 fused to a transcriptional repressor to decrease transcription and therefore downregulate gene expression.

TABLE 3C

N. meningitidis gRNA targets for BCL11A knockdown

| gRNA Name | DNA Strand | Targeting Domain | Target Site Length | SEQ ID NO |
|---|---|---|---|---|
| BCL11A-2582 | − | GCUUCUAGUCCUGCGCGCUC | 20 | 3067 |
| BCL11A-2583 | − | UCUAGUCCUGCGCGCUC | 17 | 3068 |
| BCL11A-2584 | + | UUUAGACUUGUACUCACUCC | 20 | 3069 |
| BCL11A-2585 | + | CAUUCCUUUUCGAAAAGAGA | 20 | 3070 |
| BCL11A-2586 | + | UUUAGACUUGUACUCAC | 17 | 3071 |
| BCL11A-2587 | + | CAUUCCUUUUCGAAAAG | 17 | 3072 |

Table 4A provides exemplary targeting domains for knocking out the BCL11A gene by targeting the early coding sequence the BCL11A gene selected according to first tier parameters. The targeting domains bind within first 500 bp of coding sequence downstream of start codon, good orthogonality, start with G. It is contemplated herein that the targeting domain hybridizes to the target domain through complementary base pairing. Any of the targeting domains in the table can be used with a S. pyogenes Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a S. pyogenes Cas9 (nickase) molecule to generate a single strand break. In an embodiment, dual targeting is used to create two nicks on opposite DNA strands by using S. pyogenes Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. Exemplary gRNA pairs are: BCL11A-2607 and BCL11A-2593, BCL11A-2607 and BCL11A-2598. BCL11A-264 and BCL11A-2593, BCL11A-2614 and BCL11A-2598, BCL11A-2589 and BCL11A-2664, BCL11A-2589 and BCL11A-2666, BCL11A-2596 and BCL11A-2664, BCL11A-2596 and BCL11A-2666, BCL11A-2603 and BCL11A-2664, of BCL11A-2603 and BCL11A-2666.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene. For example, gRNA pairs that target upstream (i.e., 5') of the enhancer region in the BCL11A gene (e.g., 2607 and BCL11A-2593, BCL11A-2607 and BCL11A-2598, BCL11A-264 and BCL11A-2593, or BCL11A-2614 and BCL11A-2598) can be paired with gRNA pairs that target downstream (i.e., 3') of the enhancer region in the BCL11A gene (e.g., BCL11A-2589 and BCL11A-2664, BCL11A-2589 and BCL11A-2666, BCL11A-2596 and BCL11A-2664, BCL11A-2596 and BCL11A-2666, BCL11A-2603 and BCL11A-2664, of BCL11A-2603 and BCL11A-2666).

TABLE 4A

1st Tier

| gRNA Name | DNA Strand | Targeting Domain | Target Site Length | SEQ ID NO |
|---|---|---|---|---|
| BCL11A-2588 | + | GAGCUCCAUGUGCAGAACGA | 20 | 3073 |
| BCL11A-2589 | + | GAGCUCCCAACGGGCCG | 17 | 3074 |
| BCL11A-2590 | − | GAGUGCAGAAUAUGCCCCGC | 20 | 3075 |
| BCL11A-2591 | + | GAUAAACAAUCGUCAUCCUC | 20 | 3076 |
| BCL11A-2592 | + | GAUGCCAACCUCCACGGGAU | 20 | 3077 |
| BCL11A-2593 | − | GCAGAAUAUGCCCCGCA | 17 | 3078 |
| BCL11A-2594 | − | GCAUCCAAUCCCGUGGAGGU | 20 | 3079 |
| BCL11A-2595 | + | GCCAACCUCCACGGGAU | 17 | 3080 |
| BCL11A-2596 | + | GCUCCCAACGGGCCGUGGUC | 20 | 3081 |
| BCL11A-2597 | − | GGAGCUCUAAUCCCCACGCC | 20 | 3082 |

Table 4B provides exemplary targeting domains for knocking out the BCL11A gene by targeting the early coding sequence the BCL11A gene selected according to second tier parameters. The targeting domains bind within first 500 bp of coding sequence downstream of start codon, good orthogonality, and do not start with G. It is contemplated herein that the targeting domain hybridizes to the target domain through complementary base pairing. Any of the targeting domains in the table can be used with a S. pyogenes Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a S. pyogenes Cas9 (nickase) molecule to generate a single strand break. In an embodiment, dual targeting is used to create two nicks on opposite DNA strands by using S. pyogenes Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 4B

| | 2nd Tier | | | |
|---|---|---|---|---|
| gRNA Name | DNA Strand | Targeting Domain | Target Site Length | SEQ ID NO |
| BCL11A-2598 | − | AGCAUCCAAUCCCGUGG | 17 | 3083 |
| BCL11A-2599 | − | AGUGCAGAAUAUGCCCCGCA | 20 | 3084 |
| BCL11A-2600 | − | AUGUCUCGCCGCAAGCA | 17 | 3085 |
| BCL11A-2601 | + | AUUCCCGUUUGCUUAAGUGC | 20 | 3086 |
| BCL11A-2602 | + | CAUCCUCUGGCGUGACC | 17 | 3087 |
| BCL11A-2603 | + | CCCAACGGGCCGUGGUC | 17 | 3088 |
| BCL11A-2604 | + | CCCCCAAUGGGAAGUUCAUC | 20 | 3089 |
| BCL11A-2605 | + | CCCGUUUGCUUAAGUGC | 17 | 3090 |
| BCL11A-2606 | + | CGUCAUCCUCUGGCGUGACC | 20 | 3091 |
| BCL11A-2607 | + | UCAUCUCGAUUGGUGAA | 17 | 3092 |
| BCL11A-2608 | − | UCCAAUCCCGUGGAGGU | 17 | 3093 |
| BCL11A-2609 | + | UCCCGUUUGCUUAAGUGCUG | 20 | 3094 |
| BCL11A-2610 | − | UGAACCAGACCACGGCCCGU | 20 | 3095 |
| BCL11A-2611 | − | UGCAGAAUAUGCCCCGC | 17 | 3096 |
| BCL11A-2612 | − | UGGCAUCCAGGUCACGCCAG | 20 | 3097 |

TABLE 4B-continued

| | 2nd Tier | | | |
|---|---|---|---|---|
| gRNA Name | DNA Strand | Targeting Domain | Target Site Length | SEQ ID NO |
| BCL11A-2613 | − | UUAUCAACGUCAUCUAG | 17 | 3098 |
| BCL11A-2614 | + | UUCAUCUCGAUUGGUGA | 17 | 3099 |

Table 4C provides exemplary targeting domains for knocking out the BCL11A gene by targeting the early coding sequence the BCL11A gene selected according to third tier parameters. The targeting domains bind within first 500 bp of coding sequence downstream of start codon and start with G. It is contemplated herein that the targeting domain hybridizes to the target domain through complementary base pairing. Any of the targeting domains in the table can be used with a S. pyogenes Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a S. pyogenes Cas9 (nickase) molecule to generate a single strand break. In an embodiment, dual targeting is used to create two nicks on opposite DNA strands by using S. pyogenes Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 4C

| | 3rd Tier | | | |
|---|---|---|---|---|
| gRNA Name | DNA Strand | Targeting Domain | Target Site Length | SEQ ID NO |
| BCL11A-2615 | − | GAAAAAGCAUCCAAUCCCG | 20 | 3100 |
| BCL11A-2616 | − | GAACCAGACCACGGCCCGUU | 20 | 3101 |
| BCL11A-2617 | + | GACCUGGAUGCCAACCUCCA | 20 | 3102 |
| BCL11A-2618 | − | GAGCUCUAAUCCCCACGCCU | 20 | 3103 |
| BCL11A-2619 | − | GAUCAUGACCUCCUCACCUG | 20 | 3104 |
| BCL11A-2620 | − | GAUGAACUUCCCAUUGG | 17 | 3105 |
| BCL11A-2621 | − | GAUGAUGAACCAGACCA | 17 | 3106 |
| BCL11A-2622 | + | GAUGCUUUUUCAUCUCGAU | 20 | 3107 |

TABLE 4C-continued

3rd Tier

| gRNA Name | DNA Strand | Targeting Domain | Target Site Length | SEQ ID NO |
|---|---|---|---|---|
| BCL11A-2623 | + | GCACUCAUCCCAGGCGU | 17 | 3108 |
| BCL11A-2624 | + | GCAUAUUCUGCACUCAUCCC | 20 | 3109 |
| BCL11A-2625 | - | GCCAGAUGAACUUCCCAUUG | 20 | 3110 |
| BCL11A-2626 | - | GCCCGUUGGGAGCUCCAGAA | 20 | 3111 |
| BCL11A-2627 | + | GCUAUGUGUUCCUGUUU | 17 | 3112 |
| BCL11A-2628 | + | GCUCCAUGUGCAGAACG | 17 | 3113 |
| BCL11A-2629 | - | GCUCUAAUCCCCACGCC | 17 | 3114 |
| BCL11A-2630 | + | GCUGGGGUUUGCCUUGCUUG | 20 | 3115 |
| BCL11A-2631 | + | GCUUUUUUCAUCUCGAU | 17 | 3116 |
| BCL11A-2632 | + | GGCACUGCCCACAGGUG | 17 | 3117 |
| BCL11A-2633 | + | GGCACUGCCCACAGGUGAGG | 20 | 3118 |
| BCL11A-2634 | - | GGCCCGUUGGGAGCUCCAGA | 20 | 3119 |
| BCL11A-2635 | + | GGGGUUUGCCUUGCUUG | 17 | 3120 |
| BCL11A-2636 | + | GUAAGAAUGGCUUCAAG | 17 | 3121 |
| BCL11A-2637 | + | GUGCAGAACGAGGGGAGGAG | 20 | 3122 |
| BCL11A-2638 | - | GUGCCAGAUGAACUUCCCAU | 20 | 3123 |
| BCL11A-2639 | + | GUUCAUCUGGCACUGCCCAC | 20 | 3124 |
| BCL11A-2640 | - | GUUGGGAGCUCCAGAAG | 17 | 3125 |

Table 4D provides exemplary targeting domains for knocking out the BCL11A gene by targeting the early coding sequence the BCL11A gene selected according to forth tier parameters. The targeting domains bind within first 500 bp of coding sequence downstream of start codon and do not start with G. It is contemplated herein that the targeting domain hybridizes to the target domain through complementary base pairing. Any of the targeting domains in the table can be used with a *S. pyogenes* Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *S. pyogenes* Cas9 (nickase) molecule to generate a single strand break. In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 4D

4th Tier

| gRNA Name | DNA Strand | Targeting Domain | Target Site Length | SEQ ID NO |
|---|---|---|---|---|
| BCL11A-2641 | - | AAAAGCAUCCAAUCCCG | 17 | 3126 |
| BCL11A-2642 | - | AAAAGCAUCCAAUCCCGUGG | 20 | 3127 |
| BCL11A-2643 | + | AAAAUAAGAAUGUCCCCCAA | 20 | 3128 |
| BCL11A-2644 | + | AAACAAUCGUCAUCCUC | 17 | 3129 |
| BCL11A-2645 | - | AAACGGAAACAAUGCAA | 17 | 3130 |
| BCL11A-2646 | - | AAACUUCUGCACUGGAG | 17 | 3131 |
| BCL11A-2647 | + | AAAUAAGAAUGUCCCCCAAU | 20 | 3132 |
| BCL11A-2648 | - | AACCCCAGCACUUAAGCAAA | 20 | 3133 |
| BCL11A-2649 | + | AAGAAUGGCUUCAAGAGGCU | 20 | 3134 |
| BCL11A-2650 | + | AAUGGCUUCAAGAGGCU | 17 | 3135 |
| BCL11A-2651 | - | ACAGAUGAUGAACCAGACCA | 20 | 3136 |
| BCL11A-2652 | - | ACCAGACCACGGCCCGU | 17 | 3137 |
| BCL11A-2653 | - | ACCCCAGCACUUAAGCAAAC | 20 | 3138 |
| BCL11A-2654 | + | ACCUGGAUGCCAACCUCCAC | 20 | 3139 |
| BCL11A-2655 | + | ACUGCCCACAGGUGAGG | 17 | 3140 |
| BCL11A-2656 | + | AGAGCUCCAUGUGCAGAACG | 20 | 3141 |
| BCL11A-2657 | - | AGAUGAACUUCCCAUUG | 17 | 3142 |
| BCL11A-2658 | + | AGCUCCAUGUGCAGAACGAG | 20 | 3143 |
| BCL11A-2659 | - | AGGAAUUUGCCCCAAAC | 17 | 3144 |
| BCL11A-2660 | + | AGGAGGUCAUGAUCCCCUUC | 20 | 3145 |
| BCL11A-2661 | + | AGGUCAUGAUCCCCUUC | 17 | 3146 |
| BCL11A-2662 | - | AUAAACUUCUGCACUGG | 17 | 3147 |
| BCL11A-2663 | + | AUAAGAAUGUCCCCCAA | 17 | 3148 |
| BCL11A-2664 | - | AUCAUGACCUCCUCACCUGU | 20 | 3149 |
| BCL11A-2665 | + | AUCUCGAUUGGUGAAGGGGA | 20 | 3150 |
| BCL11A-2666 | - | AUGACCUCCUCACCUGU | 17 | 3151 |
| BCL11A-2667 | + | AUGUGCAGAACGAGGGG | 17 | 3152 |
| BCL11A-2668 | + | AUUGGUGAAGGGGAAGG | 17 | 3153 |
| BCL11A-2669 | - | CACAAACGGAAACAAUGCAA | 20 | 3154 |
| BCL11A-2670 | + | CACUCAUCCCAGGCGUG | 17 | 3155 |
| BCL11A-2671 | + | CAGAACGAGGGGAGGAG | 17 | 3156 |
| BCL11A-2672 | - | CAGAUGAACUUCCCAUU | 17 | 3157 |
| BCL11A-2673 | + | CAGCUUUUUCUAAGCAG | 17 | 3158 |
| BCL11A-2674 | - | CAUCCAGGUCACGCCAG | 17 | 3159 |

TABLE 4D-continued

4th Tier

| gRNA Name | DNA Strand | Targeting Domain | Target Site Length | SEQ ID NO |
|---|---|---|---|---|
| BCL11A-2675 | + | CAUCUCGAUUGGUGAAG | 17 | 3160 |
| BCL11A-2676 | + | CAUCUGGCACUGCCCAC | 17 | 3161 |
| BCL11A-2677 | - | CAUGACCUCCUCACCUG | 17 | 3162 |
| BCL11A-2678 | + | CCAAUGGGAAGUUCAUC | 17 | 3163 |
| BCL11A-2679 | + | CCACAGCUUUUUCUAAGCAG | 20 | 3164 |
| BCL11A-2680 | - | CCAGACCACGGCCCGUU | 17 | 3165 |
| BCL11A-2681 | - | CCAGAUGAACUUCCCAU | 17 | 3166 |
| BCL11A-2682 | - | CCAGAUGAACUUCCCAUUGG | 20 | 3167 |
| BCL11A-2683 | - | CCAGCACUUAAGCAAAC | 17 | 3168 |
| BCL11A-2684 | - | CCCAGCACUUAAGCAAA | 17 | 3169 |
| BCL11A-2685 | + | CCCCUUCUGGAGCUCCCAAC | 20 | 3170 |
| BCL11A-2686 | - | CCCGUUGGGAGCUCCAGAAG | 20 | 3171 |
| BCL11A-2687 | - | CCGUUGGGAGCUCCAGA | 17 | 3172 |
| BCL11A-2688 | + | CCGUUUGCUUAAGUGCU | 17 | 3173 |
| BCL11A-2689 | - | CCUCUGCUUAGAAAAGCUG | 20 | 3174 |
| BCL11A-2690 | + | CCUUCUGGAGCUCCCAA | 17 | 3175 |
| BCL11A-2691 | - | CGUGGAGGUUGGCAUCC | 17 | 3176 |
| BCL11A-2692 | - | CGUUGGGAGCUCCAGAA | 17 | 3177 |
| BCL11A-2693 | + | CGUUUGCUUAAGUGCUG | 17 | 3178 |
| BCL11A-2694 | + | CUAUGUGUUCCUGUUUG | 17 | 3179 |
| BCL11A-2695 | + | CUCCAUGUGCAGAACGA | 17 | 3180 |
| BCL11A-2696 | - | CUCUAAUCCCCACGCCU | 17 | 3181 |
| BCL11A-2697 | + | CUGCACUCAUCCCAGGCGUG | 20 | 3182 |
| BCL11A-2698 | + | CUGCUAUGUGUUCCUGUUUG | 20 | 3183 |
| BCL11A-2699 | - | CUGCUUAGAAAAGCUG | 17 | 3184 |
| BCL11A-2700 | + | CUGGAGCUCCCAACGGGCCG | 20 | 3185 |
| BCL11A-2701 | + | CUGGAUGCCAACCUCCA | 17 | 3186 |
| BCL11A-2702 | + | CUUCUGGAGCUCCCAAC | 17 | 3187 |
| BCL11A-2703 | - | UAAACUUCUGCACUGGA | 17 | 3188 |
| BCL11A-2704 | + | UAAGAAUGUCCCCCAAU | 17 | 3189 |
| BCL11A-2705 | - | UAGAGGAAUUUGCCCCAAAC | 20 | 3190 |
| BCL11A-2706 | + | UAUUCUGCACUCAUCCC | 17 | 3191 |
| BCL11A-2707 | + | UCCAUGUGCAGAACGAG | 17 | 3192 |
| BCL11A-2708 | + | UCCAUGUGCAGAACGAGGGG | 20 | 3193 |
| BCL11A-2709 | - | UCCCCUCGUUCUGCACA | 17 | 3194 |
| BCL11A-2710 | + | UCCCCUUCUGGAGCUCCCAA | 20 | 3195 |
| BCL11A-2711 | - | UCCCGUGGAGGUUGGCAUCC | 20 | 3196 |
| BCL11A-2712 | - | UCCUCCCCUCGUUCUGCACA | 20 | 3197 |
| BCL11A-2713 | + | UCGAUUGGUGAAGGGGA | 17 | 3198 |
| BCL11A-2714 | + | UCGAUUGGUGAAGGGGAAGG | 20 | 3199 |
| BCL11A-2715 | + | UCUGCACUCAUCCCAGGCGU | 20 | 3200 |
| BCL11A-2716 | + | UCUGGCACUGCCCACAGGUG | 20 | 3201 |
| BCL11A-2717 | + | UCUGUAAGAAUGGCUUCAAG | 20 | 3202 |
| BCL11A-2718 | + | UGCACUCAUCCCAGGCG | 17 | 3203 |
| BCL11A-2719 | - | UGCCAGAUGAACUUCCCAUU | 20 | 3204 |
| BCL11A-2720 | + | UGCUAUGUGUUCCUGUU | 17 | 3205 |
| BCL11A-2721 | + | UGGAUGCCAACCUCCAC | 17 | 3206 |
| BCL11A-2722 | + | UGGUUCAUCAUCUGUAAGAA | 20 | 3207 |
| BCL11A-2723 | - | UGUUUAUCAACGUCAUCUAG | 20 | 3208 |
| BCL11A-2724 | - | UUAUUUUUAUCGAGCACAAA | 20 | 3209 |
| BCL11A-2725 | + | UUCAUCAUCUGUAAGAA | 17 | 3210 |
| BCL11A-2726 | + | UUCCCGUUUGCUUAAGUGCU | 20 | 3211 |
| BCL11A-2727 | + | UUCUGCACUCAUCCCAGGCG | 20 | 3212 |
| BCL11A-2728 | + | UUUCAUCUCGAUUGGUGAAG | 20 | 3213 |
| BCL11A-2729 | + | UUUUCAUCUCGAUUGGUGAA | 20 | 3214 |
| BCL11A-2730 | - | UUUUUAUCGAGCACAAA | 17 | 3215 |
| BCL11A-2731 | + | UUUUUCAUCUCGAUUGGUGA | 20 | 3216 |

Table 4E provides exemplary targeting domains for knocking out the BCL11A gene by targeting the early coding sequence the BCL11A gene selected according to fifth tier parameters. The targeting domains outside the first 500 bp of coding sequence downstream of start codon. It is contemplated herein that the targeting domain hybridizes to the target domain through complementary base pairing. Any of the targeting domains in the table can be used with a *S. pyogenes* Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *S. pyogenes* Cas9 (nickase) molecule to generate a single strand break. In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 4E

5th Tier

| gRNA Name | DNA Strand | Targeting Domain | Target Site Length | SEQ ID NO |
|---|---|---|---|---|
| BCL11A-2732 | + | UAUGCGGUCCGACUCGC | 17 | 3217 |
| BCL11A-2733 | - | UCGGACCGCAUAGACGA | 17 | 3218 |
| BCL11A-2734 | + | UGGGUACUACGCCGAAU | 17 | 3219 |
| BCL11A-2735 | + | GGUACUACGCCGAAUGG | 17 | 3220 |
| BCL11A-2736 | - | UUGCGACGAAGACUCGG | 17 | 3221 |
| BCL11A-2737 | + | CUGGGUACUACGCCGAA | 17 | 3222 |
| BCL11A-2738 | + | GGGUACUACGCCGAAUG | 17 | 3223 |
| BCL11A-2739 | + | UCGGACUUGACCGUCAU | 17 | 3224 |
| BCL11A-2740 | + | AGGGAUACCAACCCGCG | 17 | 3225 |
| BCL11A-2741 | - | CGCGCUCAAGUCCGUGG | 17 | 3226 |
| BCL11A-2742 | + | CGAGGAGUGCUCCGACG | 17 | 3227 |
| BCL11A-2743 | + | GUCGGACUUGACCGUCA | 17 | 3228 |
| BCL11A-2744 | + | UGCACGCGUGGUCGCAC | 17 | 3229 |
| BCL11A-2745 | - | CAGCGCGCUCAAGUCCG | 17 | 3230 |
| BCL11A-2746 | + | UACCAACCCGCGGGGUC | 17 | 3231 |
| BCL11A-2747 | - | GUGGCUCGCCGGCUACG | 17 | 3232 |
| BCL11A-2748 | + | CGGACUUGACCGUCAUG | 17 | 3233 |
| BCL11A-2749 | - | CACCGCAUAGAGCGCCU | 17 | 3234 |
| BCL11A-2750 | - | GCGCAUCAAGCUCGAGA | 17 | 3235 |
| BCL11A-2751 | + | GGCCCGGACCACUAAUA | 17 | 3236 |
| BCL11A-2752 | + | GCCCGGACCACUAAUAU | 17 | 3237 |
| BCL11A-2753 | - | GCAUAAGCGCGGCCACC | 17 | 3238 |
| BCL11A-2754 | + | AGGCGCUCUAUGCGGUG | 17 | 3239 |
| BCL11A-2755 | - | ACGGUCAAGUCCGACGA | 17 | 3240 |
| BCL11A-2756 | + | CGAGGCCGACUCGCCCG | 17 | 3241 |
| BCL11A-2757 | - | ACCGCAUAGAGCGCCUG | 17 | 3242 |
| BCL11A-2758 | - | CGACCACGCGUGCACCC | 17 | 3243 |
| BCL11A-2759 | + | GUACACGUUCUCCGUGU | 17 | 3244 |
| BCL11A-2760 | - | CACUUGCGACGAAGACU | 17 | 3245 |
| BCL11A-2761 | - | CGGGUUGGUAUCCCUUC | 17 | 3246 |
| BCL11A-2762 | - | CUCGUCGGAGCACUCCU | 17 | 3247 |
| BCL11A-2763 | + | CCCGGACCACUAAUAUG | 17 | 3248 |

TABLE 4E-continued

5th Tier

| gRNA Name | DNA Strand | Targeting Domain | Target Site Length | SEQ ID NO |
|---|---|---|---|---|
| BCL11A-2764 | + | UCGGUGGUGGACUAAAC | 17 | 3249 |
| BCL11A-2765 | + | CAGGCGCUCUAUGCGGU | 17 | 3250 |
| BCL11A-2766 | + | AAGGGAUACCAACCCGC | 17 | 3251 |
| BCL11A-2767 | + | GGCGCUCUAUGCGGUGG | 17 | 3252 |
| BCL11A-2768 | - | CCACCGCAUAGAGCGCC | 17 | 3253 |
| BCL11A-2769 | - | UACUCGCAGUGGCUCGC | 17 | 3254 |
| BCL11A-2770 | - | CGGGCGAGUCGGCCUCG | 17 | 3255 |
| BCL11A-2771 | + | UACACGUUCUCCGUGUU | 17 | 3256 |
| BCL11A-2772 | - | AGCACGCCCCAUAUUAG | 17 | 3257 |
| BCL11A-2773 | + | GAAGGGAUACCAACCCG | 17 | 3258 |
| BCL11A-2774 | + | UUGGGCAUCGCGGCCGG | 17 | 3259 |
| BCL11A-2775 | - | CCGGGCGAGUCGGCCUC | 17 | 3260 |
| BCL11A-2776 | + | GGUGGAGAGACCGUCGU | 17 | 3261 |
| BCL11A-2777 | + | GUUGGGCAUCGCGGCCG | 17 | 3262 |
| BCL11A-2778 | - | AGAACGUGUACUCGCAG | 17 | 3263 |
| BCL11A-2779 | + | ACCAACCCGCGGGGUCA | 17 | 3264 |
| BCL11A-2780 | - | CACGAGAACAGCUCGCG | 17 | 3265 |
| BCL11A-2781 | - | UAUUAGUGGUCCGGGCC | 17 | 3266 |
| BCL11A-2782 | + | CGUCGCAAGUGUCCCUG | 17 | 3267 |
| BCL11A-2783 | + | CCCGCGAGCUGUUCUCG | 17 | 3268 |
| BCL11A-2784 | + | UGCGCCGGUGCACCACC | 17 | 3269 |
| BCL11A-2785 | - | CUGCCCGACGUCAUGCA | 17 | 3270 |
| BCL11A-2786 | - | GACGAAGACUCGGUGGC | 17 | 3271 |
| BCL11A-2787 | - | CCUGCCCGACGUCAUGC | 17 | 3272 |
| BCL11A-2788 | + | AAGGGCGGCUUGCUACC | 17 | 3273 |
| BCL11A-2789 | - | GGGUGGACUACGGCUUC | 17 | 3274 |
| BCL11A-2790 | + | UCGCUGGUGCCGGGUUC | 17 | 3275 |
| BCL11A-2791 | - | GGCGAGAAGCAUAAGCG | 17 | 3276 |
| BCL11A-2792 | + | GGACUUGAGCGCGCUGC | 17 | 3277 |
| BCL11A-2793 | - | CUCGGUGGCCGGCGAGU | 17 | 3278 |
| BCL11A-2794 | + | CCCGAGGCCGACUCGCC | 17 | 3279 |
| BCL11A-2795 | - | CCCGGGCGAGUCGGCCU | 17 | 3280 |
| BCL11A-2796 | - | CCGCAUAGAGCGCCUGG | 17 | 3281 |
| BCL11A-2797 | + | UGUUGGGCAUCGCGGCC | 17 | 3282 |
| BCL11A-2798 | + | GUGUUGGGCAUCGCGGC | 17 | 3283 |
| BCL11A-2799 | + | UCUCGAUACUGAUCC | 17 | 3284 |
| BCL11A-2800 | - | ACCCGAGUGCCUUUGAC | 17 | 3285 |

TABLE 4E-continued

5th Tier

| gRNA Name | DNA Strand | Targeting Domain | Target Site Length | SEQ ID NO |
|---|---|---|---|---|
| BCL11A-2801 | + | UCCGACGAGGAGGCAAA | 17 | 3286 |
| BCL11A-2802 | − | ACCCGGCACCAGCGACU | 17 | 3287 |
| BCL11A-2803 | + | CCCCGUUCUCCGGGAUC | 17 | 3288 |
| BCL11A-2804 | + | CCGAGGCCGACUCGCCC | 17 | 3289 |
| BCL11A-2805 | − | CCCCAUAUUAGUGGUCC | 17 | 3290 |
| BCL11A-2806 | + | GACUUGGACUUGACCGG | 17 | 3291 |
| BCL11A-2807 | − | GCCCCAUAUUAGUGGUC | 17 | 3292 |
| BCL11A-2808 | − | AGGGUGGACUACGGCUU | 17 | 3293 |
| BCL11A-2809 | − | CAAAUCGUCCCCCAUGA | 17 | 3294 |
| BCL11A-2810 | − | CGACGUCAUGCAGGGCA | 17 | 3295 |
| BCL11A-2811 | − | GGCCGCGAUGCCCAACA | 17 | 3296 |
| BCL11A-2812 | + | CCAGGCGCUCUAUGCGG | 17 | 3297 |
| BCL11A-2813 | − | CCUGAUCCCGGAGAACG | 17 | 3298 |
| BCL11A-2814 | + | CCAACCCGCGGGGUCAG | 17 | 3299 |
| BCL11A-2815 | − | GGCGAGUCGGCCUCGGG | 17 | 3300 |
| BCL11A-2816 | + | GGCAAAAGGCGAUUGUC | 17 | 3301 |
| BCL11A-2817 | + | UUUGGACAGGCCCCCCG | 17 | 3302 |
| BCL11A-2818 | + | GCGGCUUGCUACCUGGC | 17 | 3303 |
| BCL11A-2819 | + | GGACUUGACCGUCAUGG | 17 | 3304 |
| BCL11A-2820 | + | GGAGUGCUCCGACGAGG | 17 | 3305 |
| BCL11A-2821 | − | AUUAGUGGUCCGGGCCC | 17 | 3306 |
| BCL11A-2822 | − | CCACGAGAACAGCUCGC | 17 | 3307 |
| BCL11A-2823 | − | GUAUCGAGAGAGGCUUC | 17 | 3308 |
| BCL11A-2824 | + | CUCCGUGUUGGGCAUCG | 17 | 3309 |
| BCL11A-2825 | + | CAAACUCCCGUUCUCCG | 17 | 3310 |
| BCL11A-2826 | − | ACCUGAUCCCGGAGAAC | 17 | 3311 |
| BCL11A-2827 | − | GGCACUGUUAAUGGCCG | 17 | 3312 |
| BCL11A-2828 | + | UUCUCCGGGAUCAGGUU | 17 | 3313 |
| BCL11A-2829 | − | UAUGGAGCCUCCCGCCA | 17 | 3314 |
| BCL11A-2830 | + | CUUGAUGCGCUUAGAGA | 17 | 3315 |
| BCL11A-2831 | − | UAGCAAGCCGCCCUUCC | 17 | 3316 |
| BCL11A-2832 | − | CCGGCUACGCGGCCUCC | 17 | 3317 |
| BCL11A-2833 | + | UCCAAGUGAUGUCUCGG | 17 | 3318 |
| BCL11A-2834 | − | GAACAGCUCGCGGGGCG | 17 | 3319 |
| BCL11A-2835 | − | GCUGCGGUUGAAUCCAA | 17 | 3320 |
| BCL11A-2836 | + | UGACUUGGACUUGACCG | 17 | 3321 |
| BCL11A-2837 | − | CCCGGAGAACGGGGACG | 17 | 3322 |
| BCL11A-2838 | + | GUGGCGCUUCAGCUUGC | 17 | 3323 |
| BCL11A-2839 | + | GUUCUCCGGGAUCAGGU | 17 | 3324 |
| BCL11A-2840 | + | CAGUGCCAUCGUCUAUG | 17 | 3325 |
| BCL11A-2841 | + | UCUCCGGGAUCAGGUUG | 17 | 3326 |
| BCL11A-2842 | − | GACGAUGGCACUGUUAA | 17 | 3327 |
| BCL11A-2843 | − | CUGCUCCCCGGGCGAGU | 17 | 3328 |
| BCL11A-2844 | + | CGGUGGUGGACUAAACA | 17 | 3329 |
| BCL11A-2845 | − | CUCGCGGGGCGCGGUCG | 17 | 3330 |
| BCL11A-2846 | + | AUGCCCUGCAUGACGUC | 17 | 3331 |
| BCL11A-2847 | + | UGGACUUGACCGGGGGC | 17 | 3332 |
| BCL11A-2848 | − | ACCACGAGAACAUCACU | 17 | 3333 |
| BCL11A-2849 | − | GGAGUUCGACCUGCCCC | 17 | 3334 |
| BCL11A-2850 | + | CCUGCAUGACGUCGGGC | 17 | 3335 |
| BCL11A-2851 | + | CUGCAUGACGUCGGGCA | 17 | 3336 |
| BCL11A-2852 | − | AGGAUCAGUAUCGAGAG | 17 | 3337 |
| BCL11A-2853 | + | GGACUUGACCGGGGGCU | 17 | 3338 |
| BCL11A-2854 | + | AAAGGCACUCGGGUGAU | 17 | 3339 |
| BCL11A-2855 | − | UGGACGGAGGGAUCUCG | 17 | 3340 |
| BCL11A-2856 | + | CCCCCAGGCGCUCUAUG | 17 | 3341 |
| BCL11A-2857 | − | CCGCCAUGGAUUUCUCU | 17 | 3342 |
| BCL11A-2858 | − | GGCGCGGUCGUGGGCGU | 17 | 3343 |
| BCL11A-2859 | − | AACCUGAUCCCGGAGAA | 17 | 3344 |
| BCL11A-2860 | + | CAUGCCCUGCAUGACGU | 17 | 3345 |
| BCL11A-2861 | + | CGCUGGUGCCGGGUUCC | 17 | 3346 |
| BCL11A-2862 | + | CCUGGAGGCCGCGUAGC | 17 | 3347 |
| BCL11A-2863 | − | CCCCGACCCCGCGGGU | 17 | 3348 |
| BCL11A-2864 | + | GCUUAUGCUUCUCGCCC | 17 | 3349 |
| BCL11A-2865 | − | AAGUCAUGCGAGUUCUG | 17 | 3350 |
| BCL11A-2866 | + | CACCAAGUCGCUGGUGC | 17 | 3351 |
| BCL11A-2867 | − | CCCGAGUGCCUUUGACA | 17 | 3352 |
| BCL11A-2868 | + | CAUGACUUGGACUUGAC | 17 | 3353 |
| BCL11A-2869 | − | CGACCCCAACCUGAUCC | 17 | 3354 |
| BCL11A-2870 | + | ACCAAGUCGCUGGUGCC | 17 | 3355 |
| BCL11A-2871 | + | AAGUGAUGUCUCGGUGG | 17 | 3356 |
| BCL11A-2872 | − | CUUCUCCACACCGCCCG | 17 | 3357 |
| BCL11A-2873 | + | UGGAGUCUCCGAAGCUA | 17 | 3358 |
| BCL11A-2874 | − | CGCUUCUCCACACCGCC | 17 | 3359 |

TABLE 4E-continued

5th Tier

| gRNA Name | DNA Strand | Targeting Domain | Target Site Length | SEQ ID NO |
|---|---|---|---|---|
| BCL11A-2875 | + | GCUGGUGCCGGGUUCCG | 17 | 3360 |
| BCL11A-2876 | - | CGCAGCGGCACGGGAAG | 17 | 3361 |
| BCL11A-2877 | + | GCAUCGCGGCCGGGGGC | 17 | 3362 |
| BCL11A-2878 | - | GAGCACUCCUCGGAGAA | 17 | 3363 |
| BCL11A-2879 | + | GGGGGGCGUCGCCAGGA | 17 | 3364 |
| BCL11A-2880 | + | GAAAGCGCCCUUCUGCC | 17 | 3365 |
| BCL11A-2881 | - | CUGGACGGAGGGAUCUC | 17 | 3366 |
| BCL11A-2882 | - | CGGCUUCGGGCUGAGCC | 17 | 3367 |
| BCL11A-2883 | + | GGGGGCGUCGCCAGGAA | 17 | 3368 |
| BCL11A-2884 | + | UAACCUUUGCAUAGGGC | 17 | 3369 |
| BCL11A-2885 | - | GGGCGAGUCGGCCUCGG | 17 | 3370 |
| BCL11A-2886 | - | CACACCGCCCGGGGAGC | 17 | 3371 |
| BCL11A-2887 | - | GGGAUCUCGGGGCGCAG | 17 | 3372 |
| BCL11A-2888 | + | CUCGCUGAAGUGCUGCA | 17 | 3373 |
| BCL11A-2889 | - | UCGGGGCGCAGCGGCAC | 17 | 3374 |
| BCL11A-2890 | - | AAGUCCCUGACCCCGC | 17 | 3375 |
| BCL11A-2891 | - | GCCUUUUGCCUCCUCGU | 17 | 3376 |
| BCL11A-2892 | - | CACCUGGCCGAGGCCGA | 17 | 3377 |
| BCL11A-2893 | - | GGUAUCCCUUCAGGACU | 17 | 3378 |
| BCL11A-2894 | + | GUGGUGGACUAAACAGG | 17 | 3379 |
| BCL11A-2895 | + | GCGAGCUGUUCUCGUGG | 17 | 3380 |
| BCL11A-2896 | - | AGCACUCCUCGGAGAAC | 17 | 3381 |
| BCL11A-2897 | - | CAUGCAGCACUUCAGCG | 17 | 3382 |
| BCL11A-2898 | + | UGGCCUGGGUGCACGCG | 17 | 3383 |
| BCL11A-2899 | - | AGCGAGAGGGUGGACUA | 17 | 3384 |
| BCL11A-2900 | + | GCACAGGUUGCACUUGU | 17 | 3385 |
| BCL11A-2901 | + | GAGAAAUCCAUGGCGGG | 17 | 3386 |
| BCL11A-2902 | + | GCAGAACUCGCAUGACU | 17 | 3387 |
| BCL11A-2903 | + | UCUCCGAAGCUAAGGAA | 17 | 3388 |
| BCL11A-2904 | + | UGACGUCGGGCAGGGCG | 17 | 3389 |
| BCL11A-2905 | + | GGGUCCAAGUGAUGUCU | 17 | 3390 |
| BCL11A-2906 | - | GCAACCUGGUGGUGCAC | 17 | 3391 |
| BCL11A-2907 | + | GGUGGCGCGCCGCCUCC | 17 | 3392 |
| BCL11A-2908 | + | GCUGCCCACCAAGUCGC | 17 | 3393 |
| BCL11A-2909 | + | GUUCUCGCUCUUGAACU | 17 | 3394 |
| BCL11A-2910 | + | CCGCAGCACCCUGUCAA | 17 | 3395 |
| BCL11A-2911 | - | GAAGUCCCUGACCCCG | 17 | 3396 |
| BCL11A-2912 | - | GCGCGGCCACCUGGCCG | 17 | 3397 |
| BCL11A-2913 | + | GGCGUCGCCAGGAAGGG | 17 | 3398 |
| BCL11A-2914 | - | GUUGAAUCCAAUGGCUA | 17 | 3399 |
| BCL11A-2915 | - | CUCGGGGCGCAGCGGCA | 17 | 3400 |
| BCL11A-2916 | - | CCGAGGCCGAGGGCCAC | 17 | 3401 |
| BCL11A-2917 | + | CUAAACAGGGGGGAGU | 17 | 3402 |
| BCL11A-2918 | - | GCGGCACGGGAAGUGGA | 17 | 3403 |
| BCL11A-2919 | + | CACAGGUUGCACUUGUA | 17 | 3404 |
| BCL11A-2920 | - | CAGCGAGGCCUUCCACC | 17 | 3405 |
| BCL11A-2921 | - | AACCUGCUAAGAAUACC | 17 | 3406 |
| BCL11A-2922 | + | AUCCUGGUAUUCUUAGC | 17 | 3407 |
| BCL11A-2923 | + | GGUGGUGGACUAAACAG | 17 | 3408 |
| BCL11A-2924 | - | CGAGGCCGAGGGCCACA | 17 | 3409 |
| BCL11A-2925 | + | GUACAUGUGUAGCUGCU | 17 | 3410 |
| BCL11A-2926 | + | UUGAUGCGCUUAGAGAA | 17 | 3411 |
| BCL11A-2927 | + | UCCUCGUCCCCGUUCUC | 17 | 3412 |
| BCL11A-2928 | + | AUGACUUGGACUUGACC | 17 | 3413 |
| BCL11A-2929 | + | GUCUCCGAAGCUAAGGA | 17 | 3414 |
| BCL11A-2930 | + | GGUGGACUAAACAGGGG | 17 | 3415 |
| BCL11A-2931 | + | GCAUGUGCGUCUUCAUG | 17 | 3416 |
| BCL11A-2932 | + | GGCACUCGGGUGAUGGG | 17 | 3417 |
| BCL11A-2933 | + | AUAGGGCUGGGCCGGCC | 17 | 3418 |
| BCL11A-2934 | + | CCGUCCAGCUCCCCGGG | 17 | 3419 |
| BCL11A-2935 | + | GCAGUAACCUUUGCAUA | 17 | 3420 |
| BCL11A-2936 | - | GAUCCCUUCCUUAGCUU | 17 | 3421 |
| BCL11A-2937 | + | AAGGGCUCAGCGAGCU | 17 | 3422 |
| BCL11A-2938 | - | AGCUGACGGAGAGCGAG | 17 | 3423 |
| BCL11A-2939 | - | UCGCGGGGCGCGUCGU | 17 | 3424 |
| BCL11A-2940 | - | AGCGGCACGGGAAGUGG | 17 | 3425 |
| BCL11A-2941 | + | CAAAGGCACUCGGGUGA | 17 | 3426 |
| BCL11A-2942 | + | CUGCACCUAGUCCUGAA | 17 | 3427 |
| BCL11A-2943 | - | GCUGGACGGAGGGAUCU | 17 | 3428 |
| BCL11A-2944 | + | CCCUGUCAAAGGCACUC | 17 | 3429 |
| BCL11A-2945 | + | AACCUUUGCAUAGGGCU | 17 | 3430 |
| BCL11A-2946 | + | CGCCCGGGGAGCAGCCG | 17 | 3431 |
| BCL11A-2947 | + | UGGUGGACUAAACAGGG | 17 | 3432 |
| BCL11A-2948 | - | GGCCCAGCCCUAUGCAA | 17 | 3433 |

TABLE 4E-continued

5th Tier

| gRNA Name | DNA Strand | Targeting Domain | Target Site Length | SEQ ID NO |
|---|---|---|---|---|
| BCL11A-2949 | + | CCUCGUCCCCGUUCUCC | 17 | 3434 |
| BCL11A-2950 | - | GCCAGCUCCCCGGAACC | 17 | 3435 |
| BCL11A-2951 | + | GCCGGGUUCCGGGGAGC | 17 | 3436 |
| BCL11A-2952 | + | UGCAGUAACCUUUGCAU | 17 | 3437 |
| BCL11A-2953 | + | GCUUCUCGCCCAGGACC | 17 | 3438 |
| BCL11A-2954 | - | CCGCCCGGGGAGCUGGA | 17 | 3439 |
| BCL11A-2955 | - | CCGGGGAGCUGGACGGA | 17 | 3440 |
| BCL11A-2956 | - | CUUCCGGCCUGGCAGAA | 17 | 3441 |
| BCL11A-2957 | + | CCUAGAGAAAUCCAUGG | 17 | 3442 |
| BCL11A-2958 | + | GGAGGGGGGGCGUCGCC | 17 | 3443 |
| BCL11A-2959 | - | UACUUAGAAAGCGAACA | 17 | 3444 |
| BCL11A-2960 | + | GGAGGCUCCAUAGCCAU | 17 | 3445 |
| BCL11A-2961 | + | ACACAUCUUGAGCUCUC | 17 | 3446 |
| BCL11A-2962 | - | GGCACCAGCGACUUGGU | 17 | 3447 |
| BCL11A-2963 | + | GGGAUCUUUGAGCUGCC | 17 | 3448 |
| BCL11A-2964 | + | GCAGCAGCUUUUUGGAC | 17 | 3449 |
| BCL11A-2965 | + | CUGCAAUAUGAAUCCCA | 17 | 3450 |
| BCL11A-2966 | + | UCUGCACCUAGUCCUGA | 17 | 3451 |
| BCL11A-2967 | + | GAAGGGGCUCAGCGAGC | 17 | 3452 |
| BCL11A-2968 | + | UUCCGGGGAGCUGGCGG | 17 | 3453 |
| BCL11A-2969 | - | GCACCGGCGCAGCCACA | 17 | 3454 |
| BCL11A-2970 | + | AUAUGAAUCCCAUGGAG | 17 | 3455 |
| BCL11A-2971 | - | GUGGUCCGGGCCCGGGC | 17 | 3456 |
| BCL11A-2972 | - | CUUCACACACCCCCAUU | 17 | 3457 |
| BCL11A-2973 | - | GUCCAAAAAGCUGCUGC | 17 | 3458 |
| BCL11A-2974 | - | CGGCACCAGCGACUUGG | 17 | 3459 |
| BCL11A-2975 | - | GCUUCUCCACACCGCCC | 17 | 3460 |
| BCL11A-2976 | + | CGCCCGUGUGGCUGCGC | 17 | 3461 |
| BCL11A-2977 | - | CACGCACAGAACACUCA | 17 | 3462 |
| BCL11A-2978 | + | UGUACAUGUGUAGCUGC | 17 | 3463 |
| BCL11A-2979 | - | CACCGGCGCAGCCACAC | 17 | 3464 |
| BCL11A-2980 | + | UUGCUACCUGGCUGGAA | 17 | 3465 |
| BCL11A-2981 | + | ACCCUGUCAAAGGCACU | 17 | 3466 |
| BCL11A-2982 | - | CCACCUGGCCGAGGCCG | 17 | 3467 |
| BCL11A-2983 | + | GGGCGGAUUGCAGAGGA | 17 | 3468 |
| BCL11A-2984 | + | CUAGAGAAAUCCAUGGC | 17 | 3469 |
| BCL11A-2985 | - | GGCGGAAGAGAUGGCCC | 17 | 3470 |
| BCL11A-2986 | + | GGGGCGGAUUGCAGAGG | 17 | 3471 |
| BCL11A-2987 | - | GUGUGGCAGUUUUCGGA | 17 | 3472 |
| BCL11A-2988 | - | GAGAGAGGCUUCCGGCC | 17 | 3473 |
| BCL11A-2989 | + | CGGGUGAUGGGUGGCCA | 17 | 3474 |
| BCL11A-2990 | - | CCCGGGGAGCUGGACGG | 17 | 3475 |
| BCL11A-2991 | - | UAGGAGACUUAGAGAGC | 17 | 3476 |
| BCL11A-2992 | + | CACAUCUUGAGCUCUCU | 17 | 3477 |
| BCL11A-2993 | + | CCUCGGCCUCGGCCAGG | 17 | 3478 |
| BCL11A-2994 | - | GGCCUUCCACCAGGUCC | 17 | 3479 |
| BCL11A-2995 | + | UCUCGCCCAGGACCUGG | 17 | 3480 |
| BCL11A-2996 | + | UCUGCCCUCUUUUGAGC | 17 | 3481 |
| BCL11A-2997 | + | ACUAAACAGGGGGGGAG | 17 | 3482 |
| BCL11A-2998 | + | CUUGACCGGGGCUGGG | 17 | 3483 |
| BCL11A-2999 | + | UUGACCGGGGCUGGGA | 17 | 3484 |
| BCL11A-3000 | - | AGACUUAGAGAGCUGGC | 17 | 3485 |
| BCL11A-3001 | - | AGCCCACCGCUGUCCCC | 17 | 3486 |
| BCL11A-3002 | - | AGCCAUUCACCAGUGCA | 17 | 3487 |
| BCL11A-3003 | - | GCUUCCGGCCUGGCAGA | 17 | 3488 |
| BCL11A-3004 | - | GACUUAGAGAGCUGGCA | 17 | 3489 |
| BCL11A-3005 | - | AGGCCCAGCUCAAAAGA | 17 | 3490 |
| BCL11A-3006 | + | UCGGGUGAUGGGUGGCC | 17 | 3491 |
| BCL11A-3007 | + | CAAGAGAAACCAUGCAC | 17 | 3492 |
| BCL11A-3008 | + | AUCUUUGAGCUGCCUGG | 17 | 3493 |
| BCL11A-3009 | + | UAUUCUUAGCAGGUUAA | 17 | 3494 |
| BCL11A-3010 | + | CUGCCCUCUUUUGAGCU | 17 | 3495 |
| BCL11A-3011 | + | CCAUCUCUUCCGCCCCC | 17 | 3496 |
| BCL11A-3012 | - | UGGCCGCGGCUGCUCCC | 17 | 3497 |
| BCL11A-3013 | + | CCUGUGGCCCUCGGCCU | 17 | 3498 |
| BCL11A-3014 | + | CAGCUCCCCGGGCGGUG | 17 | 3499 |
| BCL11A-3015 | + | UUUGCAUAGGGCUGGGC | 17 | 3500 |
| BCL11A-3016 | + | GGCCCUCGGCCUCGGCC | 17 | 3501 |
| BCL11A-3017 | - | GCUGACGGAGAGCGAGA | 17 | 3502 |
| BCL11A-3018 | - | AGAUGUGUGGCAGUUUU | 17 | 3503 |
| BCL11A-3019 | + | AUUCUUAGCAGGUUAAA | 17 | 3504 |
| BCL11A-3020 | + | UCUCCUAGAGAAAUCCA | 17 | 3505 |
| BCL11A-3021 | - | CCUUUGACAGGGUGCUG | 17 | 3506 |
| BCL11A-3022 | + | GGAGGGGCGGAUUGCAG | 17 | 3507 |

TABLE 4E-continued

5th Tier

| gRNA Name | DNA Strand | Targeting Domain | Target Site Length | SEQ ID NO |
|---|---|---|---|---|
| BCL11A-3023 | + | UUCUUAGCAGGUUAAAG | 17 | 3508 |
| BCL11A-3024 | + | CGGAUUGCAGAGGAGGG | 17 | 3509 |
| BCL11A-3025 | + | UUUGAGCUGGGCCUGCC | 17 | 3510 |
| BCL11A-3026 | + | CUUCAGCUUGCUGGCCU | 17 | 3511 |
| BCL11A-3027 | + | CUUGAACUUGGCCACCA | 17 | 3512 |
| BCL11A-3028 | − | CUGCAACCAUUCCAGCC | 17 | 3513 |
| BCL11A-3029 | − | CAUAGAGCGCCUGGGGG | 17 | 3514 |
| BCL11A-3030 | − | GGGCGCGGUCGUGGGCG | 17 | 3515 |
| BCL11A-3031 | + | UCCCAUGGAGAGGUGGC | 17 | 3516 |
| BCL11A-3032 | − | GGCCGCGGCUGCUCCCC | 17 | 3517 |
| BCL11A-3033 | − | AUUUCAGAGCAACCUGG | 17 | 3518 |
| BCL11A-3034 | − | GCCUUCCACCAGGUCCU | 17 | 3519 |
| BCL11A-3035 | + | UGAAUCCCAUGGAGAGG | 17 | 3520 |
| BCL11A-3036 | + | UUGAGCUGGGCCUGCCC | 17 | 3521 |
| BCL11A-3037 | + | AGGGGCUCAGCGAGCUG | 17 | 3522 |
| BCL11A-3038 | + | AGGGCUUCUCGCCCGUG | 17 | 3523 |
| BCL11A-3039 | − | CACCGCUGUCCCCAGGC | 17 | 3524 |
| BCL11A-3040 | − | CAAAUUUCAGAGCAACC | 17 | 3525 |
| BCL11A-3041 | − | AGAGAGCUCAAGAUGUG | 17 | 3526 |
| BCL11A-3042 | + | AACCAUGCACUGGUGAA | 17 | 3527 |
| BCL11A-3043 | + | CCUCCGUCCAGCUCCCC | 17 | 3528 |
| BCL11A-3044 | + | AGUGUCCCUGUGGCCCU | 17 | 3529 |
| BCL11A-3045 | + | CCCUCCGUCCAGCUCCC | 17 | 3530 |
| BCL11A-3046 | + | GGCCUGGGGACAGCGGU | 17 | 3531 |
| BCL11A-3047 | + | GCCCAGCAGCAGCUUUU | 17 | 3532 |
| BCL11A-3048 | − | CAGGCCCAGCUCAAAAG | 17 | 3533 |
| BCL11A-3049 | − | CUUCGGGCUGAGCCUGG | 17 | 3534 |
| BCL11A-3050 | + | CCCAUGGAGAGGUGGCU | 17 | 3535 |
| BCL11A-3051 | − | CCCAGCCACCUCUCCAU | 17 | 3536 |
| BCL11A-3052 | + | GGGUUCCGGGGAGCUGG | 17 | 3537 |
| BCL11A-3053 | + | UAGGGCUGGGCCGGCCU | 17 | 3538 |
| BCL11A-3054 | − | CCUGGGGGCGGAAGAGA | 17 | 3539 |
| BCL11A-3055 | + | GCCCAGGACCUGGUGGA | 17 | 3540 |
| BCL11A-3056 | − | CGGGCUGAGCCUGGAGG | 17 | 3541 |
| BCL11A-3057 | − | ACCACGAGAACAGCUCG | 17 | 3542 |
| BCL11A-3058 | + | CGGCCUGGGGACAGCGG | 17 | 3543 |
| BCL11A-3059 | − | UCCAAAAGCUGCUGCU | 17 | 3544 |
| BCL11A-3060 | + | GCGCCCUUCUGCCAGGC | 17 | 3545 |
| BCL11A-3061 | − | UCCCAGCCACCUCUCCA | 17 | 3546 |
| BCL11A-3062 | − | CUCCACCGCCAGCUCCC | 17 | 3547 |
| BCL11A-3063 | + | CUGGGCCUGCCCGGGCC | 17 | 3548 |
| BCL11A-3064 | + | AGGGCUGGGCCGGCCUG | 17 | 3549 |
| BCL11A-3065 | + | AACAGGGGGGAGUGGG | 17 | 3550 |
| BCL11A-3066 | − | GGAGAACGGGACGAGG | 17 | 3551 |
| BCL11A-3067 | + | UGAUGCGCUUAGAGAAG | 17 | 3552 |
| BCL11A-3068 | + | GGAUUGCAGAGGAGGGA | 17 | 3553 |
| BCL11A-3069 | + | GGCCGGCCUGGGGACAG | 17 | 3554 |
| BCL11A-3070 | + | GAUUGCAGAGGAGGGAG | 17 | 3555 |
| BCL11A-3071 | + | AUUGCAGAGGAGGGAGG | 17 | 3556 |
| BCL11A-3072 | + | ACCGGGGCUGGGAGGG | 17 | 3557 |
| BCL11A-3073 | + | UGGAGAGGUGGCUGGGA | 17 | 3558 |
| BCL11A-3074 | + | UUGCAGAGGAGGGAGGG | 17 | 3559 |
| BCL11A-3075 | − | CGGGGACGAGGAGGAAG | 17 | 3560 |
| BCL11A-3076 | − | GACGGAGAGCGAGAGGG | 17 | 3561 |
| BCL11A-3077 | − | UCCUCCCUCCCAGCCCC | 17 | 3562 |
| BCL11A-3078 | + | GCUUCAGCUUGCUGGCC | 17 | 3563 |
| BCL11A-3079 | + | UGCAGAGGAGGGAGGGG | 17 | 3564 |
| BCL11A-3080 | + | GGGCUGGGAGGGAGGAG | 17 | 3565 |
| BCL11A-3081 | − | GGAAGAGGAGGACGACG | 17 | 3566 |
| BCL11A-3082 | + | GGGGCUGGGAGGGAGGA | 17 | 3567 |
| BCL11A-3083 | − | GGAGGACGACGAGGAAG | 17 | 3568 |
| BCL11A-3084 | − | GGAGGAGGAGGAGCUGA | 17 | 3569 |
| BCL11A-3085 | + | GGGGGCUGGGAGGGAGG | 17 | 3570 |
| BCL11A-3086 | + | CUGGGAGGGAGGAGGGG | 17 | 3571 |
| BCL11A-3087 | − | CGAGGAAGAGGAAGAAG | 17 | 3572 |
| BCL11A-3088 | − | GGACGAGGAGGAAGAGG | 17 | 3573 |
| BCL11A-3089 | − | GGAAGAAGAGGAGGAAG | 17 | 3574 |
| BCL11A-3090 | − | GGAAGAGGAAGAAGAGG | 17 | 3575 |
| BCL11A-3091 | − | AGAAGAGGAGGAAGAGG | 17 | 3576 |
| BCL11A-3092 | − | AGAGGAGGAAGAGGAGG | 17 | 3577 |
| BCL11A-3093 | − | GGAGGAAGAGGAGGAGG | 17 | 3578 |
| BCL11A-3094 | + | GUCUAUGCGGUCCGACUCGC | 20 | 3579 |
| BCL11A-3095 | + | UCGUCGGACUUGACCGUCAU | 20 | 3580 |
| BCL11A-3096 | + | CGUCGGACUUGACCGUCAUG | 20 | 3581 |

TABLE 4E-continued

5th Tier

| gRNA Name | DNA Strand | Targeting Domain | Target Site Length | SEQ ID NO |
|---|---|---|---|---|
| BCL11A-3097 | − | AUGACGGUCAAGUCCGACGA | 20 | 3582 |
| BCL11A-3098 | − | GAGUCGGACCGCAUAGACGA | 20 | 3583 |
| BCL11A-3099 | + | CGGGCCCGGACCACUAAUAU | 20 | 3584 |
| BCL11A-3100 | + | GUCGUCGGACUUGACCGUCA | 20 | 3585 |
| BCL11A-3101 | + | CUCUGGGUACUACGCCGAAU | 20 | 3586 |
| BCL11A-3102 | + | CUGGGUACUACGCCGAAUGG | 20 | 3587 |
| BCL11A-3103 | + | CCGGGCCCGGACCACUAAUA | 20 | 3588 |
| BCL11A-3104 | − | CCGCGGGUUGGUAUCCCUUC | 20 | 3589 |
| BCL11A-3105 | + | UCUGGGUACUACGCCGAAUG | 20 | 3590 |
| BCL11A-3106 | + | GGAUACCAACCCGCGGGGUC | 20 | 3591 |
| BCL11A-3107 | − | ACGCCCCAUAUUAGUGGUCC | 20 | 3592 |
| BCL11A-3108 | − | CACUUGCGACGAAGACUCGG | 20 | 3593 |
| BCL11A-3109 | + | UCUCGGGUACUACGCCGAA | 20 | 3594 |
| BCL11A-3110 | − | UAAGCGCAUCAAGCUCGAGA | 20 | 3595 |
| BCL11A-3111 | − | UGCGACGAAGACUCGGUGGC | 20 | 3596 |
| BCL11A-3112 | + | CGCGCUUAUGCUUCUCGCCC | 20 | 3597 |
| BCL11A-3113 | + | UGAAGGGAUACCAACCCGCG | 20 | 3598 |
| BCL11A-3114 | + | GGGCCCGGACCACUAAUAUG | 20 | 3599 |
| BCL11A-3115 | + | CGUGUGGGCAUCGCGGCCG | 20 | 3600 |
| BCL11A-3116 | + | UCCGUGUUGGGCAUCGCGGC | 20 | 3601 |
| BCL11A-3117 | + | GUCGGACUUGACCGUCAUGG | 20 | 3602 |
| BCL11A-3118 | + | GCGCAAACUCCCGUUCUCCG | 20 | 3603 |
| BCL11A-3119 | + | CUCCGAGGAGUGCUCCGACG | 20 | 3604 |
| BCL11A-3120 | + | CACGGACUUGAGCGCGCUGC | 20 | 3605 |
| BCL11A-3121 | − | CACGCCCCAUAUUAGUGGUC | 20 | 3606 |
| BCL11A-3122 | + | GAUACCAACCCGCGGGGUCA | 20 | 3607 |
| BCL11A-3123 | − | CAGCGCGCUCAAGUCCGUGG | 20 | 3608 |
| BCL11A-3124 | + | GGGUGCACGCGUGGUCGCAC | 20 | 3609 |
| BCL11A-3125 | − | GAAGCAUAAGCGCGGCCACC | 20 | 3610 |
| BCL11A-3126 | − | GUGCGACCACGCGUGCACCC | 20 | 3611 |
| BCL11A-3127 | + | GAGUACACGUUCUCCGUGUU | 20 | 3612 |
| BCL11A-3128 | + | GUCUCGGUGGUGGACUAAAC | 20 | 3613 |
| BCL11A-3129 | + | CCGUUCUCCGGGAUCAGGUU | 20 | 3614 |
| BCL11A-3130 | + | CGAGUACACGUUCUCCGUGU | 20 | 3615 |
| BCL11A-3131 | − | CGGAGAACGUGUACUCGCAG | 20 | 3616 |
| BCL11A-3132 | − | GGGAGCACGCCCCAUAUUAG | 20 | 3617 |
| BCL11A-3133 | − | CCAUAUUAGUGGUCCGGGCC | 20 | 3618 |
| BCL11A-3134 | + | GCCGCAGAACUCGCAUGACU | 20 | 3619 |
| BCL11A-3135 | + | CGCCCCGCGAGCUGUUCUCG | 20 | 3620 |
| BCL11A-3136 | − | GCAGUGGCUCGCCGGCUACG | 20 | 3621 |
| BCL11A-3137 | − | CAUAUUAGUGGUCCGGGCCC | 20 | 3622 |
| BCL11A-3138 | + | CUGAAGGGAUACCAACCCGC | 20 | 3623 |
| BCL11A-3139 | + | AUACCAACCCGCGGGGUCAG | 20 | 3624 |
| BCL11A-3140 | − | CAGCAGCGCGCUCAAGUCCG | 20 | 3625 |
| BCL11A-3141 | + | CGUCCCCGUUCUCCGGGAUC | 20 | 3626 |
| BCL11A-3142 | − | CACCACGAGAACAGCUCGCG | 20 | 3627 |
| BCL11A-3143 | − | GCGGUUGAAUCCAAUGGCUA | 20 | 3628 |
| BCL11A-3144 | − | GGACUUGCGACGAAGACU | 20 | 3629 |
| BCL11A-3145 | + | GUGUUGGGCAUCGCGGCCGG | 20 | 3630 |
| BCL11A-3146 | + | CUUCGUCGCAAGUGUCCCUG | 20 | 3631 |
| BCL11A-3147 | + | CCCCAGGCGCUCUAUGCGGU | 20 | 3632 |
| BCL11A-3148 | + | CCGUGUUGGGCAUCGCGGCC | 20 | 3633 |
| BCL11A-3149 | + | CGUUCUCCGGGAUCAGGUUG | 20 | 3634 |
| BCL11A-3150 | + | GCCUCUCGAUACUGAUCC | 20 | 3635 |
| BCL11A-3151 | + | UCGCAUGACUUGGACUUGAC | 20 | 3636 |
| BCL11A-3152 | − | AUCACCCGAGUGCCUUUGAC | 20 | 3637 |
| BCL11A-3153 | − | UAAGCGCGGCCACCUGGCCG | 20 | 3638 |
| BCL11A-3154 | − | GCACAAAUCGUCCCCAUGA | 20 | 3639 |
| BCL11A-3155 | − | CGCCCUGCCCGACGUCAUGC | 20 | 3640 |
| BCL11A-3156 | − | CAACCUGAUCCCGGAGAACG | 20 | 3641 |
| BCL11A-3157 | − | CGGAGCACUCCUCGGAGAAC | 20 | 3642 |
| BCL11A-3158 | − | AGACUCGGUGGCCGGCGAGU | 20 | 3643 |
| BCL11A-3159 | + | GGCGGUGGAGAGACCGUCGU | 20 | 3644 |
| BCL11A-3160 | − | GUGUACUCGCAGUGGCUCGC | 20 | 3645 |
| BCL11A-3161 | − | UCGGAGCACUCCUCGGAGAA | 20 | 3646 |
| BCL11A-3162 | − | CCCGGCCGCGAUGCCCAACA | 20 | 3647 |
| BCL11A-3163 | + | CCCGUUCUCCGGGAUCAGGU | 20 | 3648 |
| BCL11A-3164 | + | UCGUGGUGGACUAAACAGG | 20 | 3649 |
| BCL11A-3165 | + | CCUGAAGGGAUACCAACCCG | 20 | 3650 |
| BCL11A-3166 | + | GUCGUUCUCGCUCUUGAACU | 20 | 3651 |
| BCL11A-3167 | − | CCCCACCGCAUAGAGCGCCU | 20 | 3652 |
| BCL11A-3168 | + | GUCGCUGGUGCCGGGUUCCG | 20 | 3653 |
| BCL11A-3169 | − | CGAGAACAGCUCGCGGGGCG | 20 | 3654 |
| BCL11A-3170 | + | CGCAUGACUUGGACUUGACC | 20 | 3655 |

TABLE 4E-continued

5th Tier

| gRNA Name | DNA Strand | Targeting Domain | Target Site Length | SEQ ID NO |
|---|---|---|---|---|
| BCL11A-3171 | - | CCCACCGCAUAGAGCGCCUG | 20 | 3656 |
| BCL11A-3172 | + | AAGUCGCUGGUGCCGGGUUC | 20 | 3657 |
| BCL11A-3173 | + | CGAGGAGUGCUCCGACGAGG | 20 | 3658 |
| BCL11A-3174 | - | UCCCCGGGCGAGUCGGCCUC | 20 | 3659 |
| BCL11A-3175 | - | CUCCCCGGGCGAGUCGGCCU | 20 | 3660 |
| BCL11A-3176 | + | CAUGACUUGGACUUGACCGG | 20 | 3661 |
| BCL11A-3177 | - | AGCUCGCGGGGCGCGGUCGU | 20 | 3662 |
| BCL11A-3178 | + | UGCUCCGACGAGGAGGCAAA | 20 | 3663 |
| BCL11A-3179 | + | CUUUUGGACAGGCCCCCCG | 20 | 3664 |
| BCL11A-3180 | - | CUACGGCUUCGGGCUGAGCC | 20 | 3665 |
| BCL11A-3181 | - | CCCCGGGCGAGUCGGCCUCG | 20 | 3666 |
| BCL11A-3182 | + | UAACAGUGCCAUCGUCUAUG | 20 | 3667 |
| BCL11A-3183 | - | CUCCUCGUCGGAGCACUCCU | 20 | 3668 |
| BCL11A-3184 | - | CCCGGCACCAGCGACUUGGU | 20 | 3669 |
| BCL11A-3185 | - | GCGCUUCUCCACACCGCCCG | 20 | 3670 |
| BCL11A-3186 | + | CUCGGUGGUGGACUAAACAG | 20 | 3671 |
| BCL11A-3187 | - | CCCCCACCGCAUAGAGCGCC | 20 | 3672 |
| BCL11A-3188 | - | GAUCCCGGAGAACGGGGACG | 20 | 3673 |
| BCL11A-3189 | + | CCAGGCGCUCUAUGCGGUGG | 20 | 3674 |
| BCL11A-3190 | - | UUAGUGGUCCGGGCCCGGGC | 20 | 3675 |
| BCL11A-3191 | + | CCCAGGCGCUCUAUGCGGUG | 20 | 3676 |
| BCL11A-3192 | - | CGGCUGCUCCCCGGGCGAGU | 20 | 3677 |
| BCL11A-3193 | - | UCGCCGGCUACGCGGCCUCC | 20 | 3678 |
| BCL11A-3194 | - | AUCGAGAGAGGCUUCCGGCC | 20 | 3679 |
| BCL11A-3195 | + | GGGUCCAAGUGAUGUCUCGG | 20 | 3680 |
| BCL11A-3196 | - | AUCGCCUUUUGCCUCCUCGU | 20 | 3681 |
| BCL11A-3197 | - | AUCUCGGGGCGCAGCGGCAC | 20 | 3682 |
| BCL11A-3198 | + | CGGUGGUGGACUAAACAGGG | 20 | 3683 |
| BCL11A-3199 | - | GAUGGCACUGUUAAUGGCCG | 20 | 3684 |
| BCL11A-3200 | + | UGCCCUGCAUGACGUCGGGC | 20 | 3685 |
| BCL11A-3201 | + | UCUCGGUGGUGGACUAAACA | 20 | 3686 |
| BCL11A-3202 | - | AGAGGGUGGACUACGGCUUC | 20 | 3687 |
| BCL11A-3203 | + | CCCCGAGGCCGACUCGCCCG | 20 | 3688 |
| BCL11A-3204 | - | GAUCUCGGGGCGCAGCGGCA | 20 | 3689 |
| BCL11A-3205 | - | ACGGAAGUCCCCUGACCCCG | 20 | 3690 |
| BCL11A-3206 | + | ACUCGCCCGGGGAGCAGCCG | 20 | 3691 |
| BCL11A-3207 | - | UUGCGCUUCUCCACACCGCC | 20 | 3692 |
| BCL11A-3208 | - | GGAACCCGGCACCAGCGACU | 20 | 3693 |
| BCL11A-3209 | + | GCAUGACUUGGACUUGACCG | 20 | 3694 |
| BCL11A-3210 | - | UAAUGGCCGCGGCUGCUCCC | 20 | 3695 |
| BCL11A-3211 | - | CCGGGCGAGUCGGCCUCGGG | 20 | 3696 |
| BCL11A-3212 | + | GUCAAAGGCACUCGGGUGAU | 20 | 3697 |
| BCL11A-3213 | - | GGUGCUGCGGUUGAAUCCAA | 20 | 3698 |
| BCL11A-3214 | - | CUGGGCGAGAAGCAUAAGCG | 20 | 3699 |
| BCL11A-3215 | + | ACUUGGACUUGACCGGGGC | 20 | 3700 |
| BCL11A-3216 | + | CCCCCGAGGCCGACUCGCC | 20 | 3701 |
| BCL11A-3217 | - | CCACCGCAUAGAGCGCCUGG | 20 | 3702 |
| BCL11A-3218 | + | AGUCGCUGGUGCCGGGUUCC | 20 | 3703 |
| BCL11A-3219 | + | UCGCACAGGUUGCACUUGUA | 20 | 3704 |
| BCL11A-3220 | + | GCCCUGCAUGACGUCGGGCA | 20 | 3705 |
| BCL11A-3221 | + | CCGCCCCAGGCGCUCUAUG | 20 | 3706 |
| BCL11A-3222 | - | GCCCUGCCCGACGUCAUGCA | 20 | 3707 |
| BCL11A-3223 | + | GUCGCACAGGUUGCACUUGU | 20 | 3708 |
| BCL11A-3224 | - | AGGUAGCAAGCCGCCCUUCC | 20 | 3709 |
| BCL11A-3225 | - | CCAACCUGAUCCCGGAGAAC | 20 | 3710 |
| BCL11A-3226 | + | AGGAAGGGCGGCUUGCUACC | 20 | 3711 |
| BCL11A-3227 | - | GAAGGAGUUCGACCUGCCCC | 20 | 3712 |
| BCL11A-3228 | + | CUUGGACUUGACCGGGGCU | 20 | 3713 |
| BCL11A-3229 | - | GAGAGGGUGGACUACGGCUU | 20 | 3714 |
| BCL11A-3230 | - | UCCAAGUCAUGCGAGUUCUG | 20 | 3715 |
| BCL11A-3231 | - | ACCCGGCACCAGCGACUUGG | 20 | 3716 |
| BCL11A-3232 | + | CCCCCAGGCGCUCUAUGCGG | 20 | 3717 |
| BCL11A-3233 | + | GCGUCUGCCCUCUUUUGAGC | 20 | 3718 |
| BCL11A-3234 | - | GCCCGACGUCAUGCAGGGCA | 20 | 3719 |
| BCL11A-3235 | + | GAGCUUGAUGCGCUUAGAGA | 20 | 3720 |
| BCL11A-3236 | - | CAGCUCGCGGGGCGCGGUCG | 20 | 3721 |
| BCL11A-3237 | + | CGUGGUGGCGCGCCGCCUCC | 20 | 3722 |
| BCL11A-3238 | - | UCACCCGAGUGCCUUUGACA | 20 | 3723 |
| BCL11A-3239 | - | GAACGACCCCAACCUGAUCC | 20 | 3724 |
| BCL11A-3240 | + | CAACCGCAGCACCCUGUCAA | 20 | 3725 |
| BCL11A-3241 | + | UCCAAGUGAUGUCUCGGUGG | 20 | 3726 |
| BCL11A-3242 | + | GUUCUCCGUGUUGGGCAUCG | 20 | 3727 |
| BCL11A-3243 | - | CGGAAGUCCCCUGACCCCGC | 20 | 3728 |
| BCL11A-3244 | + | UAUGCUUCUCGCCCAGGACC | 20 | 3729 |

TABLE 4E-continued

5th Tier

| gRNA Name | DNA Strand | Targeting Domain | Target Site Length | SEQ ID NO |
|---|---|---|---|---|
| BCL11A-3245 | − | AGCUGGACGGAGGGAUCUCG | 20 | 3730 |
| BCL11A-3246 | + | GGCUGCGCCGGUGCACCACC | 20 | 3731 |
| BCL11A-3247 | − | GUUGGUAUCCCUUCAGGACU | 20 | 3732 |
| BCL11A-3248 | − | AUAGACGAUGGCACUGUUAA | 20 | 3733 |
| BCL11A-3249 | − | CUCCCGCCAUGGAUUUCUCU | 20 | 3734 |
| BCL11A-3250 | − | ACCAGGAUCAGUAUCGAGAG | 20 | 3735 |
| BCL11A-3251 | − | AGUCCCUGACCCGCGGGU | 20 | 3736 |
| BCL11A-3252 | + | GUCUGGAGUCUCCGAAGCUA | 20 | 3737 |
| BCL11A-3253 | − | GCCGGCCCAGCCCUAUGCAA | 20 | 3738 |
| BCL11A-3254 | − | GAUGUGUGGCAGUUUUCGGA | 20 | 3739 |
| BCL11A-3255 | + | CUAGAGAAAUCCAUGGCGGG | 20 | 3740 |
| BCL11A-3256 | + | GGCGCUGCCCACCAAGUCGC | 20 | 3741 |
| BCL11A-3257 | − | CCCGGGCGAGUCGGCCUCGG | 20 | 3742 |
| BCL11A-3258 | − | ACACCGCCCGGGGAGCUGGA | 20 | 3743 |
| BCL11A-3259 | + | CAGUAACCUUUGCAUAGGGC | 20 | 3744 |
| BCL11A-3260 | − | UCAGUAUCGAGAGAGGCUUC | 20 | 3745 |
| BCL11A-3261 | + | GCAUGACGUCGGGCAGGGCG | 20 | 3746 |
| BCL11A-3262 | − | CCGCAUAGAGCGCCUGGGGG | 20 | 3747 |
| BCL11A-3263 | + | CCCCCGAGGCCGACUCGCCC | 20 | 3748 |
| BCL11A-3264 | + | AGGGCGGCUUGCUACCUGGC | 20 | 3749 |
| BCL11A-3265 | + | GCACCCUGUCAAAGGCACUC | 20 | 3750 |
| BCL11A-3266 | + | CUGAUCCUGGUAUUCUUAGC | 20 | 3751 |
| BCL11A-3267 | + | CAUGUGGCGCUUCAGCUUGC | 20 | 3752 |
| BCL11A-3268 | + | CCCACCAAGUCGCUGGUGCC | 20 | 3753 |
| BCL11A-3269 | + | GGAGGCAAAAGGCGAUUGUC | 20 | 3754 |
| BCL11A-3270 | − | CCCAACCUGAUCCCGGAGAA | 20 | 3755 |
| BCL11A-3271 | + | GAGUCUCCGAAGCUAAGGAA | 20 | 3756 |
| BCL11A-3272 | − | GGCUAUGGAGCCUCCCGCCA | 20 | 3757 |
| BCL11A-3273 | + | CGUCUGCCCUCUUUUGAGCU | 20 | 3758 |
| BCL11A-3274 | − | CGCCCGGGGAGCUGGACGGA | 20 | 3759 |
| BCL11A-3275 | + | AGUAACCUUUGCAUAGGGCU | 20 | 3760 |
| BCL11A-3276 | − | UCCACCACCGAGAACAGCUC | 20 | 3761 |
| BCL11A-3277 | + | GGUUGCAGUAACCUUUGCAU | 20 | 3762 |
| BCL11A-3278 | + | GCAAUAUGAAUCCCAUGGAG | 20 | 3763 |
| BCL11A-3279 | + | ACCAUGCCCUGCAUGACGUC | 20 | 3764 |
| BCL11A-3280 | + | GGCCUCGCUGAAGUGCUGCA | 20 | 3765 |
| BCL11A-3281 | − | AGAGCAACCUGGUGGUGCAC | 20 | 3766 |
| BCL11A-3282 | + | GCCCACCAAGUCGCUGGUGC | 20 | 3767 |
| BCL11A-3283 | + | UGUCAAAGGCACUCGGGUGA | 20 | 3768 |
| BCL11A-3284 | + | AGCUUGAUGCGCUUAGAGAA | 20 | 3769 |
| BCL11A-3285 | + | AGGGGGGGCGUCGCCAGGAA | 20 | 3770 |
| BCL11A-3286 | + | GUGGAAAGCGCCCUUCUGCC | 20 | 3771 |
| BCL11A-3287 | + | UGGGGGUCCAAGUGAUGUCU | 20 | 3772 |
| BCL11A-3288 | − | CUCCAUGCAGCACUUCAGCG | 20 | 3773 |
| BCL11A-3289 | + | GCGCUUCAGCUUGCUGGCCU | 20 | 3774 |
| BCL11A-3290 | − | CUUCAGCGAGGCCUUCCACC | 20 | 3775 |
| BCL11A-3291 | + | GGAGUCUCCGAAGCUAAGGA | 20 | 3776 |
| BCL11A-3292 | + | CACUCGGGUGAUGGGUGGCC | 20 | 3777 |
| BCL11A-3293 | − | UGCGCUUCUCCACACCGCCC | 20 | 3778 |
| BCL11A-3294 | + | GGUGGUGGACUAAACAGGGG | 20 | 3779 |
| BCL11A-3295 | − | CGAGGCCUUCCACCAGGUCC | 20 | 3780 |
| BCL11A-3296 | − | AAUGGCCGCGGCUGCUCCCC | 20 | 3781 |
| BCL11A-3297 | + | GUUGUACAUGUGUAGCUGCU | 20 | 3782 |
| BCL11A-3298 | − | GUUCUUCACACACCCCCAUU | 20 | 3783 |
| BCL11A-3299 | − | CGCAGCGGCACGGGAAGUGG | 20 | 3784 |
| BCL11A-3300 | + | GCGGGAGGCUCCAUAGCCAU | 20 | 3785 |
| BCL11A-3301 | − | GGUGCACCGGCGCAGCCACA | 20 | 3786 |
| BCL11A-3302 | − | CUCCACACCGCCCGGGGAGC | 20 | 3787 |
| BCL11A-3303 | + | AAAGCGCCCUUCUGCCAGGC | 20 | 3788 |
| BCL11A-3304 | + | ACUCGGGUGAUGGGUGGCCA | 20 | 3789 |
| BCL11A-3305 | + | CUGCCUGGAGGCCGCUAGC | 20 | 3790 |
| BCL11A-3306 | + | GUCCAGCUCCCCGGGCGGUG | 20 | 3791 |
| BCL11A-3307 | − | GAGCUGGACGGAGGGAUCUC | 20 | 3792 |
| BCL11A-3308 | − | UCUAGCCCACCGCUGUCCCC | 20 | 3793 |
| BCL11A-3309 | + | AGUUGUACAUGUGUAGCUGC | 20 | 3794 |
| BCL11A-3310 | + | AUUCUGCACCUAGUCCUGAA | 20 | 3795 |
| BCL11A-3311 | − | CCACCACGAGAACAGCUCGC | 20 | 3796 |
| BCL11A-3312 | + | CUCCUAGAGAAAUCCAUGGC | 20 | 3797 |
| BCL11A-3313 | − | UUUAACCUGCUAAGAAUACC | 20 | 3798 |
| BCL11A-3314 | + | GGACUAAACAGGGGGGGAGU | 20 | 3799 |
| BCL11A-3315 | − | GGCCACCGGCCGAGGCCGA | 20 | 3800 |
| BCL11A-3316 | + | GGCUUGCUACCUGGCUGGAA | 20 | 3801 |
| BCL11A-3317 | + | CAUUCUGCACCUAGUCCUGA | 20 | 3802 |
| BCL11A-3318 | + | UGCUGGCCUGGGGUGCACGCG | 20 | 3803 |

TABLE 4E-continued

5th Tier

| gRNA Name | DNA Strand | Targeting Domain | Target Site Length | SEQ ID NO |
|---|---|---|---|---|
| BCL11A-3319 | + | UGUGGCCCUCGGCCUCGGCC | 20 | 3804 |
| BCL11A-3320 | - | CCGCCCGGGGAGCUGGACGG | 20 | 3805 |
| BCL11A-3321 | - | UGGCCGAGGCCGAGGGCCAC | 20 | 3806 |
| BCL11A-3322 | + | UGGGCAUCGCGGCCGGGGGC | 20 | 3807 |
| BCL11A-3323 | + | UCUCCUAGAGAAAUCCAUGG | 20 | 3808 |
| BCL11A-3324 | + | GGGCCAUCUCUUCCGCCCCC | 20 | 3809 |
| BCL11A-3325 | + | GUUGCAGUAACCUUUGCAUA | 20 | 3810 |
| BCL11A-3326 | + | AAAGGCACUCGGGUGAUGGG | 20 | 3811 |
| BCL11A-3327 | + | GAAGGGAUCUUUGAGCUGCC | 20 | 3812 |
| BCL11A-3328 | + | GCCACACAUCUUGAGCUCUC | 20 | 3813 |
| BCL11A-3329 | - | GGAGGGAUCUCGGGGCGCAG | 20 | 3814 |
| BCL11A-3330 | - | CCCGGAGAACGGGGACGAGG | 20 | 3815 |
| BCL11A-3331 | + | UGCAUAGGGCUGGGCCGGCC | 20 | 3816 |
| BCL11A-3332 | - | CGGGGCGCGGUCGUGGGCGU | 20 | 3817 |
| BCL11A-3333 | + | GAGGGGGGCGUCGCCAGGA | 20 | 3818 |
| BCL11A-3334 | - | ACCGCCAGCUCCCCGGAACC | 20 | 3819 |
| BCL11A-3335 | + | GGUAUUCUUAGCAGGUUAAA | 20 | 3820 |
| BCL11A-3336 | - | AGGCUUCCGGCCUGGCAGAA | 20 | 3821 |
| BCL11A-3337 | + | GAUCCCUCCGUCCAGCUCCC | 20 | 3822 |
| BCL11A-3338 | + | UGGUAUUCUUAGCAGGUUAA | 20 | 3823 |
| BCL11A-3339 | - | AUCUACUUAGAAAGCGAACA | 20 | 3824 |
| BCL11A-3340 | - | CGGCCACCUGGCCGAGGCCG | 20 | 3825 |
| BCL11A-3341 | - | CAACACGCACAGAACACUCA | 20 | 3826 |
| BCL11A-3342 | + | GCCGGCCUGGGGACAGCGGU | 20 | 3827 |
| BCL11A-3343 | - | GCCACCACGAGAACAGCUCG | 20 | 3828 |
| BCL11A-3344 | + | GUAUUCUUAGCAGGUUAAAG | 20 | 3829 |
| BCL11A-3345 | - | CUCUAGGAGACUUAGAGAGC | 20 | 3830 |
| BCL11A-3346 | - | AACAGCCAUUCACCAGUGCA | 20 | 3831 |
| BCL11A-3347 | + | UUGCAAGAGAAACCAUGCAC | 20 | 3832 |
| BCL11A-3348 | + | GACUUGACCGGGGCUGGGA | 20 | 3833 |
| BCL11A-3349 | + | ACCUUUGCAUAGGGCUGGGC | 20 | 3834 |
| BCL11A-3350 | + | UCUUUUGAGCUGGGCCUGCC | 20 | 3835 |
| BCL11A-3351 | - | GAGGCCUUCCACCAGGUCCU | 20 | 3836 |
| BCL11A-3352 | + | CUUUUGAGCUGGGCCUGCCC | 20 | 3837 |
| BCL11A-3353 | + | GGGAUCUUUGAGCUGCCUGG | 20 | 3838 |
| BCL11A-3354 | - | GGGCAGGCCCAGCUCAAAAG | 20 | 3839 |
| BCL11A-3355 | + | AGCACCCUGUCAAAGGCACU | 20 | 3840 |
| BCL11A-3356 | + | UGGACUAAACAGGGGGGGAG | 20 | 3841 |
| BCL11A-3357 | + | GCUCUUGAACUUGGCCACCA | 20 | 3842 |
| BCL11A-3358 | + | GAAUCCCAUGGAGAGGUGGC | 20 | 3843 |
| BCL11A-3359 | - | GUGCACCGGCGCAGCCACAC | 20 | 3844 |
| BCL11A-3360 | - | AAAGAUCCCUUCCUUAGCUU | 20 | 3845 |
| BCL11A-3361 | + | UGUCUGCAAUAUGAAUCCCA | 20 | 3846 |
| BCL11A-3362 | - | GGCAGGCCCAGCUCAAAAGA | 20 | 3847 |
| BCL11A-3363 | + | CCUCCGUCCAGCUCCCCGGG | 20 | 3848 |
| BCL11A-3364 | - | CUGUCCAAAAAGCUGCUGCU | 20 | 3849 |
| BCL11A-3365 | + | GCUUGAUGCGCUUAGAGAAG | 20 | 3850 |
| BCL11A-3366 | - | CGGCUUCGGGCUGAGCCUGG | 20 | 3851 |
| BCL11A-3367 | + | CACCAUGCCCUGCAUGACGU | 20 | 3852 |
| BCL11A-3368 | - | UCAAGAUGUGUGGCAGUUUU | 20 | 3853 |
| BCL11A-3369 | - | GUUCAAAUUUCAGAGCAACC | 20 | 3854 |
| BCL11A-3370 | + | GAGAAGGGGCUCAGCGAGCU | 20 | 3855 |
| BCL11A-3371 | - | GCAGCGGCACGGGAAGUGGA | 20 | 3856 |
| BCL11A-3372 | + | AAGUCUCCUAGAGAAAUCCA | 20 | 3857 |
| BCL11A-3373 | + | GGUGCGGGUUCCGGGGAGC | 20 | 3858 |
| BCL11A-3374 | - | CCUGUCCAAAAAGCUGCUGC | 20 | 3859 |
| BCL11A-3375 | + | AUAUGAAUCCCAUGGAGAGG | 20 | 3860 |
| BCL11A-3376 | - | GGGCGCAGCGGCACGGGAAG | 20 | 3861 |
| BCL11A-3377 | - | GGCCGAGGCCGAGGGCCACA | 20 | 3862 |
| BCL11A-3378 | + | GCAAGUGUCCCUGUGGCCCU | 20 | 3863 |
| BCL11A-3379 | + | GGACUUGACCGGGGCUGGG | 20 | 3864 |
| BCL11A-3380 | + | GCUUCUCGCCCAGGACCUGG | 20 | 3865 |
| BCL11A-3381 | - | GCGCCUGGGGCGGAAGAGA | 20 | 3866 |
| BCL11A-3382 | + | GUCCCUGUGGCCCUCGGCCU | 20 | 3867 |
| BCL11A-3383 | + | AUCCCUCCGUCCAGCUCCCC | 20 | 3868 |
| BCL11A-3384 | - | GUGCCUUUGACAGGGUGCUG | 20 | 3869 |
| BCL11A-3385 | - | CCCAGAGAGCUCAAGAUGUG | 20 | 3870 |
| BCL11A-3386 | + | GGCCCUCGGCCUCGCCAGG | 20 | 3871 |
| BCL11A-3387 | - | GAGAGCGAGAGGGUGGACUA | 20 | 3872 |
| BCL11A-3388 | + | GGGGGCGUCGCCAGGAAGGG | 20 | 3873 |
| BCL11A-3389 | + | AGAGAAGGGGCUCAGCGAGC | 20 | 3874 |
| BCL11A-3390 | + | CCACACAUCUUGAGCUCUCU | 20 | 3875 |
| BCL11A-3391 | + | GCUGCCCAGCAGCAGCUUUU | 20 | 3876 |
| BCL11A-3392 | - | GGAGCUGGACGGAGGGAUCU | 20 | 3877 |

TABLE 4E-continued

5th Tier

| gRNA Name | DNA Strand | Targeting Domain | Target Site Length | SEQ ID NO |
|---|---|---|---|---|
| BCL11A-3393 | - | GGGGGCGGAAGAGAUGGCCC | 20 | 3878 |
| BCL11A-3394 | - | AGGAGACUUAGAGAGCUGGC | 20 | 3879 |
| BCL11A-3395 | - | GAGGCUUCCGGCCUGGCAGA | 20 | 3880 |
| BCL11A-3396 | + | AAUCCCAUGGAGAGGUGGCU | 20 | 3881 |
| BCL11A-3397 | + | UGUGCAUGUGCGUCUUCAUG | 20 | 3882 |
| BCL11A-3398 | + | CUCGCCCAGGACCUGGUGGA | 20 | 3883 |
| BCL11A-3399 | + | UCCUCCUCGUCCCGUUCUC | 20 | 3884 |
| BCL11A-3400 | + | AGAAACCAUGCACUGGUGAA | 20 | 3885 |
| BCL11A-3401 | - | CUUCGGGCUGAGCCUGGAGG | 20 | 3886 |
| BCL11A-3402 | + | GCCGGGUUCCGGGGAGCUGG | 20 | 3887 |
| BCL11A-3403 | + | AGAAGGGGCUCAGCGAGCUG | 20 | 3888 |
| BCL11A-3404 | + | CUAAACAGGGGGGGAGUGGG | 20 | 3889 |
| BCL11A-3405 | - | CAAAUUUCAGAGCAACCUGG | 20 | 3890 |
| BCL11A-3406 | + | GAGGGAGGGGGGCGUCGCC | 20 | 3891 |
| BCL11A-3407 | + | CCUCCUCGUCCCCGUUCUCC | 20 | 3892 |
| BCL11A-3408 | + | CCAGCAGCAGCUUUUUGGAC | 20 | 3893 |
| BCL11A-3409 | - | GCCCACCGCUGUCCCCAGGC | 20 | 3894 |
| BCL11A-3410 | - | GGAGACUUAGAGAGCUGGCA | 20 | 3895 |
| BCL11A-3411 | - | AGGAGCUGACGGAGAGCGAG | 20 | 3896 |
| BCL11A-3412 | + | GAGGGGCGGAUUGCAGAGGA | 20 | 3897 |
| BCL11A-3413 | + | CAUAGGGCUGGGCCGGCCUG | 20 | 3898 |
| BCL11A-3414 | + | GGCGGAUUGCAGAGGAGGGA | 20 | 3899 |
| BCL11A-3415 | + | GGAGGGGCGGAUUGCAGAGG | 20 | 3900 |
| BCL11A-3416 | - | UUACUGCAACCAUUCCAGCC | 20 | 3901 |
| BCL11A-3417 | + | GCAUAGGGCUGGGCCGGCCU | 20 | 3902 |
| BCL11A-3418 | + | GGGCGGAUUGCAGAGGAGGG | 20 | 3903 |
| BCL11A-3419 | + | GGGUUCCGGGGAGCUGGCGG | 20 | 3904 |
| BCL11A-3420 | + | UCUCGCCCGUGUGGCUGCGC | 20 | 3905 |
| BCL11A-3421 | - | CUUCCCAGCCACCUCUCCAU | 20 | 3906 |
| BCL11A-3422 | - | GCUGACGGAGAGCGAGAGGG | 20 | 3907 |
| BCL11A-3423 | + | GCGGAUUGCAGAGGAGGGAG | 20 | 3908 |
| BCL11A-3424 | - | GGAGCUGACGGAGAGCGAGA | 20 | 3909 |
| BCL11A-3425 | - | UCUCUCCACCGCCAGCUCCC | 20 | 3910 |
| BCL11A-3426 | + | UUGACCGGGGCUGGGAGGG | 20 | 3911 |
| BCL11A-3427 | + | CGGAUUGCAGAGGAGGGAGG | 20 | 3912 |
| BCL11A-3428 | - | GCGGGGCGCGGUCGUGGGCG | 20 | 3913 |
| BCL11A-3429 | + | GAGCUGGGCCUGCCCGGGCC | 20 | 3914 |
| BCL11A-3430 | + | CUGGGCCGGCCUGGGGACAG | 20 | 3915 |
| BCL11A-3431 | + | UGUAGGGCUUCUCGCCCGUG | 20 | 3916 |
| BCL11A-3432 | + | CCAUGGAGAGGUGGCUGGGA | 20 | 3917 |
| BCL11A-3433 | + | GGAGGAGGGGCGGAUUGCAG | 20 | 3918 |
| BCL11A-3434 | - | CCUUCCCAGCCACCUCUCCA | 20 | 3919 |
| BCL11A-3435 | + | CCCGCGAGCUGUUCUCGUGG | 20 | 3920 |
| BCL11A-3436 | + | GAUUGCAGAGGAGGGAGGGG | 20 | 3921 |
| BCL11A-3437 | + | GGCCGGCCUGGGGACAGCGG | 20 | 3922 |
| BCL11A-3438 | + | GGAUUGCAGAGGAGGGAGGG | 20 | 3923 |
| BCL11A-3439 | + | ACCGGGGCUGGGAGGGAGG | 20 | 3924 |
| BCL11A-3440 | + | CCGGGGGCUGGGAGGGAGGA | 20 | 3925 |
| BCL11A-3441 | - | GAACGGGGACGAGGAGGAAG | 20 | 3926 |
| BCL11A-3442 | - | CCCUCCUCCCUCCCAGCCCC | 20 | 3927 |
| BCL11A-3443 | + | CGGGGGCUGGGAGGGAGGAG | 20 | 3928 |
| BCL11A-3444 | + | GGCGCUUCAGCUUGCUGGCC | 20 | 3929 |
| BCL11A-3445 | - | CGGGGACGAGGAGGAAGAGG | 20 | 3930 |
| BCL11A-3446 | - | AGAGGAGGAGGAGGAGCUGA | 20 | 3931 |
| BCL11A-3447 | + | GGGCUGGGAGGGAGGAGGGG | 20 | 3932 |
| BCL11A-3448 | - | AGAGGAGGACGACGAGGAAG | 20 | 3933 |
| BCL11A-3449 | - | CGACGAGGAAGAGGAAGAAG | 20 | 3934 |
| BCL11A-3450 | - | GGAGGAAGAGGAGGACGACG | 20 | 3935 |
| BCL11A-3451 | - | CGAGGAAGAGGAAGAAGAGG | 20 | 3936 |
| BCL11A-3452 | - | GGAAGAAGAGGAGGAAGAGG | 20 | 3937 |
| BCL11A-3453 | - | AGAGGAAGAAGAGGAGGAAG | 20 | 3938 |
| BCL11A-3454 | - | AGAAGAGGAGGAAGAGGAGG | 20 | 3939 |
| BCL11A-3455 | - | AGAGGAGGAAGAGGAGGAGG | 20 | 3940 |

Table 5A provides exemplary targeting domains for knocking out the BCL11A gene by targeting the early coding sequence the BCL11A gene selected according to first tier parameters. The targeting domains bind within first 500 bp of coding sequence downstream of start codon, good orthogonality, start with G. It is contemplated herein that the targeting domain hybridizes to the target domain through complementary base pairing. Any of the targeting domains in the table can be used with a S. aureus Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a S. aureus Cas9 (nickase) molecule to generate a single strand break. In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 5A

| gRNA Name | DNA Strand | Targeting Domain | Target Site Length | SEQ ID NO |
|---|---|---|---|---|
| BCL11A-3456 | − | GAACCAGACCACGGCCCGUU | 20 | 3941 |
| BCL11A-3457 | + | GACCUGGAUGCCAACCUCCA | 20 | 3942 |
| BCL11A-3458 | + | GAUUAGAGCUCCAUGUG | 17 | 3943 |
| BCL11A-3459 | − | GAUUGUUUAUCAACGUCAUC | 20 | 3944 |
| BCL11A-3460 | + | GCACUCAUCCCAGGCGU | 17 | 3945 |
| BCL11A-3461 | + | GGGGAUUAGAGCUCCAUGUG | 20 | 3946 |
| BCL11A-3462 | − | GUGCAGAAUAUGCCCCG | 17 | 3947 |

Table 5B provides exemplary targeting domains for knocking out the BCL11A gene by targeting the early coding sequence the BCL11A gene selected according to second tier parameters. The targeting domains bind within first 500 bp of coding sequence downstream of start codon, good orthogonality, and do not start with G. It is contemplated herein that the targeting domain hybridizes to the target domain through complementary base pairing. Any of the targeting domains in the table can be used with a *S. aureus* Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *S. aureus* Cas9 (nickase) molecule to generate a single strand break. In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 5B

2nd Tier

| gRNA Name | DNA Strand | Targeting Domain | Target Site Length | SEQ ID NO |
|---|---|---|---|---|
| BCL11A-3463 | − | AACCAGACCACGGCCCG | 17 | 3948 |
| BCL11A-3464 | + | AAUUCCCGUUUGCUUAAGUG | 20 | 3949 |
| BCL11A-3465 | − | ACCAGACCACGGCCCGU | 17 | 3950 |
| BCL11A-3466 | − | AUGAACCAGACCACGGCCCG | 20 | 3951 |
| BCL11A-3467 | + | AUUCCCGUUUGCUUAAGUGC | 20 | 3952 |
| BCL11A-3468 | − | CCAGACCACGGCCCGUU | 17 | 3953 |
| BCL11A-3469 | + | CCCGUUUGCUUAAGUGC | 17 | 3954 |
| BCL11A-3470 | + | CCUGGAUGCCAACCUCC | 17 | 3955 |
| BCL11A-3471 | + | CUGGAUGCCAACCUCCA | 17 | 3956 |
| BCL11A-3472 | + | UCAUCCUCUGGCGUGAC | 17 | 3957 |
| BCL11A-3473 | + | UCCCGUUUGCUUAAGUG | 17 | 3958 |
| BCL11A-3474 | + | UCGUCAUCCUCUGGCGUGAC | 20 | 3959 |
| BCL11A-3475 | + | UCUGCACUCAUCCCAGGCGU | 20 | 3960 |
| BCL11A-3476 | + | UCUGGUUCAUCAUCUGU | 17 | 3961 |
| BCL11A-3477 | − | UGAACCAGACCACGGCCCGU | 20 | 3962 |
| BCL11A-3478 | + | UGACCUGGAUGCCAACCUCC | 20 | 3963 |
| BCL11A-3479 | − | UGAGUGCAGAAUAUGCCCCG | 20 | 3964 |
| BCL11A-3480 | + | UGCACUCAUCCCAGGCG | 17 | 3965 |
| BCL11A-3481 | + | UGGUCUGGUUCAUCAUCUGU | 20 | 3966 |
| BCL11A-3482 | − | UGUUUAUCAACGUCAUC | 17 | 3967 |
| BCL11A-3483 | − | UGUUUAUCAACGUCAUCUAG | 20 | 3968 |
| BCL11A-3484 | − | UUAUCAACGUCAUCUAG | 17 | 3969 |
| BCL11A-3485 | + | UUCUGCACUCAUCCCAGGCG | 20 | 3970 |
| BCL11A-3486 | − | UUGUUUAUCAACGUCAUCUA | 20 | 3971 |
| BCL11A-3487 | − | UUUAUCAACGUCAUCUA | 17 | 3972 |

Table 5C provides exemplary targeting domains for knocking out the BCL11A gene by targeting the early coding sequence the BCL11A gene selected according to third tier parameters. The targeting domains bind within first 500 bp of coding sequence downstream of start codon and start with G. It is contemplated herein that the targeting domain hybridizes to the target domain through complementary base pairing. Any of the targeting domains in the table can be used with a *S. aureus* Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *S. aureus* Cas9 (nickase) molecule to generate a single strand break. In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 5C

3rd Tier

| gRNA Name | DNA Strand | Targeting Domain | Target Site Length | SEQ ID NO |
|---|---|---|---|---|
| BCL11A-3488 | − | GAAAAAAGCAUCCAAUCCCG | 20 | 3973 |
| BCL11A-3489 | + | GAGAGGCCCCUCCAGUG | 17 | 3974 |
| BCL11A-3490 | + | GAGCUCCAUGUGCAGAACGA | 20 | 3975 |
| BCL11A-3491 | − | GAGGAAUUUGCCCCAAA | 17 | 3976 |
| BCL11A-3492 | + | GAGGAGAGGCCCCUCCAGUG | 20 | 3977 |
| BCL11A-3493 | + | GAGGAGGUCAUGAUCCCCUU | 20 | 3978 |
| BCL11A-3494 | + | GAGGUCAUGAUCCCCUU | 17 | 3979 |
| BCL11A-3495 | − | GCAUCCAGGUCACGCCA | 17 | 3980 |
| BCL11A-3496 | − | GCCACCUUCCCCUUCACCAA | 20 | 3981 |
| BCL11A-3497 | − | GCCAGAUGAACUUCCCA | 17 | 3982 |
| BCL11A-3498 | − | GCCAGAUGAACUUCCCAUUG | 20 | 3983 |
| BCL11A-3499 | − | GCCCGUUGGGAGCUCCAGAA | 20 | 3984 |
| BCL11A-3500 | − | GCCUCUGCUUAGAAAAAGCU | 20 | 3985 |
| BCL11A-3501 | + | GCUCCAUGUGCAGAACG | 17 | 3986 |
| BCL11A-3502 | − | GCUCUAAUCCCCACGCC | 17 | 3987 |
| BCL11A-3503 | − | GGACAUUCUUAUUUUUA | 17 | 3988 |
| BCL11A-3504 | − | GGAGCUCUAAUCCCCACGCC | 20 | 3989 |
| BCL11A-3505 | − | GGAUCAUGACCUCCUCACCU | 20 | 3990 |
| BCL11A-3506 | + | GGAUGCCAACCUCCACGGGA | 20 | 3991 |
| BCL11A-3507 | + | GGCACUGCCCACAGGUG | 17 | 3992 |
| BCL11A-3508 | − | GGCCCGUUGGGAGCUCCAGA | 20 | 3993 |
| BCL11A-3509 | − | GGGGGACAUUCUUAUUUUUA | 20 | 3994 |
| BCL11A-3510 | − | GGUUGGCAUCCAGGUCACGC | 20 | 3995 |
| BCL11A-3511 | + | GGUUUGCCUUGCUUGCG | 17 | 3996 |

TABLE 5C-continued

3rd Tier

| gRNA Name | DNA Strand | Targeting Domain | Target Site Length | SEQ ID NO |
|---|---|---|---|---|
| BCL11A-3512 | + | GUGCAGAACGAGGGGAG | 17 | 3997 |
| BCL11A-3513 | − | GUGCCAGAUGAACUUCCCAU | 20 | 3998 |

Table 5D provides exemplary targeting domains for knocking out the BCL11A gene by targeting the early coding sequence the BCL11A gene selected according to forth tier parameters. The targeting domains bind within first 500 bp of coding sequence downstream of start codon and do not start with G. It is contemplated herein that the targeting domain hybridizes to the target domain through complementary base pairing. Any of the targeting domains in the table can be used with a *S. aureus* Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *S. aureus* Cas9 (nickase) molecule to generate a single strand break. In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 5D

4th Tier

| gRNA Name | DNA Strand | Targeting Domain | Target Site Length | SEQ ID NO |
|---|---|---|---|---|
| BCL11A-3514 | − | AAAAAGCAUCCAAUCCC | 17 | 3999 |
| BCL11A-3515 | + | AAAAAUAAGAAUGUCCCCCA | 20 | 4000 |
| BCL11A-3516 | − | AAAAGCAUCCAAUCCCG | 17 | 4001 |
| BCL11A-3517 | + | AAAAUAAGAAUGUCCCCCAA | 20 | 4002 |
| BCL11A-3518 | − | AAACCCCAGCACUUAAGCAA | 20 | 4003 |
| BCL11A-3519 | + | AAAUAAGAAUGUCCCCCAAU | 20 | 4004 |
| BCL11A-3520 | − | AACCCCAGCACUUAAGCAAA | 20 | 4005 |
| BCL11A-3521 | + | AAUAAGAAUGUCCCCCA | 17 | 4006 |
| BCL11A-3522 | − | ACCCCAGCACUUAAGCAAAC | 20 | 4007 |

TABLE 5D-continued

4th Tier

| gRNA Name | DNA Strand | Targeting Domain | Target Site Length | SEQ ID NO |
|---|---|---|---|---|
| BCL11A-3523 | - | ACCUUCCCCUUCACCAA | 17 | 4008 |
| BCL11A-3524 | + | AGAGCUCCAUGUGCAGA | 17 | 4009 |
| BCL11A-3525 | + | AGAGCUCCAUGUGCAGAACG | 20 | 4010 |
| BCL11A-3526 | - | AGAUGAACUUCCCAUUG | 17 | 4011 |
| BCL11A-3527 | - | AGCCAUUCUUACAGAUG | 17 | 4012 |
| BCL11A-3528 | + | AGCUCCAUGUGCAGAAC | 17 | 4013 |
| BCL11A-3529 | + | AGCUCCAUGUGCAGAACGAG | 20 | 4014 |
| BCL11A-3530 | - | AGCUCUAAUCCCCACGC | 17 | 4015 |
| BCL11A-3531 | - | AGGAAUUUGCCCCAAAC | 17 | 4016 |
| BCL11A-3532 | + | AGGAGGUCAUGAUCCCCUUC | 20 | 4017 |
| BCL11A-3533 | + | AGGUCAUGAUCCCCUUC | 17 | 4018 |
| BCL11A-3534 | - | AGUGCCAGAUGAACUUCCCA | 20 | 4019 |
| BCL11A-3535 | + | AUAAGAAUGUCCCCCAA | 17 | 4020 |
| BCL11A-3536 | + | AUCCCAGGCGUGGGGAU | 17 | 4021 |
| BCL11A-3537 | + | AUCCCCUUCUGGAGCUCCCA | 20 | 4022 |
| BCL11A-3538 | + | AUCUGGCACUGCCCACAGGU | 20 | 4023 |
| BCL11A-3539 | - | AUGCAAUGGCAGCCUCUGCU | 20 | 4024 |
| BCL11A-3540 | + | AUGUGCAGAACGAGGGG | 17 | 4025 |
| BCL11A-3541 | + | AUUAGAGCUCCAUGUGCAGA | 20 | 4026 |
| BCL11A-3542 | + | AUUCUGCACUCAUCCCAGGC | 20 | 4027 |
| BCL11A-3543 | - | AUUUUUAUCGAGCACAA | 17 | 4028 |
| BCL11A-3544 | - | CAAUGGCAGCCUCUGCU | 17 | 4029 |
| BCL11A-3545 | - | CACGCCUGGGAUGAGUG | 17 | 4030 |
| BCL11A-3546 | - | CAGAUGAACUUCCCAUU | 17 | 4031 |
| BCL11A-3547 | + | CAUCUCGAUUGGUGAAG | 17 | 4032 |
| BCL11A-3548 | + | CAUGUGCAGAACGAGGG | 17 | 4033 |
| BCL11A-3549 | + | CAUGUGCAGAACGAGGGGAG | 20 | 4034 |
| BCL11A-3550 | + | CCACAGCUUUUUCUAAG | 17 | 4035 |
| BCL11A-3551 | - | CCACGGCCCGUUGGGAGCUC | 20 | 4036 |
| BCL11A-3552 | - | CCAGAUGAACUUCCCAU | 17 | 4037 |
| BCL11A-3553 | - | CCAGCACUUAAGCAAAC | 17 | 4038 |
| BCL11A-3554 | - | CCCAGCACUUAAGCAAA | 17 | 4039 |
| BCL11A-3555 | - | CCCCACGCCUGGGAUGAGUG | 20 | 4040 |
| BCL11A-3556 | - | CCCCAGCACUUAAGCAA | 17 | 4041 |
| BCL11A-3557 | - | CCCCUUCACCAAUCGAG | 17 | 4042 |
| BCL11A-3558 | - | CCCGUUGGGAGCUCCAG | 17 | 4043 |
| BCL11A-3559 | + | CCCUUCUGGAGCUCCCA | 17 | 4044 |
| BCL11A-3560 | - | CCGUUGGGAGCUCCAGA | 17 | 4045 |
| BCL11A-3561 | - | CCUGUGGGCAGUGCCAG | 17 | 4046 |
| BCL11A-3562 | - | CGGCCCGUUGGGAGCUC | 17 | 4047 |
| BCL11A-3563 | - | CGGCCCGUUGGGAGCUCCAG | 20 | 4048 |
| BCL11A-3564 | - | CGUUGGGAGCUCCAGAA | 17 | 4049 |
| BCL11A-3565 | + | CGUUUGUGCUCGAUAAAAAU | 20 | 4050 |
| BCL11A-3566 | - | CUAGAGGAAUUUGCCCCAAA | 20 | 4051 |
| BCL11A-3567 | + | CUCAUCCCAGGCGUGGGGAU | 20 | 4052 |
| BCL11A-3568 | + | CUCCAUGUGCAGAACGA | 17 | 4053 |
| BCL11A-3569 | + | CUCCAUGUGCAGAACGAGGG | 20 | 4054 |
| BCL11A-3570 | - | CUCCCCUCGUUCUGCAC | 17 | 4055 |
| BCL11A-3571 | - | CUCCUCCCCUCGUUCUGCAC | 20 | 4056 |
| BCL11A-3572 | - | CUCUAAUCCCCACGCCUGGG | 20 | 4057 |
| BCL11A-3573 | + | CUGCACUCAUCCCAGGC | 17 | 4058 |
| BCL11A-3574 | - | CUUAUUUUUAUCGAGCACAA | 20 | 4059 |
| BCL11A-3575 | - | CUUCCCCUUCACCAAUCGAG | 20 | 4060 |
| BCL11A-3576 | + | UAAGAAUGUCCCCCAAU | 17 | 4061 |
| BCL11A-3577 | - | UAAUCCCCACGCCUGGG | 17 | 4062 |
| BCL11A-3578 | + | UAGAGCUCCAUGUGCAGAAC | 20 | 4063 |
| BCL11A-3579 | - | UAGAGGAAUUUGCCCCAAAC | 20 | 4064 |
| BCL11A-3580 | + | UAUCCACAGCUUUUUCUAAG | 20 | 4065 |
| BCL11A-3581 | - | UCACCUGUGGGCAGUGCCAG | 20 | 4066 |
| BCL11A-3582 | + | UCAUCUCGAUUGGUGAA | 17 | 4067 |
| BCL11A-3583 | + | UCAUCUGGCACUGCCCACAG | 20 | 4068 |
| BCL11A-3584 | + | UCAUCUGUAAGAAUGGCUUC | 20 | 4069 |
| BCL11A-3585 | - | UCAUGACCUCCUCACCU | 17 | 4070 |
| BCL11A-3586 | + | UCCAUGUGCAGAACGAG | 17 | 4071 |
| BCL11A-3587 | + | UCCAUGUGCAGAACGAGGGG | 20 | 4072 |
| BCL11A-3588 | - | UCCCCUCGUUCUGCACA | 17 | 4073 |
| BCL11A-3589 | - | UCCUCCCCUCGUUCUGCACA | 20 | 4074 |
| BCL11A-3590 | - | UCUGCUUAGAAAAAGCU | 17 | 4075 |
| BCL11A-3591 | + | UCUGGCACUGCCCACAG | 17 | 4076 |
| BCL11A-3592 | + | UCUGGCACUGCCCACAGGUG | 20 | 4077 |
| BCL11A-3593 | + | UCUGUAAGAAUGGCUUC | 17 | 4078 |
| BCL11A-3594 | - | UGAAAAAGCAUCCAAUCCC | 20 | 4079 |
| BCL11A-3595 | - | UGAAGCCAUUCUUACAGAUG | 20 | 4080 |
| BCL11A-3596 | + | UGCCAACCUCCACGGGA | 17 | 4081 |

TABLE 5D-continued

4th Tier

| gRNA Name | DNA Strand | Targeting Domain | Target Site Length | SEQ ID NO |
|---|---|---|---|---|
| BCL11A-3597 | − | UGCCAGAUGAACUUCCCAUU | 20 | 4082 |
| BCL11A-3598 | + | UGCUUUUUUCAUCUCGAUUG | 20 | 4083 |
| BCL11A-3599 | − | UGGAGCUCUAAUCCCCACGC | 20 | 4084 |
| BCL11A-3600 | + | UGGCACUGCCCACAGGU | 17 | 4085 |
| BCL11A-3601 | − | UGGCAUCCAGGUCACGC | 17 | 4086 |
| BCL11A-3602 | + | UGGGGUUUGCCUUGCUUGCG | 20 | 4087 |
| BCL11A-3603 | − | UUAUUUUUAUCGAGCACAAA | 20 | 4088 |
| BCL11A-3604 | + | UUCAUCUCGAUUGGUGA | 17 | 4089 |
| BCL11A-3605 | − | UUGGCAUCCAGGUCACGCCA | 20 | 4090 |
| BCL11A-3606 | + | UUGUGCUCGAUAAAAAU | 17 | 4091 |
| BCL11A-3607 | + | UUUCAUCUCGAUUGGUG | 17 | 4092 |
| BCL11A-3608 | + | UUUCAUCUCGAUUGGUGAAG | 20 | 4093 |
| BCL11A-3609 | + | UUUUCAUCUCGAUUGGUGAA | 20 | 4094 |
| BCL11A-3610 | − | UUUUUAUCGAGCACAAA | 17 | 4095 |
| BCL11A-3611 | + | UUUUUCAUCUCGAUUGGUGA | 20 | 4096 |
| BCL11A-3612 | + | UUUUUUCAUCUCGAUUG | 17 | 4097 |
| BCL11A-3613 | + | UUUUUUCAUCUCGAUUGGUG | 20 | 4098 |

Table 5E provides exemplary targeting domains for knocking out the BCL11A gene by targeting the early coding sequence the BCL11A gene selected according to fifth tier parameters. The targeting domains target outside the first 500 bp of coding sequence downstream of start codon. It is contemplated herein that the targeting domain hybridizes to the target domain through complementary base pairing. Any of the targeting domains in the table can be used with a S. aureus Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a S. aureus Cas9 (nickase) molecule to generate a single strand break. In an embodiment, dual targeting is used to create two nicks on opposite DNA strands by using S. aureus Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 5E

5th Tier

| gRNA Name | DNA Strand | Targeting Domain | Target Site Length | SEQ ID NO |
|---|---|---|---|---|
| BCL11A-3614 | + | UCGUCGGACUUGACCGUCAU | 20 | 4099 |
| BCL11A-3615 | + | GUCGUCGGACUUGACCGUCA | 20 | 4100 |
| BCL11A-3616 | + | CGUCGUCGGACUUGACCGUC | 20 | 4101 |
| BCL11A-3617 | + | CGUCGGACUUGACCGUCAUG | 20 | 4102 |
| BCL11A-3618 | − | CCCAUAUUAGUGGUCCGGGC | 20 | 4103 |
| BCL11A-3619 | + | GCGGUCCGACUCGCCGGCCA | 20 | 4104 |
| BCL11A-3620 | + | CUCCGAGGAGUGCUCCGACG | 20 | 4105 |
| BCL11A-3621 | − | CCCCCAUUCGGCGUAGUACC | 20 | 4106 |
| BCL11A-3622 | + | UCUCCGAGGAGUGCUCCGAC | 20 | 4107 |
| BCL11A-3623 | − | CCCGCGGGUUGGUAUCCCUU | 20 | 4108 |
| BCL11A-3624 | + | GCGAGUACACGUUCUCCGUG | 20 | 4109 |
| BCL11A-3625 | − | CCCAUUCGGCGUAGUACCCA | 20 | 4110 |
| BCL11A-3626 | + | CUCCGUGUUGGGCAUCGCGG | 20 | 4111 |
| BCL11A-3627 | + | CCGCGCUUAUGCUUCUCGCC | 20 | 4112 |
| BCL11A-3628 | − | CGACGAAGACUCGGUGGCCG | 20 | 4113 |
| BCL11A-3629 | − | ACCCCACCGCAUAGAGCGC | 20 | 4114 |
| BCL11A-3630 | + | ACUACGCCGAAUGGGGGUGU | 20 | 4115 |
| BCL11A-3631 | + | CCGGGCCCGGACCACUAAUA | 20 | 4116 |
| BCL11A-3632 | + | CGCGUAGCCGGCGAGCCACU | 20 | 4117 |
| BCL11A-3633 | − | UCGGAGCACUCCUCGGAGAA | 20 | 4118 |
| BCL11A-3634 | − | CGGAGCACUCCUCGGAGAAC | 20 | 4119 |
| BCL11A-3635 | + | UCUCUGGGUACUACGCCGAA | 20 | 4120 |
| BCL11A-3636 | + | UGCCGCAGAACUCGCAUGAC | 20 | 4121 |
| BCL11A-3637 | + | GAUACCAACCCGCGGGGUCA | 20 | 4122 |
| BCL11A-3638 | + | GGAUACCAACCCGCGGGGUC | 20 | 4123 |
| BCL11A-3639 | + | GGGAUACCAACCCGCGGGGU | 20 | 4124 |
| BCL11A-3640 | − | CCCCCACCGCAUAGAGCGCC | 20 | 4125 |
| BCL11A-3641 | + | GGUUGGGUCGUUCUCGCUC | 20 | 4126 |
| BCL11A-3642 | − | GCACGCCCCAUAUUAGUGGU | 20 | 4127 |
| BCL11A-3643 | − | UAAGCGCAUCAAGCUCGAGA | 20 | 4128 |
| BCL11A-3644 | + | GUUCUCCGAGGAGUGCUCCG | 20 | 4129 |
| BCL11A-3645 | + | UCUCGAGCUUGAUGCGCUUA | 20 | 4130 |
| BCL11A-3646 | − | CUAAGCGCAUCAAGCUCGAG | 20 | 4131 |
| BCL11A-3647 | − | GUCGGAGCACUCCUCGGAGA | 20 | 4132 |
| BCL11A-3648 | − | UGGCCGCGGCUGCUCCCCGG | 20 | 4133 |

TABLE 5E-continued

5th Tier

| gRNA Name | DNA Strand | Targeting Domain | Target Site Length | SEQ ID NO |
|---|---|---|---|---|
| BCL11A-3649 | - | CCCCACCGCAUAGAGCGCCU | 20 | 4134 |
| BCL11A-3650 | + | CCUGAAGGGAUACCAACCCG | 20 | 4135 |
| BCL11A-3651 | - | GCGCUUCUCCACACCGCCCG | 20 | 4136 |
| BCL11A-3652 | - | GCGCCCUGCCCGACGUCAUG | 20 | 4137 |
| BCL11A-3653 | - | AACCCGGCACCAGCGACUUG | 20 | 4138 |
| BCL11A-3654 | + | CUCUGGGUACUACGCCGAAU | 20 | 4139 |
| BCL11A-3655 | + | CCCGUUCUCCGGGAUCAGGU | 20 | 4140 |
| BCL11A-3656 | - | GAACGACCCCAACCUGAUCC | 20 | 4141 |
| BCL11A-3657 | + | ACGCCGAAUGGGGUGUGUG | 20 | 4142 |
| BCL11A-3658 | + | GUCGCUGGUGCCGGGUUCCG | 20 | 4143 |
| BCL11A-3659 | - | CCCCGGGCGAGUCGGCCUCG | 20 | 4144 |
| BCL11A-3660 | + | CGGUGCACCACCAGGUUGCU | 20 | 4145 |
| BCL11A-3661 | - | GUCCACCACCGAGACAUCAC | 20 | 4146 |
| BCL11A-3662 | - | UUAAUGGCCGCGGCUGCUCC | 20 | 4147 |
| BCL11A-3663 | + | CUCUCUGGGUACUACGCCGA | 20 | 4148 |
| BCL11A-3664 | + | GCGCAAACUCCCGUUCUCCG | 20 | 4149 |
| BCL11A-3665 | + | CCCGGGCCCGGACCACUAAU | 20 | 4150 |
| BCL11A-3666 | + | GCCCCCAGGCGCUCUAUGCG | 20 | 4151 |
| BCL11A-3667 | - | AUCGCCUUUGCCUCCUCGU | 20 | 4152 |
| BCL11A-3668 | - | CCUCGUCGGAGCACUCCUCG | 20 | 4153 |
| BCL11A-3669 | + | GAGCUUGAUGCGCUUAGAGA | 20 | 4154 |
| BCL11A-3670 | + | CCCCGUUCUCCGGGAUCAGG | 20 | 4155 |
| BCL11A-3671 | - | CGGCCGCGAUGCCCAACACG | 20 | 4156 |
| BCL11A-3672 | + | GCCCCCGAGGCCGACUCGC | 20 | 4157 |
| BCL11A-3673 | - | CCCGGCCGCGAUGCCCAACA | 20 | 4158 |
| BCL11A-3674 | - | CUCCUCGUCGGAGCACUCCU | 20 | 4159 |
| BCL11A-3675 | + | GUCUCGGUGGUGGACUAAAC | 20 | 4160 |
| BCL11A-3676 | + | CCCCAGGCGCUCUAUGCGGU | 20 | 4161 |
| BCL11A-3677 | + | GGUCGCACAGGUUGCACUUG | 20 | 4162 |
| BCL11A-3678 | + | AGUCGCUGGUGCCGGGUUCC | 20 | 4163 |
| BCL11A-3679 | - | CCCGGUCAAGUCCAAGUCAU | 20 | 4164 |
| BCL11A-3680 | - | AGAACGACCCCAACCUGAUC | 20 | 4165 |
| BCL11A-3681 | + | UCCGUGUUGGGCAUCGCGGC | 20 | 4166 |
| BCL11A-3682 | - | CCUCCUCGUCGGAGCACUCC | 20 | 4167 |
| BCL11A-3683 | - | UCACUUGGACCCCACCGCA | 20 | 4168 |
| BCL11A-3684 | - | CCCAACCUGAUCCCGGAGAA | 20 | 4169 |
| BCL11A-3685 | - | ACUACGGCUUCGGGCUGAGC | 20 | 4170 |
| BCL11A-3686 | - | UUUGCGCUUCUCCACACCGC | 20 | 4171 |
| BCL11A-3687 | + | AAGUCGCUGGUGCCGGGUUC | 20 | 4172 |
| BCL11A-3688 | - | CCCCAACCUGAUCCCGGAGA | 20 | 4173 |
| BCL11A-3689 | - | AAGACUCGGUGGCCGGCGAG | 20 | 4174 |
| BCL11A-3690 | - | GCGCGGCCACCUGGCCGAGG | 20 | 4175 |
| BCL11A-3691 | - | AAUCGCCUUUGCCUCCUCG | 20 | 4176 |
| BCL11A-3692 | - | ACGACCCCAACCUGAUCCCG | 20 | 4177 |
| BCL11A-3693 | - | GAUCCCGGAGAACGGGACG | 20 | 4178 |
| BCL11A-3694 | + | GGGGCAGGUCGAACUCCUUC | 20 | 4179 |
| BCL11A-3695 | - | UGGCUAUGGAGCCUCCCGCC | 20 | 4180 |
| BCL11A-3696 | + | CCCCCAGGCGCUCUAUGCGG | 20 | 4181 |
| BCL11A-3697 | - | GCGGUUGAAUCCAAUGGCUA | 20 | 4182 |
| BCL11A-3698 | - | CUACGGCUUCGGGCUGAGCC | 20 | 4183 |
| BCL11A-3699 | - | ACAGCUCGCGGGGCGGUC | 20 | 4184 |
| BCL11A-3700 | - | CCCCCUGUUUAGUCCACCA | 20 | 4185 |
| BCL11A-3701 | + | CGCAUGACUUGGACUUGACC | 20 | 4186 |
| BCL11A-3702 | - | CACGGAAGUCCCCUGACCCC | 20 | 4187 |
| BCL11A-3703 | - | CCUCCCGCCAUGGAUUUCUC | 20 | 4188 |
| BCL11A-3704 | + | UCUCGGUGGUGGACUAAACA | 20 | 4189 |
| BCL11A-3705 | + | UGAACUUGGCCACCACGGAC | 20 | 4190 |
| BCL11A-3706 | - | CUUCUCUAAGCGCAUCAAGC | 20 | 4191 |
| BCL11A-3707 | + | AGCGCAAACUCCCGUUCUCC | 20 | 4192 |
| BCL11A-3708 | + | UCGGUGGUGGACUAAACAGG | 20 | 4193 |
| BCL11A-3709 | - | CGCCACCACGAGAACAGCUC | 20 | 4194 |
| BCL11A-3710 | - | CUCCCGCCAUGGAUUUCUCU | 20 | 4195 |
| BCL11A-3711 | + | CGAGCUUGAUGCGCUUAGAG | 20 | 4196 |
| BCL11A-3712 | + | AUGCCCUGCAUGACGUCGGG | 20 | 4197 |
| BCL11A-3713 | - | UCUCUAAGCGCAUCAAGCUC | 20 | 4198 |
| BCL11A-3714 | + | GUCCAAGUGAUGUCUCGGUG | 20 | 4199 |
| BCL11A-3715 | + | CCCCCGAGGCCGACUCGCCC | 20 | 4200 |
| BCL11A-3716 | + | CCCCGAGGCCGACUCGCCCG | 20 | 4201 |
| BCL11A-3717 | + | GAAAUUUGAACGUCUUGCCG | 20 | 4202 |
| BCL11A-3718 | + | GUCGCUGCGUCUGCCCUCUU | 20 | 4203 |
| BCL11A-3719 | - | UGGAGGCGGCGCGCCACCAC | 20 | 4204 |
| BCL11A-3720 | + | CUUCUCGAGCUUGAUGCGCU | 20 | 4205 |
| BCL11A-3721 | + | GAAGCGCAAACUCCCGUUCU | 20 | 4206 |
| BCL11A-3722 | - | GAGAGAGGCUUCCGGCCUGG | 20 | 4207 |

TABLE 5E-continued

5th Tier

| gRNA Name | DNA Strand | Targeting Domain | Target Site Length | SEQ ID NO |
|---|---|---|---|---|
| BCL11A-3723 | − | UCCCCGGGCGAGUCGGCCUC | 20 | 4208 |
| BCL11A-3724 | + | CAAGUCGCUGGUGCCGGGUU | 20 | 4209 |
| BCL11A-3725 | − | CAUAGAGCGCCUGGGGGCGG | 20 | 4210 |
| BCL11A-3726 | + | CUCGGUGGUGGACUAAACAG | 20 | 4211 |
| BCL11A-3727 | + | CCCCCCGAGGCCGACUCGCC | 20 | 4212 |
| BCL11A-3728 | − | GGUUUCUCUUGCAACACGCA | 20 | 4213 |
| BCL11A-3729 | + | ACUGGACUUGACCGGGGGC | 20 | 4214 |
| BCL11A-3730 | − | UGAUCCCGGAGAACGGGGAC | 20 | 4215 |
| BCL11A-3731 | + | UGUCUGGAGUCUCCGAAGCU | 20 | 4216 |
| BCL11A-3732 | − | AUGGAUUUCUCUAGGAGACU | 20 | 4217 |
| BCL11A-3733 | − | UGCGGUUGAAUCCAAUGGCU | 20 | 4218 |
| BCL11A-3734 | − | CUCCCCGGGCGAGUCGGCCU | 20 | 4219 |
| BCL11A-3735 | − | CCUGAUCCCGGAGAACGGGG | 20 | 4220 |
| BCL11A-3736 | + | UGUCUCGGUGGUGGACUAAA | 20 | 4221 |
| BCL11A-3737 | + | CGGUGGUGGACUAAACAGGG | 20 | 4222 |
| BCL11A-3738 | + | UGCCCACCAAGUCGCUGGUG | 20 | 4223 |
| BCL11A-3739 | − | CGUGGUGGCCAAGUUCAAGA | 20 | 4224 |
| BCL11A-3740 | − | CAUCACCCGAGUGCCUUUGA | 20 | 4225 |
| BCL11A-3741 | − | GCGGCAAGACGUUCAAAUUU | 20 | 4226 |
| BCL11A-3742 | + | AAGGGCUCUCGAGCUUCCAU | 20 | 4227 |
| BCL11A-3743 | + | GUCUGGAGUCUCCGAAGCUA | 20 | 4228 |
| BCL11A-3744 | − | CCCCGGCCGCGAUGCCCAAC | 20 | 4229 |
| BCL11A-3745 | + | CUGUCAAAGGCACUCGGGUG | 20 | 4230 |
| BCL11A-3746 | + | CUUGGACUUGACCGGGGGCU | 20 | 4231 |
| BCL11A-3747 | + | GACUUGGACUUGACCGGGGG | 20 | 4232 |
| BCL11A-3748 | + | UGCGUCUGCCCUCUUUUGAG | 20 | 4233 |
| BCL11A-3749 | + | GGAGGCAAAAGGCGAUUGUC | 20 | 4234 |
| BCL11A-3750 | − | GCAACACGCACAGAACACUC | 20 | 4235 |
| BCL11A-3751 | + | GCAGUAACCUUUGCAUAGGG | 20 | 4236 |
| BCL11A-3752 | − | UGGUGCACCGGCGCAGCCAC | 20 | 4237 |
| BCL11A-3753 | − | UGGUGGCCAAGUUCAAGAGC | 20 | 4238 |
| BCL11A-3754 | − | GCAUAGCGCGGCCACCUGG | 20 | 4239 |
| BCL11A-3755 | + | UUGCAUAGGGCUGGGCCGGC | 20 | 4240 |
| BCL11A-3756 | − | CCAACCUGAUCCCGGAGAAC | 20 | 4241 |
| BCL11A-3757 | − | AGAUGUGGCAGUUUUCGG | 20 | 4242 |
| BCL11A-3758 | − | CAGUUUUCGGAUGGAAGCUC | 20 | 4243 |
| BCL11A-3759 | − | GCUCCCCGGGCGAGUCGGCC | 20 | 4244 |
| BCL11A-3760 | − | GGGUGGACUACGGCUUCGGG | 20 | 4245 |
| BCL11A-3761 | − | UAUCCCUUCAGGACUAGGUG | 20 | 4246 |
| BCL11A-3762 | − | AUCUCGGGGCGCAGCGGCAC | 20 | 4247 |
| BCL11A-3763 | + | CGCUCUUGAACUUGGCCACC | 20 | 4248 |
| BCL11A-3764 | − | GCACCGGCGCAGCCACACGG | 20 | 4249 |
| BCL11A-3765 | + | GCUUCUCGCCCAGGACCUGG | 20 | 4250 |
| BCL11A-3766 | − | UCCCGGAGAACGGGGACGAG | 20 | 4251 |
| BCL11A-3767 | + | CAGCACCCUGUCAAAGGCAC | 20 | 4252 |
| BCL11A-3768 | + | CAUUCUGCACCUAGUCCUGA | 20 | 4253 |
| BCL11A-3769 | − | CUUUAACCUGCUAAGAAUAC | 20 | 4254 |
| BCL11A-3770 | − | GUCUCUCCACCGCCAGCUCC | 20 | 4255 |
| BCL11A-3771 | − | UCUCUCCACCGCCAGCUCCC | 20 | 4256 |
| BCL11A-3772 | + | UGCUUCUCGCCCAGGACCUG | 20 | 4257 |
| BCL11A-3773 | + | GCGCCGCCUCCAGGCUCAGC | 20 | 4258 |
| BCL11A-3774 | + | AGAUCCCUCCGUCCAGCUCC | 20 | 4259 |
| BCL11A-3775 | − | CGAGAGGGUGGACUACGGCU | 20 | 4260 |
| BCL11A-3776 | + | CGUCCAGCUCCCCGGGCGGU | 20 | 4261 |
| BCL11A-3777 | + | CCAGCUCUCUAAGUCUCCUA | 20 | 4262 |
| BCL11A-3778 | + | UCGCAUGACUUGGACUUGAC | 20 | 4263 |
| BCL11A-3779 | + | GCACCAUGCCCUGCAUGACG | 20 | 4264 |
| BCL11A-3780 | + | AAGGCGAUUGUCUGGAGUCU | 20 | 4265 |
| BCL11A-3781 | + | GCCUGGAGGCCGCGUAGCCG | 20 | 4266 |
| BCL11A-3782 | − | GCGGCCACCUGGCCGAGGCC | 20 | 4267 |
| BCL11A-3783 | − | AGAAUACCAGGAUCAGUAUC | 20 | 4268 |
| BCL11A-3784 | − | GAUGUGGCAGUUUUCGGA | 20 | 4269 |
| BCL11A-3785 | − | UCUCCACCGCCCGGGGAG | 20 | 4270 |
| BCL11A-3786 | − | CCUGGAGGCGGCGCGCCACC | 20 | 4271 |
| BCL11A-3787 | + | CUGGUAUUCUUAGCAGGUUA | 20 | 4272 |
| BCL11A-3788 | + | UAGAGAAGGGCUCAGCGAG | 20 | 4273 |
| BCL11A-3789 | + | GAGUGUUCUGUGCGUGUUGC | 20 | 4274 |
| BCL11A-3790 | − | AAUAACCCCUUUAACCUGCU | 20 | 4275 |
| BCL11A-3791 | + | AAAGCGCCCUUCUGCCAGGC | 20 | 4276 |
| BCL11A-3792 | + | GUCCAGCUCCCCGGGCGGUG | 20 | 4277 |
| BCL11A-3793 | + | AAGGGCGGCUUGCUACCUGG | 20 | 4278 |
| BCL11A-3794 | + | GAAAGCGCCCUUCUGCCAGG | 20 | 4279 |
| BCL11A-3795 | + | AGGGCGGCUUGCUACCUGGC | 20 | 4280 |
| BCL11A-3796 | − | CGCGGGGCGCGGUCGUGGGC | 20 | 4281 |

TABLE 5E-continued

5th Tier

| gRNA Name | DNA Strand | Targeting Domain | Target Site Length | SEQ ID NO |
|---|---|---|---|---|
| BCL11A-3797 | - | GCGAGGCCUUCCACCAGGUC | 20 | 4282 |
| BCL11A-3798 | + | ACUUCCCGUGCCGCUGCGCC | 20 | 4283 |
| BCL11A-3799 | - | GCACAGAACACUCAUGGAUU | 20 | 4284 |
| BCL11A-3800 | + | CCAGCUCCCCGGGCGGUGUG | 20 | 4285 |
| BCL11A-3801 | - | ACCGCCCGGGGAGCUGGACG | 20 | 4286 |
| BCL11A-3802 | + | UGGUUGCAGUAACCUUUGCA | 20 | 4287 |
| BCL11A-3803 | - | AGGAGACUUAGAGAGCUGGC | 20 | 4288 |
| BCL11A-3804 | - | ACCGGCGCAGCCACACGGGC | 20 | 4289 |
| BCL11A-3805 | + | ACAUUCUGCACCUAGUCCUG | 20 | 4290 |
| BCL11A-3806 | + | GUGUUCUGUGCGUGUUGCAA | 20 | 4291 |
| BCL11A-3807 | - | UGGCCCUGGCCACCCAUCAC | 20 | 4292 |
| BCL11A-3808 | + | UGCAUAGGGCUGGGCCGGCC | 20 | 4293 |
| BCL11A-3809 | - | AAUACCAGGAUCAGUAUCGA | 20 | 4294 |
| BCL11A-3810 | + | UCCUGAAGGGAUACCAACCC | 20 | 4295 |
| BCL11A-3811 | + | CUCCUAGAGAAAUCCAUGGC | 20 | 4296 |
| BCL11A-3812 | + | UGGCGGUGGAGAGACCGUCG | 20 | 4297 |
| BCL11A-3813 | - | GGAUUUCUCUAGGAGACUUA | 20 | 4298 |
| BCL11A-3814 | + | CUCGCAUGACUUGGACUUGA | 20 | 4299 |
| BCL11A-3815 | - | GAUCUCGGGGCGCAGCGGCA | 20 | 4300 |
| BCL11A-3816 | + | GGUGGUGGACUAAACAGGGG | 20 | 4301 |
| BCL11A-3817 | + | AGGCCUCGCUGAAGUGCUGC | 20 | 4302 |
| BCL11A-3818 | + | CCACCAGGUUGCUCUGAAAU | 20 | 4303 |
| BCL11A-3819 | - | ACCGCAUAGAGCGCCUGGGG | 20 | 4304 |
| BCL11A-3820 | - | CCAGCAAGCUGAAGCGCCAC | 20 | 4305 |
| BCL11A-3821 | + | GGCCUCGCUGAAGUGCUGCA | 20 | 4306 |
| BCL11A-3822 | - | CGUGCACCCAGGCCAGCAAG | 20 | 4307 |
| BCL11A-3823 | + | GGCGGGAGGCUCCAUAGCCA | 20 | 4308 |
| BCL11A-3824 | + | AGGAGGCAAAAGGCGAUUGU | 20 | 4309 |
| BCL11A-3825 | - | AAAGAUCCCUUCCUUAGCUU | 20 | 4310 |
| BCL11A-3826 | + | GGAGUCUCCGAAGCUAAGGA | 20 | 4311 |
| BCL11A-3827 | + | GCGCUUAGAGAAGGGGCUCA | 20 | 4312 |
| BCL11A-3828 | + | CAGCUUUUGGACAGGCCCC | 20 | 4313 |
| BCL11A-3829 | + | GCACUCGGGUGAUGGGUGGC | 20 | 4314 |
| BCL11A-3830 | + | CACGCCCACGACCGCGCCCC | 20 | 4315 |
| BCL11A-3831 | + | AAGUUGUACAUGUGUAGCUG | 20 | 4316 |
| BCL11A-3832 | - | AGUCCGUGGUGGCCAAGUUC | 20 | 4317 |
| BCL11A-3833 | - | CCCGGAGAACGGGGACGAGG | 20 | 4318 |
| BCL11A-3834 | - | CGGGCAGGCCCAGCUCAAAA | 20 | 4319 |
| BCL11A-3835 | + | UGGUAUUCUUAGCAGGUUAA | 20 | 4320 |
| BCL11A-3836 | + | UUGUCUGCAAUAUGAAUCCC | 20 | 4321 |
| BCL11A-3837 | + | GUCUCCUAGAGAAAUCCAUG | 20 | 4322 |
| BCL11A-3838 | + | UGGACUUGACCGGGGCUGG | 20 | 4323 |
| BCL11A-3839 | + | UGGAGUCUCCGAAGCUAAGG | 20 | 4324 |
| BCL11A-3840 | + | UGAGCUGGGCCUGCCCGGGC | 20 | 4325 |
| BCL11A-3841 | - | CAAAGAUCCCUUCCUUAGCU | 20 | 4326 |
| BCL11A-3842 | + | UGCCACACAUCUUGAGCUCU | 20 | 4327 |
| BCL11A-3843 | - | CCGCCCGGGGAGCUGGACGG | 20 | 4328 |
| BCL11A-3844 | + | AGAGAAGGGGCUCAGCGAGC | 20 | 4329 |
| BCL11A-3845 | - | GGAGACUUAGAGAGCUGGCA | 20 | 4330 |
| BCL11A-3846 | + | GAAUCCCAUGGAGAGGUGGC | 20 | 4331 |
| BCL11A-3847 | + | CGCUGAAGUGCUGCAUGGAG | 20 | 4332 |
| BCL11A-3848 | + | AGGACAUUCUGCACCUAGUC | 20 | 4333 |
| BCL11A-3849 | + | AAUCCCAUGGAGAGGUGGCU | 20 | 4334 |
| BCL11A-3850 | + | UGAGCUCUCUGGGUACUACG | 20 | 4335 |
| BCL11A-3851 | - | GGGCCACAGGGACACUUGCG | 20 | 4336 |
| BCL11A-3852 | - | UAGGAGACUUAGAGAGCUGG | 20 | 4337 |
| BCL11A-3853 | - | CCUUUGACAGGGUGCUGCGG | 20 | 4338 |
| BCL11A-3854 | - | UGGCCGAGGCCGAGGGCCAC | 20 | 4339 |
| BCL11A-3855 | + | GGAAGGGAUCUUUGAGCUGC | 20 | 4340 |
| BCL11A-3856 | + | UCUAAGUAGAUUCUUAAUCC | 20 | 4341 |
| BCL11A-3857 | - | GGGGCGCAGCGGCACGGGAA | 20 | 4342 |
| BCL11A-3858 | - | CUGGCCGAGGCCGAGGGCCA | 20 | 4343 |
| BCL11A-3859 | - | CUCAAGAUGUGUGGCAGUUU | 20 | 4344 |
| BCL11A-3860 | - | CGAAGCUAAGGAAGGGAUCU | 20 | 4345 |
| BCL11A-3861 | + | UGCCAGCUCUCUAAGUCUCC | 20 | 4346 |
| BCL11A-3862 | + | UCUCCUAGAGAAAUCCAUGG | 20 | 4347 |
| BCL11A-3863 | - | GCCACCACGAGAACAGCUCG | 20 | 4348 |
| BCL11A-3864 | + | UCUGCAAUAUGAAUCCCAUG | 20 | 4349 |
| BCL11A-3865 | - | CAGCUCCAUGCAGCACUUCA | 20 | 4350 |
| BCL11A-3866 | - | GCCUGUCCAAAAGCUGCUG | 20 | 4351 |
| BCL11A-3867 | - | UAAGAAUACCAGGAUCAGUA | 20 | 4352 |
| BCL11A-3868 | - | GGAUCUCGGGGCGCAGCGGC | 20 | 4353 |
| BCL11A-3869 | - | GGCAGUUUUCGGAUGGAAGC | 20 | 4354 |
| BCL11A-3870 | - | CGGUCGUGGGCGUGGGCGAC | 20 | 4355 |

TABLE 5E-continued

5th Tier

| gRNA Name | DNA Strand | Targeting Domain | Target Site Length | SEQ ID NO |
|---|---|---|---|---|
| BCL11A-3871 | + | GCAUCGCGGCCGGGGGCAGG | 20 | 4356 |
| BCL11A-3872 | - | AAUCUACUUAGAAAGCGAAC | 20 | 4357 |
| BCL11A-3873 | + | AAGGGGUUAUUGUCUGCAAU | 20 | 4358 |
| BCL11A-3874 | + | GGACUUGACCGGGGGCUGGG | 20 | 4359 |
| BCL11A-3875 | - | UCAUGGAUUAAGAAUCUACU | 20 | 4360 |
| BCL11A-3876 | - | AGAGGCUUCCGGCCUGGCAG | 20 | 4361 |
| BCL11A-3877 | - | GGCCUUCCACCAGGUCCUGG | 20 | 4362 |
| BCL11A-3878 | + | UGGCGCUUCAGCUUGCUGGC | 20 | 4363 |
| BCL11A-3879 | - | CCGCAUAGAGCGCUGGGGGG | 20 | 4364 |
| BCL11A-3880 | + | GGACCUGGUGGAAGGCCUCG | 20 | 4365 |
| BCL11A-3881 | - | CCUUCCACCAGGUCCUGGGC | 20 | 4366 |
| BCL11A-3882 | + | UGUCUGCAAUAUGAAUCCCA | 20 | 4367 |
| BCL11A-3883 | - | GGAGCUGGACGGAGGGAUCU | 20 | 4368 |
| BCL11A-3884 | + | GACUUGACCGGGGGCUGGGA | 20 | 4369 |
| BCL11A-3885 | - | UCCUUCCCAGCCACCUCUCC | 20 | 4370 |
| BCL11A-3886 | + | CUCUUUUGAGCUGGGCCUGC | 20 | 4371 |
| BCL11A-3887 | - | UGCGCUUCUCCACACCGCCC | 20 | 4372 |
| BCL11A-3888 | + | GCAAGAGAAACCAUGCACUG | 20 | 4373 |
| BCL11A-3889 | - | GGGAGCUGGACGGAGGGAUC | 20 | 4374 |
| BCL11A-3890 | + | GUUCCGGGGAGCUGGCGGUG | 20 | 4375 |
| BCL11A-3891 | + | UGAAUCCCAUGGAGAGGUGG | 20 | 4376 |
| BCL11A-3892 | + | CGGGUUCCGGGGAGCUGGCG | 20 | 4377 |
| BCL11A-3893 | + | GUGGACUAAACAGGGGGGGA | 20 | 4378 |
| BCL11A-3894 | + | GGCUGCCCAGCAGCAGCUUU | 20 | 4379 |
| BCL11A-3895 | + | GAAGGGAUCUUUGAGCUGCC | 20 | 4380 |
| BCL11A-3896 | - | CCUUCCCAGCCACCUCUCCA | 20 | 4381 |
| BCL11A-3897 | - | GCGCAGCGGCACGGGAAGUG | 20 | 4382 |
| BCL11A-3898 | + | GGGUUCCGGGGAGCUGGCGG | 20 | 4383 |
| BCL11A-3899 | + | UCCUCCUCGUCCCCGUUCUC | 20 | 4384 |
| BCL11A-3900 | - | GCAGCGGCACGGGAAGUGGA | 20 | 4385 |
| BCL11A-3901 | - | UGCUGGGCAGCCCCAGCUCG | 20 | 4386 |
| BCL11A-3902 | - | GGGCGCAGCGGCACGGGAAG | 20 | 4387 |
| BCL11A-3903 | - | ACACCGCCCGGGGAGCUGGA | 20 | 4388 |
| BCL11A-3904 | + | CCCAUGGAGAGGUGGCUGGG | 20 | 4389 |
| BCL11A-3905 | + | UUCCUCCUCGUCCCCGUUCU | 20 | 4390 |
| BCL11A-3906 | - | AUCUACUUAGAAAGCGAACA | 20 | 4391 |
| BCL11A-3907 | - | CCCGGGCAGGCCCAGCUCAA | 20 | 4392 |
| BCL11A-3908 | - | CACACCGCCCGGGGAGCUGG | 20 | 4393 |
| BCL11A-3909 | + | ACUAAACAGGGGGGGAGUGG | 20 | 4394 |
| BCL11A-3910 | + | GACCGGGGCUGGGAGGGAG | 20 | 4395 |
| BCL11A-3911 | + | GGGCCGGCCUGGGGACAGCG | 20 | 4396 |
| BCL11A-3912 | + | GCAUAGGGCUGGGCCGGCCU | 20 | 4397 |
| BCL11A-3913 | - | AUUAAGAAUCUACUUAGAAA | 20 | 4398 |
| BCL11A-3914 | + | CUAAACAGGGGGGAGUGGG | 20 | 4399 |
| BCL11A-3915 | + | UUGACCGGGGCUGGGAGGG | 20 | 4400 |
| BCL11A-3916 | - | CGCGGUCGUGGGCGUGGGCG | 20 | 4401 |
| BCL11A-3917 | + | GAGGGAGGGGGGCGUCGCC | 20 | 4402 |
| BCL11A-3918 | - | GGAGAACGGGGACGAGGAGG | 20 | 4403 |
| BCL11A-3919 | + | CUUGACCGGGGGCUGGGAGG | 20 | 4404 |
| BCL11A-3920 | + | GGAGGGAGGGGGGCGUCGC | 20 | 4405 |
| BCL11A-3921 | + | ACCGGGGCUGGGAGGGAGG | 20 | 4406 |
| BCL11A-3922 | - | CGCAGCGGCACGGGAAGUGG | 20 | 4407 |
| BCL11A-3923 | + | GCGGAUUGCAGAGGAGGGAG | 20 | 4408 |
| BCL11A-3924 | + | GGAGGGGGGCGUCGCCAGG | 20 | 4409 |
| BCL11A-3925 | + | GGCGGAUUGCAGAGGAGGGA | 20 | 4410 |
| BCL11A-3926 | + | GAGGGGCGGAUUGCAGAGGA | 20 | 4411 |
| BCL11A-3927 | + | GGGGCGGAUUGCAGAGGAGG | 20 | 4412 |
| BCL11A-3928 | - | GAGGAGCUGACGGAGAGCGA | 20 | 4413 |
| BCL11A-3929 | + | UCCGAAAACUGCCACACAUC | 20 | 4414 |
| BCL11A-3930 | + | CGGAUUGCAGAGGAGGGAGG | 20 | 4415 |
| BCL11A-3931 | + | GGAGGGGCGGAUUGCAGAGG | 20 | 4416 |
| BCL11A-3932 | + | GGGCGGAUUGCAGAGGAGGG | 20 | 4417 |
| BCL11A-3933 | + | AGGAGGGGCGGAUUGCAGAG | 20 | 4418 |
| BCL11A-3934 | - | AGAACGGGGACGAGGAGGAA | 20 | 4419 |
| BCL11A-3935 | + | GAGGGAGGAGGGGCGGAUUG | 20 | 4420 |
| BCL11A-3936 | - | UUGCGCUUCUCCACACCGCC | 20 | 4421 |
| BCL11A-3937 | - | AGCUGACGGAGAGCGAGAGG | 20 | 4422 |
| BCL11A-3938 | - | AGGAGGAGCUGACGGAGAGC | 20 | 4423 |
| BCL11A-3939 | + | GGGGCUGGGAGGGAGGAGGG | 20 | 4424 |
| BCL11A-3940 | + | GGGAGGAGGGGCGGAUUGCA | 20 | 4425 |
| BCL11A-3941 | + | CCGUGUUGGGCAUCGCGGCC | 20 | 4426 |
| BCL11A-3942 | - | GAACGGGGACGAGGAGGAAG | 20 | 4427 |
| BCL11A-3943 | + | GGAGGAGGGGCGGAUUGCAG | 20 | 4428 |
| BCL11A-3944 | - | GGAGGAGGAGCUGACGGAGA | 20 | 4429 |

TABLE 5E-continued

5th Tier

| gRNA Name | DNA Strand | Targeting Domain | Target Site Length | SEQ ID NO |
|---|---|---|---|---|
| BCL11A-3945 | − | ACGGGGACGAGGAGGAAGAG | 20 | 4430 |
| BCL11A-3946 | − | AGGAGGAGGAGGAGCUGACG | 20 | 4431 |
| BCL11A-3947 | − | ACGACGAGGAAGAGGAAGAA | 20 | 4432 |
| BCL11A-3948 | − | ACGAGGAAGAGGAAGAAGAG | 20 | 4433 |
| BCL11A-3949 | − | AGGAGGAAGAGGAGGACGAC | 20 | 4434 |
| BCL11A-3950 | − | AAGAGGAGGACGACGAGGAA | 20 | 4435 |
| BCL11A-3951 | − | AGAGGAGGAGGAGGAGCUGA | 20 | 4436 |
| BCL11A-3952 | − | GGAGGAAGAGGAGGACGACG | 20 | 4437 |
| BCL11A-3953 | − | CGAGGAGGAAGAGGAGGACG | 20 | 4438 |
| BCL11A-3954 | − | CGAGGAAGAGGAAGAAGAGG | 20 | 4439 |
| BCL11A-3955 | − | AAGAGGAGGAGGAGGAGCUG | 20 | 4440 |
| BCL11A-3956 | − | CGACGAGGAAGAGGAAGAAG | 20 | 4441 |
| BCL11A-3957 | − | GGAGGACGACGAGGAAGAGG | 20 | 4442 |
| BCL11A-3958 | − | AGAGGAGGACGACGAGGAAG | 20 | 4443 |
| BCL11A-3959 | − | GGACGACGAGGAAGAGGAAG | 20 | 4444 |
| BCL11A-3960 | − | GGAAGAGGAGGACGACGAGG | 20 | 4445 |
| BCL11A-3961 | − | AGGAAGAAGAGGAGGAAGAG | 20 | 4446 |
| BCL11A-3962 | − | AAGAGGAAGAAGAGGAGGAA | 20 | 4447 |
| BCL11A-3963 | − | GGAAGAGGAAGAAGAGGAGG | 20 | 4448 |
| BCL11A-3964 | − | AAGAAGAGGAGGAAGAGGAG | 20 | 4449 |
| BCL11A-3965 | − | AAGAGGAGGAAGAGGAGGAG | 20 | 4450 |
| BCL11A-3966 | − | AGAGGAAGAAGAGGAGGAAG | 20 | 4451 |
| BCL11A-3967 | − | GGAAGAGGAGGAGGAAGAGG | 20 | 4452 |
| BCL11A-3968 | − | AGAAGAGGAGGAAGAGGAGG | 20 | 4453 |
| BCL11A-3969 | − | AGAGGAGGAAGAGGAGGAGG | 20 | 4454 |
| BCL11A-3970 | + | UCGGACUUGACCGUCAU | 17 | 4455 |
| BCL11A-3971 | + | GUCGGACUUGACCGUCA | 17 | 4456 |
| BCL11A-3972 | + | CGUCGGACUUGACCGUC | 17 | 4457 |
| BCL11A-3973 | + | CGGACUUGACCGUCAUG | 17 | 4458 |
| BCL11A-3974 | − | AUAUUAGUGGUCCGGGC | 17 | 4459 |
| BCL11A-3975 | + | GUCCGACUCGCCGGCCA | 17 | 4460 |
| BCL11A-3976 | + | CGAGGAGUGCUCCGACG | 17 | 4461 |
| BCL11A-3977 | − | CCAUUCGGCGUAGUACC | 17 | 4462 |
| BCL11A-3978 | + | CCGAGGAGUGCUCCGAC | 17 | 4463 |
| BCL11A-3979 | − | GCGGGUUGGUAUCCCUU | 17 | 4464 |
| BCL11A-3980 | + | AGUACACGUUCUCCGUG | 17 | 4465 |
| BCL11A-3981 | − | AUUCGGCGUAGUACCCA | 17 | 4466 |
| BCL11A-3982 | + | CGUGUUGGGCAUCGCGG | 17 | 4467 |
| BCL11A-3983 | + | CGCUUAUGCUUCUCGCC | 17 | 4468 |
| BCL11A-3984 | − | CGAAGACUCGGUGGCCG | 17 | 4469 |
| BCL11A-3985 | − | CCCACCGCAUAGAGCGC | 17 | 4470 |
| BCL11A-3986 | + | ACGCCGAAUGGGGGUGU | 17 | 4471 |
| BCL11A-3987 | + | GGCCCGGACCACUAAUA | 17 | 4472 |
| BCL11A-3988 | + | GUAGCCGGCGAGCCACU | 17 | 4473 |
| BCL11A-3989 | − | GAGCACUCCUCGGAGAA | 17 | 4474 |
| BCL11A-3990 | − | AGCACUCCUCGGAGAAC | 17 | 4475 |
| BCL11A-3991 | + | CUGGGUACUACGCCGAA | 17 | 4476 |
| BCL11A-3992 | + | CGCAGAACUCGCAUGAC | 17 | 4477 |
| BCL11A-3993 | + | ACCAACCCGCGGGGUCA | 17 | 4478 |
| BCL11A-3994 | + | UACCAACCCGCGGGGUC | 17 | 4479 |
| BCL11A-3995 | + | AUACCAACCCGCGGGGU | 17 | 4480 |
| BCL11A-3996 | − | CCACCGCAUAGAGCGCC | 17 | 4481 |
| BCL11A-3997 | + | UGGGGUCGUUCUCGCUC | 17 | 4482 |
| BCL11A-3998 | − | CGCCCCAUAUUAGUGGU | 17 | 4483 |
| BCL11A-3999 | − | GCGCAUCAAGCUCGAGA | 17 | 4484 |
| BCL11A-4000 | + | CUCCGAGGAGUGCUCCG | 17 | 4485 |
| BCL11A-4001 | + | CGAGCUUGAUGCGCUUA | 17 | 4486 |
| BCL11A-4002 | − | AGCGCAUCAAGCUCGAG | 17 | 4487 |
| BCL11A-4003 | − | GGAGCACUCCUCGGAGA | 17 | 4488 |
| BCL11A-4004 | − | CCGCGGCUGCUCCCCGG | 17 | 4489 |
| BCL11A-4005 | − | CACCGCAUAGAGCGCCU | 17 | 4490 |
| BCL11A-4006 | + | GAAGGGAUACCAACCCG | 17 | 4491 |
| BCL11A-4007 | − | CUUCUCCACACCGCCCG | 17 | 4492 |
| BCL11A-4008 | − | CCCUGCCCGACGUCAUG | 17 | 4493 |
| BCL11A-4009 | − | CCGGCACCAGCGACUUG | 17 | 4494 |
| BCL11A-4010 | + | UGGGUACUACGCCGAAU | 17 | 4495 |
| BCL11A-4011 | + | GUUCUCCGGGAUCAGGU | 17 | 4496 |
| BCL11A-4012 | − | CGACCCCAACCUGAUCC | 17 | 4497 |
| BCL11A-4013 | + | CCGAAUGGGGUGUGUG | 17 | 4498 |
| BCL11A-4014 | + | GCUGGUGCCGGGUUCCG | 17 | 4499 |
| BCL11A-4015 | − | CGGGCGAGUCGGCCUCG | 17 | 4500 |
| BCL11A-4016 | + | UGCACCACCAGGUUGCU | 17 | 4501 |
| BCL11A-4017 | − | CACCACCGAGACAUCAC | 17 | 4502 |
| BCL11A-4018 | − | AUGGCCGCGGCUGCUCC | 17 | 4503 |

TABLE 5E-continued

5th Tier

| gRNA Name | DNA Strand | Targeting Domain | Target Site Length | SEQ ID NO |
|---|---|---|---|---|
| BCL11A-4019 | + | UCUGGGUACUACGCCGA | 17 | 4504 |
| BCL11A-4020 | + | CAAACUCCCGUUCUCCG | 17 | 4505 |
| BCL11A-4021 | + | GGGCCCGGACCACUAAU | 17 | 4506 |
| BCL11A-4022 | + | CCCAGGCGCUCUAUGCG | 17 | 4507 |
| BCL11A-4023 | − | GCCUUUUGCCUCCUCGU | 17 | 4508 |
| BCL11A-4024 | − | CGUCGGAGCACUCCUCG | 17 | 4509 |
| BCL11A-4025 | + | CUUGAUGCGCUUAGAGA | 17 | 4510 |
| BCL11A-4026 | + | CGUUCUCCGGGAUCAGG | 17 | 4511 |
| BCL11A-4027 | − | CCGCGAUGCCCAACACG | 17 | 4512 |
| BCL11A-4028 | + | CCCCGAGGCCGACUCGC | 17 | 4513 |
| BCL11A-4029 | − | GGCCGCGAUGCCCAACA | 17 | 4514 |
| BCL11A-4030 | − | CUCGUCGGAGCACUCCU | 17 | 4515 |
| BCL11A-4031 | + | UCGGUGGUGGACUAAAC | 17 | 4516 |
| BCL11A-4032 | + | CAGGCGCUCUAUGCGGU | 17 | 4517 |
| BCL11A-4033 | + | CGCACAGGUUGCACUUG | 17 | 4518 |
| BCL11A-4034 | + | CGCUGGUGCCGGGUUCC | 17 | 4519 |
| BCL11A-4035 | − | GGUCAAGUCCAAGUCAU | 17 | 4520 |
| BCL11A-4036 | − | ACGACCCCAACCUGAUC | 17 | 4521 |
| BCL11A-4037 | + | GUGUUUGGGCAUCGCGGC | 17 | 4522 |
| BCL11A-4038 | − | CCUCGUCGGAGCACUCC | 17 | 4523 |
| BCL11A-4039 | − | CUUGGACCCCACCGCA | 17 | 4524 |
| BCL11A-4040 | − | AACCUGAUCCCGGAGAA | 17 | 4525 |
| BCL11A-4041 | − | ACGGCUUCGGGCUGAGC | 17 | 4526 |
| BCL11A-4042 | − | GCGCUUCUCCACACCGC | 17 | 4527 |
| BCL11A-4043 | + | UCGCUGGUGCCGGGUUC | 17 | 4528 |
| BCL11A-4044 | − | CAACCUGAUCCCGGAGA | 17 | 4529 |
| BCL11A-4045 | − | ACUCGGUGGCCGGCGAG | 17 | 4530 |
| BCL11A-4046 | − | CGGCCACCUGGCCGAGG | 17 | 4531 |
| BCL11A-4047 | − | CGCCUUUUGCCUCCUCG | 17 | 4532 |
| BCL11A-4048 | − | ACCCCAACCUGAUCCCG | 17 | 4533 |
| BCL11A-4049 | − | CCCGGAGAACGGGGACG | 17 | 4534 |
| BCL11A-4050 | + | GCAGGUCGAACUCCUUC | 17 | 4535 |
| BCL11A-4051 | − | CUAUGGAGCCUCCCGCC | 17 | 4536 |
| BCL11A-4052 | + | CCAGGCGCUCUAUGCGG | 17 | 4537 |
| BCL11A-4053 | − | GUUGAAUCCAAUGGCUA | 17 | 4538 |
| BCL11A-4054 | − | CGGCUUCGGGCUGAGCC | 17 | 4539 |
| BCL11A-4055 | − | GCUCGCGGGGCGCGGUC | 17 | 4540 |
| BCL11A-4056 | − | CCCUGUUUAGUCCACCA | 17 | 4541 |
| BCL11A-4057 | + | AUGACUUGGACUUGACC | 17 | 4542 |
| BCL11A-4058 | − | GGAAGUCCCCUGACCCC | 17 | 4543 |
| BCL11A-4059 | − | CCCGCCAUGGAUUUCUC | 17 | 4544 |
| BCL11A-4060 | + | CGGUGGUGGACUAAACA | 17 | 4545 |
| BCL11A-4061 | + | ACUUGGCCACCACGGAC | 17 | 4546 |
| BCL11A-4062 | − | CUCUAAGCGCAUCAAGC | 17 | 4547 |
| BCL11A-4063 | + | GCAAACUCCCGUUCUCC | 17 | 4548 |
| BCL11A-4064 | + | GUGGUGGACUAAACAGG | 17 | 4549 |
| BCL11A-4065 | − | CACCACGAGAACAGCUC | 17 | 4550 |
| BCL11A-4066 | − | CCGCCAUGGAUUUCUCU | 17 | 4551 |
| BCL11A-4067 | + | GCUUGAUGCGCUUAGAG | 17 | 4552 |
| BCL11A-4068 | + | CCCUGCAUGACGUCGGG | 17 | 4553 |
| BCL11A-4069 | − | CUAAGCGCAUCAAGCUC | 17 | 4554 |
| BCL11A-4070 | + | CAAGUGAUGUCUCGGUG | 17 | 4555 |
| BCL11A-4071 | + | CCGAGGCCGACUCGCCC | 17 | 4556 |
| BCL11A-4072 | + | CGAGGCCGACUCGCCCG | 17 | 4557 |
| BCL11A-4073 | + | AUUUGAACGUCUUGCCG | 17 | 4558 |
| BCL11A-4074 | + | GCUGCGUCUGCCCUCUU | 17 | 4559 |
| BCL11A-4075 | − | AGGCGGCGCGCCACCAC | 17 | 4560 |
| BCL11A-4076 | + | CUCGAGCUUGAUGCGCU | 17 | 4561 |
| BCL11A-4077 | + | GCGCAAACUCCCGUUCU | 17 | 4562 |
| BCL11A-4078 | − | AGAGGCUUCCGGCCUGG | 17 | 4563 |
| BCL11A-4079 | − | CCGGGCGAGUCGGCCUC | 17 | 4564 |
| BCL11A-4080 | + | GUCGCUGGUGCCGGGUU | 17 | 4565 |
| BCL11A-4081 | − | AGAGCGCCUGGGGGCGG | 17 | 4566 |
| BCL11A-4082 | + | GGUGGUGGACUAAACAG | 17 | 4567 |
| BCL11A-4083 | + | CCCGAGGCCGACUCGCC | 17 | 4568 |
| BCL11A-4084 | − | UUCUCUUGCAACACGCA | 17 | 4569 |
| BCL11A-4085 | + | UGGACUUGACCGGGGC | 17 | 4570 |
| BCL11A-4086 | − | UCCCGGAGAACGGGAC | 17 | 4571 |
| BCL11A-4087 | + | CUGGAGUCUCCGAAGCU | 17 | 4572 |
| BCL11A-4088 | − | GAUUUCUCUAGGAGACU | 17 | 4573 |
| BCL11A-4089 | − | GGUUGAAUCCAAUGGCU | 17 | 4574 |
| BCL11A-4090 | − | CCCGGGCGAGUCGGCCU | 17 | 4575 |
| BCL11A-4091 | − | GAUCCCGGAGAACGGGG | 17 | 4576 |
| BCL11A-4092 | + | CUCGGUGGUGGACUAAA | 17 | 4577 |

TABLE 5E-continued

5th Tier

| gRNA Name | DNA Strand | Targeting Domain | Target Site Length | SEQ ID NO |
|---|---|---|---|---|
| BCL11A-4093 | + | UGGUGGACUAAACAGGG | 17 | 4578 |
| BCL11A-4094 | + | CCACCAAGUCGCUGGUG | 17 | 4579 |
| BCL11A-4095 | − | GGUGGCCAAGUUCAAGA | 17 | 4580 |
| BCL11A-4096 | − | CACCCGAGUGCCUUUGA | 17 | 4581 |
| BCL11A-4097 | − | GCAAGACGUUCAAAUUU | 17 | 4582 |
| BCL11A-4098 | + | GGCUCUCGAGCUUCCAU | 17 | 4583 |
| BCL11A-4099 | + | UGGAGUCUCCGAAGCUA | 17 | 4584 |
| BCL11A-4100 | − | CGGCCGCGAUGCCCAAC | 17 | 4585 |
| BCL11A-4101 | + | UCAAAGGCACUCGGGUG | 17 | 4586 |
| BCL11A-4102 | + | GGACUUGACCGGGGCU | 17 | 4587 |
| BCL11A-4103 | + | UUGGACUUGACCGGGGG | 17 | 4588 |
| BCL11A-4104 | + | GUCUGCCCUCUUUUGAG | 17 | 4589 |
| BCL11A-4105 | + | GGCAAAAGGCGAUUGUC | 17 | 4590 |
| BCL11A-4106 | − | ACACGCACAGAACACUC | 17 | 4591 |
| BCL11A-4107 | + | GUAACCUUUGCAUAGGG | 17 | 4592 |
| BCL11A-4108 | − | UGCACCGGCGCAGCCAC | 17 | 4593 |
| BCL11A-4109 | − | UGGCCAAGUUCAAGAGC | 17 | 4594 |
| BCL11A-4110 | − | UAAGCGCGGCCACCUGG | 17 | 4595 |
| BCL11A-4111 | + | CAUAGGGCUGGGCCGGC | 17 | 4596 |
| BCL11A-4112 | − | ACCUGAUCCCGGAGAAC | 17 | 4597 |
| BCL11A-4113 | − | UGUGUGGCAGUUUUCGG | 17 | 4598 |
| BCL11A-4114 | − | UUUUCGGAUGGAAGCUC | 17 | 4599 |
| BCL11A-4115 | − | CCCCGGGCGAGUCGGCC | 17 | 4600 |
| BCL11A-4116 | + | UGGACUACGGCUUCGGG | 17 | 4601 |
| BCL11A-4117 | − | CCCUUCAGGACUAGGUG | 17 | 4602 |
| BCL11A-4118 | − | UCGGGGCGCAGCGGCAC | 17 | 4603 |
| BCL11A-4119 | + | UCUUGAACUUGGCCACC | 17 | 4604 |
| BCL11A-4120 | − | CCGGCGCAGCCACACGG | 17 | 4605 |
| BCL11A-4121 | + | UCUCGCCCAGGACCUGG | 17 | 4606 |
| BCL11A-4122 | − | CGGAGAACGGGGACGAG | 17 | 4607 |
| BCL11A-4123 | + | CACCCUGUCAAAGGCAC | 17 | 4608 |
| BCL11A-4124 | + | UCUGCACCUAGUCCUGA | 17 | 4609 |
| BCL11A-4125 | − | UAACCUGCUAAGAAUAC | 17 | 4610 |
| BCL11A-4126 | − | UCUCCACCGCCAGCUCC | 17 | 4611 |
| BCL11A-4127 | − | CUCCACCGCCAGCUCCC | 17 | 4612 |
| BCL11A-4128 | + | UUCUGCCCAGGACCUG | 17 | 4613 |
| BCL11A-4129 | + | CCGCCUCCAGGCUCAGC | 17 | 4614 |
| BCL11A-4130 | + | UCCCUCCGUCCAGCUCC | 17 | 4615 |
| BCL11A-4131 | − | GAGGGUGGACUACGGCU | 17 | 4616 |
| BCL11A-4132 | + | CCAGCUCCCCGGGCGGU | 17 | 4617 |
| BCL11A-4133 | + | GCUCUCUAAGUCUCCUA | 17 | 4618 |
| BCL11A-4134 | + | CAUGACUUGGACUUGAC | 17 | 4619 |
| BCL11A-4135 | + | CCAUGCCCUGCAUGACG | 17 | 4620 |
| BCL11A-4136 | + | GCGAUUGUCUGGAGUCU | 17 | 4621 |
| BCL11A-4137 | + | UGGAGGCCGCGUAGCCG | 17 | 4622 |
| BCL11A-4138 | − | GCCACCUGGCCGAGGCC | 17 | 4623 |
| BCL11A-4139 | − | AUACCAGGAUCAGUAUC | 17 | 4624 |
| BCL11A-4140 | − | GUGUGGCAGUUUUCGGA | 17 | 4625 |
| BCL11A-4141 | − | CCACACCGCCCGGGGAG | 17 | 4626 |
| BCL11A-4142 | − | GGAGGCGGCGCGCCACC | 17 | 4627 |
| BCL11A-4143 | + | GUAUUCUUAGCAGGUUA | 17 | 4628 |
| BCL11A-4144 | + | AGAAGGGCUCAGCGAG | 17 | 4629 |
| BCL11A-4145 | + | UGUUCUGUGCGUGUUGC | 17 | 4630 |
| BCL11A-4146 | − | AACCCCUUUAACCUGCU | 17 | 4631 |
| BCL11A-4147 | + | GCGCCCUUCUGCCAGGC | 17 | 4632 |
| BCL11A-4148 | + | CAGCUCCCCGGGCGGUG | 17 | 4633 |
| BCL11A-4149 | + | GGCGGCUUGCUACCUGG | 17 | 4634 |
| BCL11A-4150 | + | AGCGCCCUUCUGCCAGG | 17 | 4635 |
| BCL11A-4151 | + | GCGGCUUGCUACCUGGC | 17 | 4636 |
| BCL11A-4152 | − | GGGGCGCGGUCGUGGGC | 17 | 4637 |
| BCL11A-4153 | − | AGGCCUUCCACCAGGUC | 17 | 4638 |
| BCL11A-4154 | + | UCCCGUGCCGCUGCGCC | 17 | 4639 |
| BCL11A-4155 | − | CAGAACACUCAUGGAUU | 17 | 4640 |
| BCL11A-4156 | + | GCUCCCCGGGCGGUGUG | 17 | 4641 |
| BCL11A-4157 | − | GCCCGGGGAGCUGGACG | 17 | 4642 |
| BCL11A-4158 | + | UUGCAGUAACCUUUGCA | 17 | 4643 |
| BCL11A-4159 | − | AGACUUAGAGAGCUGGC | 17 | 4644 |
| BCL11A-4160 | − | GGCGCAGCCACACGGGC | 17 | 4645 |
| BCL11A-4161 | + | UUCUGCACCUAGUCCUG | 17 | 4646 |
| BCL11A-4162 | + | UUCUGUGCGUGUUGCAA | 17 | 4647 |
| BCL11A-4163 | − | CCCUGGCCACCCAUCAC | 17 | 4648 |
| BCL11A-4164 | + | AUAGGGCUGGGCCGGCC | 17 | 4649 |
| BCL11A-4165 | − | ACCAGGAUCAGUAUCGA | 17 | 4650 |
| BCL11A-4166 | + | UGAAGGGAUACCAACCC | 17 | 4651 |

TABLE 5E-continued

5th Tier

| gRNA Name | DNA Strand | Targeting Domain | Target Site Length | SEQ ID NO |
|---|---|---|---|---|
| BCL11A-4167 | + | CUAGAGAAAUCCAUGGC | 17 | 4652 |
| BCL11A-4168 | + | CGGUGGAGAGACCGUCG | 17 | 4653 |
| BCL11A-4169 | − | UUUCUCUAGGAGACUUA | 17 | 4654 |
| BCL11A-4170 | + | GCAUGACUUGGACUUGA | 17 | 4655 |
| BCL11A-4171 | − | CUCGGGCGCAGCGGCA | 17 | 4656 |
| BCL11A-4172 | + | GGUGGACUAAACAGGGG | 17 | 4657 |
| BCL11A-4173 | + | CCUCGCUGAAGUGCUGC | 17 | 4658 |
| BCL11A-4174 | + | CCAGGUUGCUCUGAAAU | 17 | 4659 |
| BCL11A-4175 | − | GCAUAGAGCGCCUGGGG | 17 | 4660 |
| BCL11A-4176 | − | GCAAGCUGAAGCGCCAC | 17 | 4661 |
| BCL11A-4177 | + | CUCGCUGAAGUGCUGCA | 17 | 4662 |
| BCL11A-4178 | − | GCACCCAGGCCAGCAAG | 17 | 4663 |
| BCL11A-4179 | + | GGGAGGCUCCAUAGCCA | 17 | 4664 |
| BCL11A-4180 | + | AGGCAAAAGGCGAUUGU | 17 | 4665 |
| BCL11A-4181 | − | GAUCCCUUCCUUAGCUU | 17 | 4666 |
| BCL11A-4182 | + | GUCUCCGAAGCUAAGGA | 17 | 4667 |
| BCL11A-4183 | + | CUUAGAGAAGGGGCUCA | 17 | 4668 |
| BCL11A-4184 | + | CUUUUUGGACAGGCCCC | 17 | 4669 |
| BCL11A-4185 | + | CUCGGGUGAUGGGUGGC | 17 | 4670 |
| BCL11A-4186 | + | GCCCACGACCGCGCCCC | 17 | 4671 |
| BCL11A-4187 | + | UUGUACAUGUGUAGCUG | 17 | 4672 |
| BCL11A-4188 | − | CCGUGGUGGCCAAGUUC | 17 | 4673 |
| BCL11A-4189 | − | GGAGAACGGGGACGAGG | 17 | 4674 |
| BCL11A-4190 | − | GCAGGCCCAGCUCAAAA | 17 | 4675 |
| BCL11A-4191 | + | UAUUCUUAGCAGGUUAA | 17 | 4676 |
| BCL11A-4192 | + | UCUGCAAUAUGAAUCCC | 17 | 4677 |
| BCL11A-4193 | + | UCCUAGAGAAAUCCAUG | 17 | 4678 |
| BCL11A-4194 | + | ACUUGACCGGGGCUGG | 17 | 4679 |
| BCL11A-4195 | + | AGUCUCCGAAGCUAAGG | 17 | 4680 |
| BCL11A-4196 | + | GCUGGGCCUGCCCGGGC | 17 | 4681 |
| BCL11A-4197 | − | AGAUCCCUUCCUUAGCU | 17 | 4682 |
| BCL11A-4198 | + | CACACAUCUUGAGCUCU | 17 | 4683 |
| BCL11A-4199 | − | CCCGGGGAGCUGGACGG | 17 | 4684 |
| BCL11A-4200 | + | GAAGGGGCUCAGCGAGC | 17 | 4685 |
| BCL11A-4201 | − | GACUUAGAGAGCUGGCA | 17 | 4686 |
| BCL11A-4202 | + | UCCCAUGGAGAGGUGGC | 17 | 4687 |
| BCL11A-4203 | + | UGAAGUGCUGCAUGGAG | 17 | 4688 |
| BCL11A-4204 | + | ACAUUCUGCACCUAGUC | 17 | 4689 |
| BCL11A-4205 | + | CCCAUGGAGAGGUGGCU | 17 | 4690 |
| BCL11A-4206 | + | GCUCUCUGGGUACUACG | 17 | 4691 |
| BCL11A-4207 | − | CCACAGGGACACUUGCG | 17 | 4692 |
| BCL11A-4208 | − | GAGACUUAGAGAGCUGG | 17 | 4693 |
| BCL11A-4209 | − | UUGACAGGGUGCUGCGG | 17 | 4694 |
| BCL11A-4210 | − | CCGAGGCCGAGGGCCAC | 17 | 4695 |
| BCL11A-4211 | + | AGGGAUCUUUGAGCUGC | 17 | 4696 |
| BCL11A-4212 | + | AAGUAGAUUCUUAAUCC | 17 | 4697 |
| BCL11A-4213 | − | GCGCAGCGGCACGGGAA | 17 | 4698 |
| BCL11A-4214 | − | GCCGAGGCCGAGGGCCA | 17 | 4699 |
| BCL11A-4215 | − | AAGAUGUGUGGCAGUUU | 17 | 4700 |
| BCL11A-4216 | + | AGCUAAGGAAGGGAUCU | 17 | 4701 |
| BCL11A-4217 | + | CAGCUCUCUAAGUCUCC | 17 | 4702 |
| BCL11A-4218 | + | CCUAGAGAAAUCCAUGG | 17 | 4703 |
| BCL11A-4219 | − | ACCACGAGAACAGCUCG | 17 | 4704 |
| BCL11A-4220 | + | GCAAUAUGAAUCCCAUG | 17 | 4705 |
| BCL11A-4221 | − | CUCCAUGCAGCACUUCA | 17 | 4706 |
| BCL11A-4222 | − | UGUCCAAAAAGCUGCUG | 17 | 4707 |
| BCL11A-4223 | − | GAAUACCAGGAUCAGUA | 17 | 4708 |
| BCL11A-4224 | − | UCUCGGGCGCAGCGGC | 17 | 4709 |
| BCL11A-4225 | − | AGUUUCGGAUGGAAGC | 17 | 4710 |
| BCL11A-4226 | − | UCGUGGGCGUGGGCGAC | 17 | 4711 |
| BCL11A-4227 | + | UCGCGCCGGGGCAGG | 17 | 4712 |
| BCL11A-4228 | − | CUACUUAGAAAGCGAAC | 17 | 4713 |
| BCL11A-4229 | + | GGGUUAUUGUCUGCAAU | 17 | 4714 |
| BCL11A-4230 | + | CUUGACCGGGGCUGGG | 17 | 4715 |
| BCL11A-4231 | − | UGGAUUAAGAAUCUACU | 17 | 4716 |
| BCL11A-4232 | − | GGCUUCCGGCCUGGCAG | 17 | 4717 |
| BCL11A-4233 | − | CUUCCACCAGGUCCUGG | 17 | 4718 |
| BCL11A-4234 | + | CGCUUCAGCUUGCUGGC | 17 | 4719 |
| BCL11A-4235 | − | CAUAGAGCGCCUGGGGG | 17 | 4720 |
| BCL11A-4236 | + | CCUGGUGGAAGGCCUCG | 17 | 4721 |
| BCL11A-4237 | − | UCCACCAGGUCCUGGGC | 17 | 4722 |
| BCL11A-4238 | + | CUGCAAUAUGAAUCCCA | 17 | 4723 |
| BCL11A-4239 | − | GCUGGACGGAGGGAUCU | 17 | 4724 |
| BCL11A-4240 | + | UUGACCGGGGCUGGGA | 17 | 4725 |

TABLE 5E-continued

5th Tier

| gRNA Name | DNA Strand | Targeting Domain | Target Site Length | SEQ ID NO |
|---|---|---|---|---|
| BCL11A-4241 | - | UUCCCAGCCACCUCUCC | 17 | 4726 |
| BCL11A-4242 | + | UUUUGAGCUGGGCCUGC | 17 | 4727 |
| BCL11A-4243 | - | GCUUCUCCACACCGCCC | 17 | 4728 |
| BCL11A-4244 | + | AGAGAAACCAUGCACUG | 17 | 4729 |
| BCL11A-4245 | - | AGCUGGACGGAGGGAUC | 17 | 4730 |
| BCL11A-4246 | + | CCGGGGAGCUGGCGGUG | 17 | 4731 |
| BCL11A-4247 | + | AUCCCAUGGAGAGGUGG | 17 | 4732 |
| BCL11A-4248 | + | GUUCCGGGGAGCUGGCG | 17 | 4733 |
| BCL11A-4249 | + | GACUAAACAGGGGGGGA | 17 | 4734 |
| BCL11A-4250 | + | UGCCCAGCAGCAGCUUU | 17 | 4735 |
| BCL11A-4251 | + | GGGAUCUUUGAGCUGCC | 17 | 4736 |
| BCL11A-4252 | - | UCCCAGCCACCUCUCCA | 17 | 4737 |
| BCL11A-4253 | - | CAGCGGCACGGGAAGUG | 17 | 4738 |
| BCL11A-4254 | + | UUCCGGGGAGCUGGCGG | 17 | 4739 |
| BCL11A-4255 | + | UCCUCGUCCCCGUUCUC | 17 | 4740 |
| BCL11A-4256 | - | GCGGCACGGGAAGUGGA | 17 | 4741 |
| BCL11A-4257 | - | UGGGCAGCCCCAGCUCG | 17 | 4742 |
| BCL11A-4258 | - | CGCAGCGGCACGGGAAG | 17 | 4743 |
| BCL11A-4259 | - | CCGCCCGGGGAGCUGGA | 17 | 4744 |
| BCL11A-4260 | + | AUGGAGAGGUGGCUGGG | 17 | 4745 |
| BCL11A-4261 | + | CUCCUCGUCCCCGUUCU | 17 | 4746 |
| BCL11A-4262 | - | UACUUAGAAAGCGAACA | 17 | 4747 |
| BCL11A-4263 | - | GGGCAGGCCCAGCUCAA | 17 | 4748 |
| BCL11A-4264 | - | ACCGCCCGGGGAGCUGG | 17 | 4749 |
| BCL11A-4265 | + | AAACAGGGGGGGAGUGG | 17 | 4750 |
| BCL11A-4266 | + | CGGGGGCUGGGAGGGAG | 17 | 4751 |
| BCL11A-4267 | + | CCGGCCUGGGGACAGCG | 17 | 4752 |
| BCL11A-4268 | + | UAGGGCUGGGCCGGCCU | 17 | 4753 |
| BCL11A-4269 | - | AAGAAUCUACUUAGAAA | 17 | 4754 |
| BCL11A-4270 | + | AACAGGGGGGGAGUGGG | 17 | 4755 |
| BCL11A-4271 | + | ACCGGGGGCUGGGAGGG | 17 | 4756 |
| BCL11A-4272 | - | GGUCGUGGGCGUGGGCG | 17 | 4757 |
| BCL11A-4273 | + | GGAGGGGGGGCGUCGCC | 17 | 4758 |
| BCL11A-4274 | - | GAACGGGACGAGGAGG | 17 | 4759 |
| BCL11A-4275 | + | GACCGGGGGCUGGGAGG | 17 | 4760 |
| BCL11A-4276 | + | GGGAGGGGGGGCGUCGC | 17 | 4761 |
| BCL11A-4277 | + | GGGGGCUGGGAGGGAGG | 17 | 4762 |
| BCL11A-4278 | - | AGCGGCACGGGAAGUGG | 17 | 4763 |
| BCL11A-4279 | + | GAUUGCAGAGGAGGGAG | 17 | 4764 |
| BCL11A-4280 | + | GGGGGGGCGUCGCCAGG | 17 | 4765 |
| BCL11A-4281 | + | GGAUUGCAGAGGAGGGA | 17 | 4766 |
| BCL11A-4282 | + | GGGCGGAUUGCAGAGGA | 17 | 4767 |
| BCL11A-4283 | + | GCGGAUUGCAGAGGAGG | 17 | 4768 |
| BCL11A-4284 | - | GAGCUGACGGAGAGCGA | 17 | 4769 |
| BCL11A-4285 | + | GAAAACUGCCACACAUC | 17 | 4770 |
| BCL11A-4286 | + | AUUGCAGAGGAGGGAGG | 17 | 4771 |
| BCL11A-4287 | + | GGGGCGGAUUGCAGAGG | 17 | 4772 |
| BCL11A-4288 | + | CGGAUUGCAGAGGAGGG | 17 | 4773 |
| BCL11A-4289 | + | AGGGGCGGAUUGCAGAG | 17 | 4774 |
| BCL11A-4290 | - | ACGGGACGAGGAGGAA | 17 | 4775 |
| BCL11A-4291 | + | GGAGGAGGGGCGGAUUG | 17 | 4776 |
| BCL11A-4292 | - | CGCUUCUCCACACCGCC | 17 | 4777 |
| BCL11A-4293 | - | UGACGGAGAGCGAGAGG | 17 | 4778 |
| BCL11A-4294 | - | AGGAGCUGACGGAGAGC | 17 | 4779 |
| BCL11A-4295 | + | GCUGGGAGGGAGGAGGG | 17 | 4780 |
| BCL11A-4296 | + | AGGAGGGGCGGAUUGCA | 17 | 4781 |
| BCL11A-4297 | + | UGUUGGGCAUCGCGGCC | 17 | 4782 |
| BCL11A-4298 | - | CGGGGACGAGGAGGAAG | 17 | 4783 |
| BCL11A-4299 | + | GGAGGGGCGGAUUGCAG | 17 | 4784 |
| BCL11A-4300 | - | GGAGGAGCUGACGGAGA | 17 | 4785 |
| BCL11A-4301 | - | GGGACGAGGAGGAAGAG | 17 | 4786 |
| BCL11A-4302 | - | AGGAGGAGGAGCUGACG | 17 | 4787 |
| BCL11A-4303 | - | ACGAGGAAGAGGAAGAA | 17 | 4788 |
| BCL11A-4304 | - | AGGAAGAGGAAGAAGAG | 17 | 4789 |
| BCL11A-4305 | - | AGGAAGAGGAGGACGAC | 17 | 4790 |
| BCL11A-4306 | - | AGGAGGACGACGAGGAA | 17 | 4791 |
| BCL11A-4307 | - | GGAGGAGGAGGAGCUGA | 17 | 4792 |
| BCL11A-4308 | - | GGAAGAGGAGGACGACG | 17 | 4793 |
| BCL11A-4309 | - | GGAGGAAGAGGAGGACG | 17 | 4794 |
| BCL11A-4310 | - | GGAAGAGGAAGAAGAGG | 17 | 4795 |
| BCL11A-4311 | - | AGGAGGAGGAGGAGCUG | 17 | 4796 |
| BCL11A-4312 | - | CGAGGAAGAGGAAGAAG | 17 | 4797 |
| BCL11A-4313 | - | GGACGACGAGGAAGAGG | 17 | 4798 |
| BCL11A-4314 | - | GGAGGACGACGAGGAAG | 17 | 4799 |

TABLE 5E-continued

5th Tier

| gRNA Name | DNA Strand | Targeting Domain | Target Site Length | SEQ ID NO |
|---|---|---|---|---|
| BCL11A-4315 | - | CGACGAGGAAGAGGAAG | 17 | 4800 |
| BCL11A-4316 | - | AGAGGAGGACGACGAGG | 17 | 4801 |
| BCL11A-4317 | - | AAGAAGAGGAGGAAGAG | 17 | 4802 |
| BCL11A-4318 | - | AGGAAGAAGAGGAGGAA | 17 | 4803 |
| BCL11A-4319 | - | AGAGGAAGAAGAGGAGG | 17 | 4804 |
| BCL11A-4320 | - | AAGAGGAGGAAGAGGAG | 17 | 4805 |
| BCL11A-4321 | - | AGGAGGAAGAGGAGGAG | 17 | 4806 |
| BCL11A-4322 | - | GGAAGAAGAGGAGGAAG | 17 | 4807 |
| BCL11A-4323 | - | AGAAGAGGAGGAAGAGG | 17 | 4808 |
| BCL11A-4324 | - | AGAGGAGGAAGAGGAGG | 17 | 4809 |
| BCL11A-4325 | - | GGAGGAAGAGGAGGAGG | 17 | 4810 |

Table 6A provides exemplary targeting domains for knocking out the BCL11A gene by targeting the early coding sequence the BCL11A gene selected according to first tier parameters. The targeting domains bind within first 500 bp of coding sequence downstream of start codon, good orthogonality, start with G. It is contemplated herein that the targeting domain hybridizes to the target domain through complementary base pairing. Any of the targeting domains in the table can be used with a *N. meningitidis* Cas9 molecule that generates a double strand break (Cas9 nuclease) or a single-strand break (Cas9 nickase). In an embodiment, dual targeting is used to create two double strand breaks to remove the enhancer region in the BCL11A gene. e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *N. meningitidis* Cas9 (nickase) molecule to generate a single strand break. In an embodiment, dual targeting is used to create two nicks on opposite DNA strands by using *N. meningitidis* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 6A

1st Tier

| gRNA Name | DNA Strand | Targeting Domain | Target Site Length | SEQ ID NO |
|---|---|---|---|---|
| BCL11A-4326 | + | UUCUGCACUCAUCCCAGGCG | 20 | 4811 |
| BCL11A-4327 | - | AUCCAGGUCACGCCAGAGGA | 20 | 4812 |
| BCL11A-4328 | + | UGACCUGGAUGCCAACCUCC | 20 | 4813 |
| BCL11A-4329 | + | GGGAUUGGAUGCUUUUUUCA | 20 | 4814 |
| BCL11A-4330 | + | UGCACUCAUCCCAGGCG | 17 | 4815 |
| BCL11A-4331 | - | CAGGUCACGCCAGAGGA | 17 | 4816 |
| BCL11A-4332 | + | CCUGGAUGCCAACCUCC | 17 | 4817 |
| BCL11A-4333 | + | AUUGGAUGCUUUUUUCA | 17 | 4818 |

Table 6B provides exemplary targeting domains for knocking out the BCL11A gene by targeting the early coding sequence the BCL11A gene. The targeting domains target outside the first 500 bp of coding sequence downstream of start codon. It is contemplated herein that the targeting domain hybridizes to the target domain through complementary base pairing. Any of the targeting domains in the table can be used with a *N. meningitidis* Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *N. meningitidis* Cas9 (nickase) molecule to generate a single strand break. In an embodiment, dual targeting is used to create two nicks on opposite DNA strands by using *N. meningitidis* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 6B

| gRNA Name | DNA Strand | Targeting Domain | Target Site Length | SEQ ID NO |
|---|---|---|---|---|
| BCL11A-4334 | - | GCUAUGGAGCCUCCCGC | 17 | 4819 |
| BCL11A-4335 | + | GACUUGACCGUCAUGGG | 17 | 4820 |
| BCL11A-4336 | + | UCCGACGAGGAGGCAAA | 17 | 4821 |
| BCL11A-4337 | + | CGGGAGGCUCCAUAGCC | 17 | 4822 |

TABLE 6B-continued

| gRNA Name | DNA Strand | Targeting Domain | Target Site Length | SEQ ID NO |
|---|---|---|---|---|
| BCL11A-4338 | + | UCCGUGUUCGCUUUCUA | 17 | 4823 |
| BCL11A-4339 | - | AACACGCACAGAACACU | 17 | 4824 |
| BCL11A-4340 | - | UUCCCAGCCACCUCUCC | 17 | 4825 |
| BCL11A-4341 | + | GGCUGGGAGGGAGGAGG | 17 | 4826 |
| BCL11A-4342 | + | UCGGACUUGACCGUCAUGGG | 20 | 4827 |
| BCL11A-4343 | - | AUGGCUAUGGAGCCUCCCGC | 20 | 4828 |
| BCL11A-4344 | + | UGCUCCGACGAGGAGGCAAA | 20 | 4829 |
| BCL11A-4345 | + | UGGCGGGAGGCUCCAUAGCC | 20 | 4830 |
| BCL11A-4346 | - | UGCAACACGCACAGAACACU | 20 | 4831 |
| BCL11A-4347 | + | ACUUCCGUGUUCGCUUUCUA | 20 | 4832 |
| BCL11A-4348 | - | UCCUUCCCAGCCACCUCUCC | 20 | 4833 |
| BCL11A-4349 | + | GGGGGCUGGGAGGGAGGAGG | 20 | 4834 | paired any gRNA comprising a plus strand targeting domain provided that the two gRNAs are oriented on the DNA such that PAMs face outward and the distance between the 5' ends of the gRNAs is 0-50 bp. Exemplary gRNA pairs are: BCL11A-5210 and BCL11A-5204, BCL11A-5211 and BCL11A-5204, BCL11A-5172 and BCL11A-5176, BCL11A-5172 and BCL11A-5186, BCL11A-5179 and BCL11A-5176, or BCL11A-5179 and BCL11A-5186.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene. For example, gRNA pairs that target upstream (i.e., 5') of the enhancer region in the BCL11A gene (e.g., BCL11A-5210 and BCL11A-5204, or BCL11A-5211 and BCL11A-5204) can be paired with gRNA pairs that target downstream (i.e., 3') of the enhancer region in the BCL11A gene (e.g., BCL11A-5172 and BCL11A-5176, BCL11A-5172 and BCL11A-5186, BCL11A-5179 and BCL11A-5176, or BCL11A-5179 and BCL11A-5186).

TABLE 7A

1st Tier

| gRNA Name | DNA Strand | Targeting Domain | Target Site Length | 5' or 3' of repeats | SEQ ID NO |
|---|---|---|---|---|---|
| BCL11A-5172 | + | GAAAAUACUUACUGUACUGC | 20 | 3' | 4835 |
| BCL11A-5173 | - | GAAAGCAGUGUAAGGCU | 17 | 5' | 4836 |
| BCL11A-5174 | - | GGCUGUUUUGGAAUGUAGAG | 20 | 5' | 4837 |
| BCL11A-5175 | + | GUGCUACUUAUACAAUUCAC | 20 | 3' | 4838 |

Table 7A provides exemplary targeting domains for removing (e.g., deleting) the enhancer region in the BCL11A gene selected according to first tier parameters. The targeting domains bind within a region 5' (51.5 to 51.7 kb downstream of transcription start site, TSS) or 3' (65.1 to 65.3 kb downstream of TSS) of enhancer, good orthogonality, starts with G. It is contemplated herein that the targeting domain hybridizes to the target domain through complementary base pairing. Any of the targeting domains in the table can be used with a *S. pyogenes* Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *S. pyogenes* Cas9 (nickase) molecule to generate a single strand break. In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be Table 7B provides exemplary targeting domains for removing (e.g., deleting) the enhancer region in the BCL11A gene selected according to second tier parameters. The targeting domains bind within a region 5' (51.5 to 51.7 kb downstream of transcription start site, TSS) or 3' (65.1 to 65.3 kb downstream of TSS) of enhancer, good orthogonality, and do not start with G. It is contemplated herein that the targeting domain hybridizes to the target domain through complementary base pairing. Any of the targeting domains in the table can be used with a *S. pyogenes* Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *S. pyogenes* Cas9 (nickase) molecule to generate a single strand break. In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. The table provides exemplary targeting domains for removing (e.g., deleting) the enhancer region in the BCL11A gene selected according to first tier parameters. The targeting domains bind within a region 5'

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 7B

2nd Tier

| gRNA Name | DNA Strand | Targeting Domain | Target Site Length | 5' or 3' of repeats | SEQ ID NO |
|---|---|---|---|---|---|
| BCL11A-5176 | − | AAACUAUUUACAGCCAUAAC | 20 | 3' | 4839 |
| BCL11A-5177 | + | AAAUACUUACUGUACUGCAG | 20 | 3' | 4840 |
| BCL11A-5178 | − | AACUAUUUACAGCCAUAACA | 20 | 3' | 4841 |
| BCL11A-5179 | + | AAUACUUACUGUACUGC | 17 | 3' | 4842 |
| BCL11A-5180 | + | ACAACUUGUGUUGCACU | 17 | 5' | 4843 |
| BCL11A-5181 | + | AUACUUACUGUACUGCA | 17 | 3' | 4844 |
| BCL11A-5182 | + | AUUCACUGGAAACCCUGUUA | 20 | 3' | 4845 |
| BCL11A-5183 | + | AUUUAAGACGGGAAAAC | 17 | 5' | 4846 |
| BCL11A-5184 | + | CACUGGAAACCCUGUUA | 17 | 3' | 4847 |
| BCL11A-5185 | + | CUACUUAUACAAUUCAC | 17 | 3' | 4848 |
| BCL11A-5186 | − | CUAUUUACAGCCAUAAC | 17 | 3' | 4849 |
| BCL11A-5187 | − | UAAGAAAGCAGUGUAAGGCU | 20 | 5' | 4850 |
| BCL11A-5188 | + | UACACAACUUGUGUUGCACU | 20 | 5' | 4851 |
| BCL11A-5189 | + | UACUGUACUGCAGGGGAAUU | 20 | 3' | 4852 |
| BCL11A-5190 | + | UACUUACUGUACUGCAG | 17 | 3' | 4853 |
| BCL11A-5191 | + | UGUACUGCAGGGGAAUU | 17 | 3' | 4854 |

(51.5 to 51.7 kb downstream of transcription start site, TSS) or 3' (65.1 to 65.3 kb downstream of TSS) of enhancer, good orthogonality, starts with G. It is contemplated herein that the targeting domain hybridizes to the target domain through complementary base pairing. Any of the targeting domains in the table can be used with a S. pyogenes Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a S. pyogenes Cas9 (nickase) molecule to generate a single strand break. In an embodiment, dual targeting is used to create two nicks on opposite DNA strands by using S. pyogenes Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

Table 7C provides exemplary targeting domains for removing (e.g., deleting) the enhancer region in the BCL11A gene selected according to third tier parameters. The targeting domains bind within a region 5' (51.5 to 51.7 kb downstream of transcription start site, TSS) or 3' (65.1 to 65.3 kb downstream of TSS) of enhancer and start with G. It is contemplated herein that the targeting domain hybridizes to the target domain through complementary base pairing. Any of the targeting domains in the table can be used with a S. pyogenes Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a S. pyogenes Cas9 (nickase) molecule to generate a single strand break. In an embodiment, dual targeting is used to create two nicks on opposite DNA strands by using S. pyogenes Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. The table provides exemplary targeting domains for removing (e.g., deleting) the enhancer region in the BCL11A gene selected according to first tier parameters. The targeting domains bind within a region 5' (51.5 to 51.7 kb downstream of transcription start site, TSS) or 3' (65.1 to 65.3 kb downstream of TSS) of enhancer, good orthogonality, starts with G. It is contemplated herein that the targeting domain hybridizes to the target domain through complementary base pairing. Any of the targeting domains in the table can be used with a *S. pyogenes* Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *S. pyogenes* Cas9 (nickase) molecule to generate a single strand break. In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *S. pyogenes* Cas9 (nickase) molecule to generate a single strand break. In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. The table provides exemplary targeting domains for removing (e.g., deleting) the enhancer region in the BCL11A gene selected according to first tier parameters. The targeting domains bind within a region 5' (51.5 to 51.7 kb downstream of transcription start site, TSS) or 3' (65.1 to 65.3 kb downstream of TSS) of enhancer, good orthogonality, starts with G. It is contemplated herein that the targeting domain hybridizes to the target domain through complementary base pairing. Any of the targeting domains in the table can be used with a *S. pyogenes* Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *S. pyogenes* Cas9 (nickase) molecule to generate a single strand break. In an embodiment, dual targeting is used to create two nicks on opposite DNA strands by using *S. pyogenes* Cas9 nickases with two targeting domains that are

TABLE 7C

3rd Tier

| gRNA Name | DNA Strand | Targeting Domain | Target Site Length | 5' or 3' repeats | of SEQ ID NO |
|---|---|---|---|---|---|
| BCL11A-5192 | – | GAAUGUAGAGAGGCAGA | 17 | 5' | 4855 |
| BCL11A-5193 | – | GGAAUGUAGAGAGGCAG | 17 | 5' | 4856 |
| BCL11A-5194 | – | GUAAGUAUUUUCUUUCAUUG | 20 | 3' | 4857 |
| BCL11A-5195 | – | GUAAUUAAGAAAGCAGUGUA | 20 | 5' | 4858 |
| BCL11A-5196 | – | GUAUUUUCUUUCAUUGG | 17 | 3' | 4859 |

Table 7D provides exemplary targeting domains for removing (e.g., deleting) the enhancer region in the BCL11A gene selected according to forth tier parameters. The targeting domains bind within a region 5' (51.5 to 51.7 kb downstream of transcription start site, TSS) or 3' (65.1 to 65.3 kb downstream of TSS) of enhancer and do not start with G. It is contemplated herein that the targeting domain hybridizes to the target domain through complementary base pairing. Any of the targeting domains in the table can be used with a *S. pyogenes* Cas9 molecule that generates a double strand break (Cas9 nuclease) or a single-strand break (Cas9 nickase). In an embodiment, dual targeting is used to create two double strand breaks to remove the enhancer complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 7D

4th Tier

| gRNA Name | DNA Strand | Targeting Domain | Target Site Length | 5' or 3' of repeats | SEQ ID NO |
|---|---|---|---|---|---|
| BCL11A-5197 | − | AAAAUAAUUAGAAUAAA | 17 | 5' | 4860 |
| BCL11A-5198 | + | AAAAUACUUACUGUACUGCA | 20 | 3' | 4861 |
| BCL11A-5199 | + | AAAAUUUAAGACGGGAAAAC | 20 | 5' | 4862 |
| BCL11A-5200 | − | AAGUAUUUCUUUCAUU | 17 | 3' | 4863 |
| BCL11A-5201 | − | AAUGUAGAGAGGCAGAG | 17 | 5' | 4864 |
| BCL11A-5202 | + | ACAUAAAAAUUUAAGAC | 17 | 5' | 4865 |
| BCL11A-5203 | − | AGAAAGCAGUGUAAGGC | 17 | 5' | 4866 |
| BCL11A-5204 | − | AGAAUAAAAGGCUGUUU | 17 | 5' | 4867 |
| BCL11A-5205 | − | AGUAAAAUAAUUAGAAUAAA | 20 | 5' | 4868 |
| BCL11A-5206 | − | AGUAAGUAUUUCUUUCAUU | 20 | 3' | 4869 |
| BCL11A-5207 | − | AGUAUUUCUUUCAUUG | 17 | 3' | 4870 |
| BCL11A-5208 | − | AUUAAGAAAGCAGUGUA | 17 | 5' | 4871 |
| BCL11A-5209 | − | AUUAGAAUAAAAGGCUGUUU | 20 | 5' | 4872 |
| BCL11A-5210 | + | AUUAUUUUACUAGUGAAUUA | 20 | 5' | 4873 |
| BCL11A-5211 | + | AUUUUACUAGUGAAUUA | 17 | 5' | 4874 |
| BCL11A-5212 | + | CACAUAAAAAUUUAAGA | 17 | 5' | 4875 |
| BCL11A-5213 | − | CAGUAAGUAUUUCUUUCAU | 20 | 3' | 4876 |
| BCL11A-5214 | + | CUCACAUAAAAAUUUAAGAC | 20 | 5' | 4877 |
| BCL11A-5215 | − | UAAGUAUUUCUUUCAU | 17 | 3' | 4878 |
| BCL11A-5216 | − | UAAGUAUUUCUUUCAUUGG | 20 | 3' | 4879 |
| BCL11A-5217 | − | UAUUUACAGCCAUAACA | 17 | 3' | 4880 |
| BCL11A-5218 | + | UCUCACAUAAAAAUUUAAGA | 20 | 5' | 4881 |
| BCL11A-5219 | − | UGGAAUGUAGAGAGGCAGAG | 20 | 5' | 4882 |
| BCL11A-5220 | − | UGUUUUGGAAUGUAGAG | 17 | 5' | 4883 |
| BCL11A-5221 | − | UUAAGAAAGCAGUGUAAGGC | 20 | 5' | 4884 |
| BCL11A-5222 | − | UUGGAAUGUAGAGAGGCAGA | 20 | 5' | 4885 |
| BCL11A-5223 | − | UUUGGAAUGUAGAGAGGCAG | 20 | 5' | 4886 |

Table 8A provides exemplary targeting domains for removing (e.g., deleting) the enhancer region in the BCL11A gene selected according to first tier parameters. The targeting domains bind within a region 5' (51.5 to 51.7 kb downstream of transcription start site, TSS) or 3' (65.1 to 65.3 kb downstream of TSS) of enhancer, good orthogonality, starts with G. It is contemplated herein that the targeting domain hybridizes to the target domain through complementary base pairing. Any of the targeting domains in the table can be used with a S. aureus Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a S. aureus Cas9 (nickase) molecule to generate a single strand break. In an embodiment, dual targeting is used to create two nicks on opposite DNA strands by using S. aureus Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 8A

1st Tier

| gRNA Name | DNA Strand | Targeting Domain | Target Site Length | 5' or 3' of repeats | SEQ ID NO |
|---|---|---|---|---|---|
| BCL11A-5224 | − | GAGGGGCUGAUAUAACUUCU | 20 | 5' | 4887 |
| BCL11A-5225 | + | GCUACUUAUACAAUUCA | 17 | 3' | 4888 |
| BCL11A-5226 | − | GGGCUGAUAUAACUUCU | 17 | 5' | 4889 |
| BCL11A-5227 | − | GUCUUAAAUUUUUAUGUGAG | 20 | 5' | 4890 |
| BCL11A-5228 | + | GUGCUACUUAUACAAUUCAC | 20 | 3' | 4891 |

Table 8B provides exemplary targeting domains for removing (e.g., deleting) the enhancer region in the BCL11A gene selected according to second tier parameters. The targeting domains bind within a region 5' (51.5 to 51.7 kb downstream of transcription start site, TSS) or 3' (65.1 to 65.3 kb downstream of TSS) of enhancer, good orthogonality, and do not start with G. It is contemplated herein that the targeting domain hybridizes to the target domain through complementary base pairing. Any of the targeting domains in the table can be used with a *S. aureus* Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *S. aureus* Cas9 (nickase) molecule to generate a single strand break. In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. The table provides exemplary targeting domains for removing (e.g., deleting) the enhancer region in the BCL11A gene selected according to first tier parameters. The targeting domains bind within a region 5' (51.5 to 51.7 kb downstream of transcription start site, TSS) or 3' (65.1 to 65.3 kb downstream of TSS) of enhancer, good orthogonality, starts with G. It is contemplated herein that the targeting domain hybridizes to the target domain through complementary base pairing. Any of the targeting domains in the table can be used with a *S. aureus* Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a *S. aureus* Cas9 (nickase) molecule to generate a single strand break. In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 8B

2nd Tier

| gRNA Name | DNA Strand | Targeting Domain | Target Site Length | 5' or 3' of repeats | SEQ ID NO |
|---|---|---|---|---|---|
| BCL11A-5229 | − | AACACAAGUUGUGUAGA | 17 | 5' | 4892 |
| BCL11A-5230 | − | ACUAUUUACAGCCAUAA | 17 | 3' | 4893 |
| BCL11A-5231 | − | AGCACACUGCUGUAAUU | 17 | 5' | 4894 |
| BCL11A-5232 | + | AGUGCUACUUAUACAAUUCA | 20 | 3' | 4895 |
| BCL11A-5233 | + | AUAGUUUGCUUCCCCCA | 17 | 3' | 4896 |

TABLE 8B-continued

2nd Tier

| gRNA Name | DNA Strand | Targeting Domain | Target Site Length | 5' or 3' of repeats | SEQ ID NO |
|---|---|---|---|---|---|
| BCL11A-5234 | − | AUGAGCACACUGCUGUAAUU | 20 | 5' | 4897 |
| BCL11A-5235 | − | CAAACUAUUUACAGCCAUAA | 20 | 3' | 4898 |
| BCL11A-5236 | − | CAGCCAUAACAGGGUUUCCA | 20 | 3' | 4899 |
| BCL11A-5237 | − | CCAUAACAGGGUUUCCA | 17 | 3' | 4900 |
| BCL11A-5238 | + | CUACUUAUACAAUUCAC | 17 | 3' | 4901 |
| BCL11A-5239 | − | CUUUGGCUAUUGAUACUGAU | 20 | 3' | 4902 |
| BCL11A-5240 | + | UAAAUAGUUUGCUUCCCCCA | 20 | 3' | 4903 |
| BCL11A-5241 | + | UAGUUUGCUUCCCCCAAUGA | 20 | 3' | 4904 |
| BCL11A-5242 | − | UGCAACACAAGUUGUGUAGA | 20 | 5' | 4905 |
| BCL11A-5243 | − | UGGAAUGUAGAGAGGCA | 17 | 5' | 4906 |
| BCL11A-5244 | − | UGGCUAUUGAUACUGAU | 17 | 3' | 4907 |
| BCL11A-5245 | + | UUUGCUUCCCCCAAUGA | 17 | 3' | 4908 |
| BCL11A-5246 | − | UUUUGGAAUGUAGAGAGGCA | 20 | 5' | 4909 |

Table 8C provides exemplary targeting domains for removing (e.g., deleting) the enhancer region in the BCL11A gene selected according to third tier parameters. The targeting domains bind within a region 5' (51.5 to 51.7 kb downstream of transcription start site, TSS) or 3' (65.1 to 65.3 kb downstream of TSS) of enhancer and start with G. It is contemplated herein that the targeting domain hybridizes to the target domain through complementary base pairing. Any of the targeting domains in the table can be used with a S. aureus Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a S. aureus Cas9 (nickase) molecule to generate a single strand break. In an embodiment, dual targeting is used to create two nicks on opposite DNA strands by using S. aureus Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. The table provides exemplary targeting domains for removing (e.g., deleting) the enhancer region in the BCL11A gene selected according to first tier parameters. The targeting domains bind within a region 5' (51.5 to 51.7 kb downstream of transcription start site, TSS) or 3' (65.1 to 65.3 kb downstream of TSS) of enhancer, good orthogonality, starts with G. It is contemplated herein that the targeting domain hybridizes to the target domain through complementary base pairing. Any of the targeting domains in the table can be used with a S. aureus Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a S. aureus Cas9 (nickase) molecule to generate a single strand break. In an embodiment, dual targeting is used to create two nicks on opposite DNA strands by using S. aureus Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 8C

3rd Tier

| gRNA Name | DNA Strand | Targeting Domain | Target Site Length | 5' or 3' of repeats | SEQ ID NO |
|---|---|---|---|---|---|
| BCL11A-5247 | + | GAAAAUACUUACUGUACUGC | 20 | 3' | 4910 |
| BCL11A-5248 | − | GAAUUGUAUAAGUAGCA | 17 | 3' | 4911 |
| BCL11A-5249 | − | GAGUUCUGUGUCAGCAAAAA | 20 | 3' | 4912 |
| BCL11A-5250 | + | GGAAAACAGGAAGAUGCAUU | 20 | 5' | 4913 |
| BCL11A-5251 | − | GGAAUGUAGAGAGGCAG | 17 | 5' | 4914 |
| BCL11A-5252 | − | GGCUGUUUUGGAAUGUA | 17 | 5' | 4915 |
| BCL11A-5253 | − | GUAAGUAUUUUCUUUCA | 17 | 3' | 4916 |
| BCL11A-5254 | − | GUAAGUAUUUUCUUUCAUUG | 20 | 3' | 4917 |
| BCL11A-5255 | − | GUAUUUUCUUUCAUUGG | 17 | 3' | 4918 |

Table 8D provides exemplary targeting domains for removing (e.g., deleting) the enhancer region in the BCL11A gene selected according to forth tier parameters. The targeting domains bind within a region 5' (51.5 to 51.7 kb downstream of transcription start site, TSS) or 3' (65.1 to 65.3 kb downstream of TSS) of enhancer and do not start with G. It is contemplated herein that the targeting domain hybridizes to the target domain through complementary base pairing. Any of the targeting domains in the table can be used with a S. aureus Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a S. aureus Cas9 (nickase) molecule to generate a single strand break. In an embodiment, dual targeting is used to create two nicks on opposite DNA strands by using S. aureus Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. The table provides exemplary targeting domains for removing (e.g., deleting) the enhancer region in the BCL11A gene selected according to first tier parameters. The targeting domains bind within a region 5' (51.5 to 51.7 kb downstream of transcription start site, TSS) or 3' (65.1 to 65.3 kb downstream of TSS) of enhancer, good orthogonality, starts with G. It is contemplated herein that the targeting domain hybridizes to the target domain through complementary base pairing. Any of the targeting domains in the table can be used with a S. aureus Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a S. aureus Cas9 (nickase) molecule to generate a single strand break. In an embodiment, dual targeting is used to create two nicks on opposite DNA strands by using S. aureus Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 8D

4th Tier

| gRNA Name | DNA Strand | Targeting Domain | Target Site Length | 5' or 3' of repeats | SEQ ID NO |
|---|---|---|---|---|---|
| BCL11A-5256 | + | AAAAAUUUAAGACGGGAAAA | 20 | 5' | 4919 |
| BCL11A-5257 | + | AAAACAGGAAGAUGCAUUCU | 20 | 5' | 4920 |
| BCL11A-5258 | − | AAAACUAGAAAGUUUUA | 17 | 3' | 4921 |

TABLE 8D-continued

4th Tier

| gRNA Name | DNA Strand | Targeting Domain | Target Site Length | 5' or 3' of repeats | SEQ ID NO |
|---|---|---|---|---|---|
| BCL11A-5259 | + | AAAAUACUUACUGUACUGCA | 20 | 3' | 4922 |
| BCL11A-5260 | + | AAAAUUUAAGACGGGAAAAC | 20 | 5' | 4923 |
| BCL11A-5261 | + | AAACAGGAAGAUGCAUU | 17 | 5' | 4924 |
| BCL11A-5262 | − | AAAGGCUGUUUUGGAAUGUA | 20 | 5' | 4925 |
| BCL11A-5263 | + | AAAUACUUACUGUACUG | 17 | 3' | 4926 |
| BCL11A-5264 | + | AAAUACUUACUGUACUGCAG | 20 | 3' | 4927 |
| BCL11A-5265 | − | AAGAAAGCAGUGUAAGG | 17 | 5' | 4928 |
| BCL11A-5266 | − | AAGGCUGUUUUGGAAUG | 17 | 5' | 4929 |
| BCL11A-5267 | − | AAGUAUUUUCUUUCAUU | 17 | 3' | 4930 |
| BCL11A-5268 | + | AAUACUUACUGUACUGC | 17 | 3' | 4931 |
| BCL11A-5269 | − | AAUUAGAAUAAAAGGCUGUU | 20 | 5' | 4932 |
| BCL11A-5270 | + | AAUUAUUUUACUAGUGAAUU | 20 | 5' | 4933 |
| BCL11A-5271 | + | AAUUUAAGACGGGAAAA | 17 | 5' | 4934 |
| BCL11A-5272 | + | ACAGGAAGAUGCAUUCU | 17 | 5' | 4935 |
| BCL11A-5273 | − | ACAGUAAGUAUUUUCUUUCA | 20 | 3' | 4936 |
| BCL11A-5274 | + | ACAUAAAAAUUUAAGAC | 17 | 5' | 4937 |
| BCL11A-5275 | + | ACUUUCUAGUUUUGCUUAAC | 20 | 3' | 4938 |
| BCL11A-5276 | + | AGAAAAUACUUACUGUACUG | 20 | 3' | 4939 |
| BCL11A-5277 | − | AGAAUAAAAGGCUGUUU | 17 | 5' | 4940 |
| BCL11A-5278 | − | AGCAAAACUAGAAAGUUUUA | 20 | 3' | 4941 |
| BCL11A-5279 | − | AGUAAGUAUUUUCUUUCAUU | 20 | 3' | 4942 |
| BCL11A-5280 | − | AGUAUUUUCUUUCAUUG | 17 | 3' | 4943 |
| BCL11A-5281 | − | AGUGAAUUGUAUAAGUAGCA | 20 | 3' | 4944 |
| BCL11A-5282 | + | AUACUUACUGUACUGCA | 17 | 3' | 4945 |
| BCL11A-5283 | + | AUCUCACAUAAAAAUUUAAG | 20 | 5' | 4946 |
| BCL11A-5284 | − | AUUAAGAAAGCAGUGUAAGG | 20 | 5' | 4947 |
| BCL11A-5285 | − | AUUAGAAUAAAAGGCUGUUU | 20 | 5' | 4948 |
| BCL11A-5286 | + | AUUAUUUUACUAGUGAAUUA | 20 | 5' | 4949 |
| BCL11A-5287 | + | AUUUAAGACGGGAAAAC | 17 | 5' | 4950 |
| BCL11A-5288 | + | AUUUUACUAGUGAAUUA | 17 | 5' | 4951 |
| BCL11A-5289 | − | AUUUUCAUGUUAAGCAAAAC | 20 | 3' | 4952 |
| BCL11A-5290 | + | CACAUAAAAAUUUAAGA | 17 | 5' | 4953 |
| BCL11A-5291 | − | CAGUAAGUAUUUUCUUUCAU | 20 | 3' | 4954 |
| BCL11A-5292 | − | CCGUCUUAAAUUUUUAU | 17 | 5' | 4955 |
| BCL11A-5293 | + | CUCACAUAAAAAUUUAAGAC | 20 | 5' | 4956 |
| BCL11A-5294 | − | UAAAAGGCUGUUUUGGAAUG | 20 | 5' | 4957 |
| BCL11A-5295 | − | UAAGUAUUUUCUUUCAU | 17 | 3' | 4958 |

TABLE 8D-continued

4th Tier

| gRNA Name | DNA Strand | Targeting Domain | Target Site Length | 5' or 3' of repeats | SEQ ID NO |
|---|---|---|---|---|---|
| BCL11A-5296 | − | UAAGUAUUUCUUUCAUUGG | 20 | 3' | 4959 |
| BCL11A-5297 | − | UAAUUCACUAGUAAAAUAAU | 20 | 5' | 4960 |
| BCL11A-5298 | + | UACUUACUGUACUGCAG | 17 | 3' | 4961 |
| BCL11A-5299 | − | UAGAAUAAAAGGCUGUU | 17 | 5' | 4962 |
| BCL11A-5300 | + | UAUUUUACUAGUGAAUU | 17 | 5' | 4963 |
| BCL11A-5301 | + | UCACAUAAAAAUUUAAG | 17 | 5' | 4964 |
| BCL11A-5302 | + | UCUCACAUAAAAAUUUAAGA | 20 | 5' | 4965 |
| BCL11A-5303 | + | UGUUUCAUUUUUUGCUGACA | 20 | 3' | 4966 |
| BCL11A-5304 | − | UGUUUUGGAAUGUAGAGAGG | 20 | 5' | 4967 |
| BCL11A-5305 | − | UUAAAUUUUUAUGUGAG | 17 | 5' | 4968 |
| BCL11A-5306 | + | UUAUUCUAAUUAUUUUACUA | 20 | 5' | 4969 |
| BCL11A-5307 | − | UUCACUAGUAAAAUAAU | 17 | 5' | 4970 |
| BCL11A-5308 | − | UUCAUGUUAAGCAAAAC | 17 | 3' | 4971 |
| BCL11A-5309 | + | UUCAUUUUUUGCUGACA | 17 | 3' | 4972 |
| BCL11A-5310 | − | UUCCCGUCUUAAAUUUUUAU | 20 | 5' | 4973 |
| BCL11A-5311 | + | UUCUAAUUAUUUUACUA | 17 | 5' | 4974 |
| BCL11A-5312 | + | UUCUAGUUUUGCUUAAC | 17 | 3' | 4975 |
| BCL11A-5313 | − | UUCUGUGUCAGCAAAAA | 17 | 3' | 4976 |
| BCL11A-5314 | − | UUUGGAAUGUAGAGAGG | 17 | 5' | 4977 |
| BCL11A-5315 | − | UUUGGAAUGUAGAGAGGCAG | 20 | 5' | 4978 |

Table 9 provides exemplary targeting domains for removing (e.g., deleting) the enhancer region in the BCL11A gene selected according to first tier parameters. The targeting domains bind within a region 5' (51.5 to 51.7 kb downstream of transcription start site, TSS) or 3' (65.1 to 65.3 kb downstream of TSS) of enhancer, good orthogonality, starts with G. It is contemplated herein that the targeting domain hybridizes to the target domain through complementary base pairing. Any of the targeting domains in the table can be used with a N. meningitidis Cas9 molecule that generates a double strand break (Cas9 nuclease) or a single-strand break (Cas9 nickase). In an embodiment, dual targeting is used to create two double strand breaks to remove the enhancer region in the BCL11A gene, e.g., the first gRNA is used to target upstream (i.e., 5') of the enhancer region in the BCL11A gene and the second gRNA is used to target downstream (i.e., 3') of the enhancer region in the BCL11A gene.

Any of the targeting domains in the table can be used with a N. meningitidis Cas9 (nickase) molecule to generate a single strand break. In an embodiment, dual targeting is used to create two nicks on opposite DNA strands by using N. meningitidis Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, four gRNAs (e.g., two pairs) are used to target four Cas9 nickases to create four nicks to remove the enhancer region in the BCL11A gene, e.g., the first pair of gRNAs are used to target upstream (i.e., 5') of the enhancer region in the BCL11A gene and the second pair of gRNAs are used to target downstream (i.e., 3') of the enhancer region in the BCL11A gene.

TABLE 9

1st Tier

| gRNA Name | DNA Strand | Targeting Domain | Target Site Length | 5' or 3' of repeats | SEQ ID NO |
|---|---|---|---|---|---|
| BCL11A-5316 | − | UUUGGAUCUUUGGCUAUUGA | 20 | 3' | 4979 |
| BCL11A-5317 | − | GGAUCUUUGGCUAUUGA | 17 | 3' | 4980 |

Table 10A provides exemplary targeting domains for knocking down expression of the BCL11A gene according to first tier parameters. The targeting domains bind between 500 bp upstream and 500 bp downstream of transcription start site, good orthogonality, starts with G. It is contemplated herein that the targeting domain hybridizes to the target domain through complementary base pairing. Any of the targeting domains in the table can be used with a S. pyogenes eiCas9 molecule to cause a steric block at the target region, e.g., between 500 bp upstream and 500 bp downstream of transcription start site to block transcription resulting in the repression of the BCL11A gene. Alternatively, any of the targeting domains in the table can be used with a S. pyogenes eiCas9 fused to a transcriptional repressor to decrease transcription and therefore downregulate gene expression.

TABLE 10A

1st Tier

| gRNA Name | DNA Strand | Targeting Domain | Target Site Length | SEQ ID NO |
|---|---|---|---|---|
| BCL11A-4350 | + | GACGACGGCUCGGUUCACAU | 20 | 4981 |
| BCL11A-4351 | + | GACGCCAGACGCGGCCCCG | 20 | 4982 |
| BCL11A-4352 | + | GCCUUGCUUGCGGCGAGACA | 20 | 4983 |
| BCL11A-4353 | + | GGCUCCGCGGACGCCAGACG | 20 | 4984 |
| BCL11A-4354 | + | GACGGCUCGGUUCACAU | 17 | 4985 |
| BCL11A-4355 | − | GCCGCGUCUGGCGUCCG | 17 | 4986 |
| BCL11A-4356 | + | GCGGGCGGACGACGGCU | 17 | 4987 |

Table 10B provides exemplary targeting domains for knocking down expression of the BCL11A gene according to second tier parameters. The targeting domains bind between 500 bp upstream and 500 bp downstream of transcription start site, good orthogonality and do not start with G. It is contemplated herein that the targeting domain hybridizes to the target domain through complementary base pairing. Any of the targeting domains in the table can be used with a S. pyogenes eiCas9 molecule to cause a steric block at the target region, e.g., between 500 bp upstream and 500 bp downstream of transcription start site to block transcription resulting in the repression of the BCL11A gene. Alternatively, any of the targeting domains in the table can be used with a S. pyogenes eiCas9 fused to a transcriptional repressor to decrease transcription and therefore downregulate gene expression.

TABLE 10B

2nd Tier

| gRNA Name | DNA Strand | Targeting Domain | Target Site Length | SEQ ID NO |
|---|---|---|---|---|
| BCL11A-4357 | + | ACACGGCAAUGGUUCCAGAU | 20 | 4988 |
| BCL11A-4358 | − | ACCAUGUCUCGCCGCAAGCA | 20 | 4989 |
| BCL11A-4359 | + | ACGACGGCUCGGUUCACAUC | 20 | 4990 |
| BCL11A-4360 | + | AUUCCCGUUUGCUUAAGUGC | 20 | 4991 |
| BCL11A-4361 | − | CAUUUUAGAGUCCGCGUGUG | 20 | 4992 |
| BCL11A-4362 | + | CGGACGCCAGACGCGGCCCC | 20 | 4993 |
| BCL11A-4363 | + | CGGUUCACAUCGGGAGAGCC | 20 | 4994 |
| BCL11A-4364 | − | CUCCUGACGUUCAAGUUCGC | 20 | 4995 |
| BCL11A-4365 | − | UAAUAAUCACGAGAGCGCGC | 20 | 4996 |
| BCL11A-4366 | − | UCCUGACGUUCAAGUUCGCA | 20 | 4997 |
| BCL11A-4367 | + | UCGGUUCACAUCGGGAGAGC | 20 | 4998 |
| BCL11A-4368 | + | UCUUUUACCUCGACUCUCGG | 20 | 4999 |
| BCL11A-4369 | + | UGCUUGCGGCGAGACAUGGU | 20 | 5000 |
| BCL11A-4370 | − | UUUAGAGUCCGCGUGUGUGG | 20 | 5001 |
| BCL11A-4371 | + | ACGGCUCGGUUCACAUC | 17 | 5002 |
| BCL11A-4372 | − | AUGUCUCGCCGCAAGCA | 17 | 5003 |
| BCL11A-4373 | − | CUGACGUUCAAGUUCGC | 17 | 5004 |
| BCL11A-4374 | − | UAAUCACGAGAGCGCGC | 17 | 5005 |
| BCL11A-4375 | + | UCCGCGGACGCCAGACG | 17 | 5006 |
| BCL11A-4376 | − | UGACGUUCAAGUUCGCA | 17 | 5007 |
| BCL11A-4377 | − | UUAGAGUCCGCGUGUGU | 17 | 5008 |
| BCL11A-4378 | + | UUGCGGCGAGACAUGGU | 17 | 5009 |
| BCL11A-4379 | + | UUGCUUGCGGCGAGACA | 17 | 5010 |
| BCL11A-4380 | + | UUUACCUCGACUCUCGG | 17 | 5011 |
| BCL11A-4381 | − | UUUAGAGUCCGCGUGUG | 17 | 5012 |

Table 10C provides exemplary targeting domains for knocking down expression of the BCL11A gene according to third tier parameters. The targeting domains bind between 500 bp upstream and 500 bp downstream of transcription start site and start with G. It is contemplated herein that the targeting domain hybridizes to the target domain through complementary base pairing. Any of the targeting domains in the table can be used with a S. pyogenes eiCas9 molecule to cause a steric block at the target region, e.g., between 500 bp upstream and 500 bp downstream of transcription start site to block transcription resulting in the repression of the BCL11A gene. Alternatively, any of the targeting domains in the table can be used with a *S. pyogenes* eiCas9 fused to a transcriptional repressor to decrease transcription and therefore downregulate gene expression.

TABLE 10C

3rd Tier

| gRNA Name | DNA Strand | Targeting Domain | Target Site Length | SEQ ID NO |
|---|---|---|---|---|
| BCL11A-4382 | − | GAAAAAACCCUCAUCCCAUC | 20 | 5013 |
| BCL11A-4383 | + | GAAAGGGGUGGCAGGGG | 17 | 5014 |
| BCL11A-4384 | + | GAACUUGAACGUCAGGAGUC | 20 | 5015 |
| BCL11A-4385 | − | GAACUUGCAGCUCAGGG | 17 | 5016 |
| BCL11A-4386 | + | GAAGAAAGGGGUGGCAG | 17 | 5017 |
| BCL11A-4387 | + | GAAGAAAGGGGUGGCAGGGG | 20 | 5018 |
| BCL11A-4388 | + | GAAGGGGAAGCUCACACCAA | 20 | 5019 |
| BCL11A-4389 | + | GAAGGGGAGGAGGGAAG | 17 | 5020 |
| BCL11A-4390 | + | GAAUUGUGGGAGAGCCGUCA | 20 | 5021 |
| BCL11A-4391 | + | GACAAGCCAAUGGCCAGUGC | 20 | 5022 |
| BCL11A-4392 | + | GACAGAGACACACAAAACAU | 20 | 5023 |
| BCL11A-4393 | + | GACAUGAAAAAGAGACC | 17 | 5024 |
| BCL11A-4394 | + | GACAUGGUGGGCUGCGGGGC | 20 | 5025 |
| BCL11A-4395 | + | GACGCGGCCCCCGGGGG | 17 | 5026 |
| BCL11A-4396 | − | GACUAGAAGCAAAAGCG | 17 | 5027 |
| BCL11A-4397 | − | GACUAGAAGCAAAAGCGAGG | 20 | 5028 |
| BCL11A-4398 | + | GAGAAGAAAGGGGUGGC | 17 | 5029 |
| BCL11A-4399 | + | GAGAAGGGGAGGAGGGA | 17 | 5030 |
| BCL11A-4400 | + | GAGACACACAAAACAUGGGC | 20 | 5031 |
| BCL11A-4401 | + | GAGACAUGGUGGGCUGC | 17 | 5032 |
| BCL11A-4402 | + | GAGAGAAGAAAGGGGUGGCA | 20 | 5033 |
| BCL11A-4403 | + | GAGAGAAGAGAGAUAGA | 17 | 5034 |
| BCL11A-4404 | + | GAGAGAAGGGGAGGAGGGAA | 20 | 5035 |
| BCL11A-4405 | + | GAGAGAGAGAAGAGAGAUAG | 20 | 5036 |
| BCL11A-4406 | + | GAGAGAGAUGAAAAAAA | 17 | 5037 |
| BCL11A-4407 | + | GAGCAGGAGAGAAGGGG | 17 | 5038 |
| BCL11A-4408 | + | GAGCAGGAGAGAAGGGGAGG | 20 | 5039 |
| BCL11A-4409 | + | GAGCCGGGUUAGAAAGA | 17 | 5040 |
| BCL11A-4410 | + | GAGGGGAGGGGCGCUG | 17 | 5041 |
| BCL11A-4411 | + | GAGGGGCGGGCCGAGGGGAG | 20 | 5042 |
| BCL11A-4412 | + | GAGGGGAGGUGCGGGG | 17 | 5043 |
| BCL11A-4413 | + | GAGGGGAGGUGCGGGCGG | 20 | 5044 |

TABLE 10C-continued

3rd Tier

| gRNA Name | DNA Strand | Targeting Domain | Target Site Length | SEQ ID NO |
|---|---|---|---|---|
| BCL11A-4414 | − | GAGGUAAAAGAGAUAAA | 17 | 5045 |
| BCL11A-4415 | − | GAGUCCGCGUGUGUGGG | 17 | 5046 |
| BCL11A-4416 | − | GAGUCUCCUUCUUUCUAACC | 20 | 5047 |
| BCL11A-4417 | − | GAUGAAGAUAUUUUCUC | 17 | 5048 |
| BCL11A-4418 | − | GCAAAAGCGAGGGGGAGAGA | 20 | 5049 |
| BCL11A-4419 | − | GCACCUCCCCCUCCCCGCAC | 20 | 5050 |
| BCL11A-4420 | − | GCACUUGAACUUGCAGCUCA | 20 | 5051 |
| BCL11A-4421 | + | GCAGGGAAGAUGAAUUG | 17 | 5052 |
| BCL11A-4422 | + | GCAGGGCGAGCAGGAGAGAA | 20 | 5053 |
| BCL11A-4423 | + | GCAGGGGUGGGAGGAAA | 17 | 5054 |
| BCL11A-4424 | + | GCAGGGGUGGGAGGAAAGGG | 20 | 5055 |
| BCL11A-4425 | + | GCCAAUGGCCAGUGCGGGGA | 20 | 5056 |
| BCL11A-4426 | − | GCCACCCCUUUCUUCUCUCC | 20 | 5057 |
| BCL11A-4427 | + | GCCAGACGCGGCCCCCG | 17 | 5058 |
| BCL11A-4428 | − | GCCCCAGCGCCCCCUCCCCU | 20 | 5059 |
| BCL11A-4429 | + | GCCCCCGGGGAGGGGC | 17 | 5060 |
| BCL11A-4430 | − | GCCCGCCCCUCCCCCGG | 17 | 5061 |
| BCL11A-4431 | + | GCCGAGGGGAGGGGCGCUG | 20 | 5062 |
| BCL11A-4432 | + | GCCGCGGCGGUGGCGUGGCC | 20 | 5063 |
| BCL11A-4433 | + | GCCGGGAGAGAAGAAAG | 17 | 5064 |
| BCL11A-4434 | + | GCCGGGAGAGAAGAAAGGGG | 20 | 5065 |
| BCL11A-4435 | + | GCGAGACAUGGUGGGCUGCG | 20 | 5066 |
| BCL11A-4436 | + | GCGCAGGGAAGAUGAAUUGU | 20 | 5067 |
| BCL11A-4437 | + | GCGCCGCGGCGGUGGCG | 17 | 5068 |
| BCL11A-4438 | − | GCGCUCGCUGCGGCCAC | 17 | 5069 |
| BCL11A-4439 | + | GCGGCCCCGGGGAGGGGC | 20 | 5070 |
| BCL11A-4440 | − | GCGGCGCUCGCUGCGGCCAC | 20 | 5071 |
| BCL11A-4441 | + | GCGGCGGCGGCGGCGGC | 17 | 5072 |
| BCL11A-4442 | + | GCGGCGGCGGCGGCGGCGGC | 20 | 5073 |
| BCL11A-4443 | + | GCGGCGGCGGCGGCGGCGGG | 20 | 5074 |
| BCL11A-4444 | + | GCGGCGGCGGCGGCGGG | 17 | 5075 |
| BCL11A-4445 | + | GCGGCGGGCGGACGACGGCU | 20 | 5076 |
| BCL11A-4446 | + | GCGGCGGUGGCGUGGCC | 17 | 5077 |
| BCL11A-4447 | + | GCGGGCGGCGGCGGCGG | 17 | 5078 |
| BCL11A-4448 | + | GCGGGCGGCGGCGGCGGCGG | 20 | 5079 |
| BCL11A-4449 | + | GCGGGAGGGGAGGUG | 17 | 5080 |
| BCL11A-4450 | + | GCGUGGCCGGGAGAGAAGAA | 20 | 5081 |

TABLE 10C-continued

3rd Tier

| gRNA Name | DNA Strand | Targeting Domain | Target Site Length | SEQ ID NO |
|---|---|---|---|---|
| BCL11A-4451 | + | GCUCCCCCCACACACG | 17 | 5082 |
| BCL11A-4452 | + | GCUGGGGUUUGCCUUGCUUG | 20 | 5083 |
| BCL11A-4453 | + | GGACAAGCCAAUGGCCAGUG | 20 | 5084 |
| BCL11A-4454 | + | GGACACACAUCAGGGGC | 17 | 5085 |
| BCL11A-4455 | + | GGACAGAGACACACAAAACA | 20 | 5086 |
| BCL11A-4456 | + | GGACGCCAGACGCGGCCCCC | 20 | 5087 |
| BCL11A-4457 | − | GGACUAGAAGCAAAAGCGAG | 20 | 5088 |
| BCL11A-4458 | + | GGAGAGAAGAAAGGGGUGGC | 20 | 5089 |
| BCL11A-4459 | + | GGAGAGAAGGGAGGAGGGA | 20 | 5090 |
| BCL11A-4460 | + | GGAGAGCCGGGUUAGAAAGA | 20 | 5091 |
| BCL11A-4461 | + | GGAGGGGCGGGCCGAGGGA | 20 | 5092 |
| BCL11A-4462 | + | GGAGGGGGAGGUGCGGGGCG | 20 | 5093 |
| BCL11A-4463 | + | GGAGGGGGCGCUGGGGCCGC | 20 | 5094 |
| BCL11A-4464 | + | GGCAGGGCGAGCAGGAGAGA | 20 | 5095 |
| BCL11A-4465 | + | GGCAGGGGUGGGAGGAA | 17 | 5096 |
| BCL11A-4466 | − | GGCCACUGGUGAGCCCG | 17 | 5097 |
| BCL11A-4467 | + | GGCCCCCGGGGAGGGG | 17 | 5098 |
| BCL11A-4468 | − | GGCCCGCCCCUCCCCCG | 17 | 5099 |
| BCL11A-4469 | + | GGCCGAGGGGAGGGGCGCU | 20 | 5100 |
| BCL11A-4470 | + | GGCCGCAGCGAGCGCCG | 17 | 5101 |
| BCL11A-4471 | + | GGCCGCAGCGAGCGCCGCGG | 20 | 5102 |
| BCL11A-4472 | + | GGCCGCGGGCUCACCAG | 17 | 5103 |
| BCL11A-4473 | + | GGCCGGGAGAAGAAA | 17 | 5104 |
| BCL11A-4474 | + | GGCGAGACAUGGUGGGCUGC | 20 | 5105 |
| BCL11A-4475 | + | GGCGAGCAGGAGAGAAG | 17 | 5106 |
| BCL11A-4476 | + | GGCGAGCAGGAGAGAAGGGG | 20 | 5107 |
| BCL11A-4477 | + | GGCGCAGGGAAGAUGAAUUG | 20 | 5108 |
| BCL11A-4478 | + | GGCGGCGGCGGCGGCGG | 17 | 5109 |
| BCL11A-4479 | + | GGCGGCGGCGGCGGCGGCGG | 20 | 5110 |
| BCL11A-4480 | + | GGCGGGCCGAGGGGAGG | 17 | 5111 |
| BCL11A-4481 | + | GGCUGCGGGGCGGGCGG | 17 | 5112 |
| BCL11A-4482 | + | GGCUGCGGGGCGGGCGGCGG | 20 | 5113 |
| BCL11A-4483 | + | GGGAGAGAAGAAAGGGG | 17 | 5114 |
| BCL11A-4484 | + | GGGAGGAAAGGGUGGGG | 17 | 5115 |
| BCL11A-4485 | + | GGGAGGGGCGGGCCGAG | 17 | 5116 |
| BCL11A-4486 | + | GGGAGGGGCGGGCCGAGGGG | 20 | 5117 |
| BCL11A-4487 | + | GGGAGGGGGAGGUGCGGGGC | 20 | 5118 |
| BCL11A-4488 | + | GGGAGGGGGCGCUGGGGCCG | 20 | 5119 |
| BCL11A-4489 | + | GGGAGGUGCGGGGCGGG | 17 | 5120 |
| BCL11A-4490 | + | GGGCCGAGGGGAGGGGCGC | 20 | 5121 |
| BCL11A-4491 | + | GGGCGAGCAGGAGAGAA | 17 | 5122 |
| BCL11A-4492 | + | GGGCGGGCCGAGGGGAG | 17 | 5123 |
| BCL11A-4493 | + | GGGGAAGCUCACACCAA | 17 | 5124 |
| BCL11A-4494 | + | GGGGAGGGGCGGGCCGA | 17 | 5125 |
| BCL11A-4495 | + | GGGGAGGGGGAGGUGCG | 17 | 5126 |
| BCL11A-4496 | + | GGGGAGGGGGAGGUGCGGGG | 20 | 5127 |
| BCL11A-4497 | + | GGGGAGGUGCGGGGCGG | 17 | 5128 |
| BCL11A-4498 | − | GGGGCCGCGUCUGGCGUCCG | 20 | 5129 |
| BCL11A-4499 | + | GGGGCGGGCCGAGGGGA | 17 | 5130 |
| BCL11A-4500 | + | GGGGCGGGCGGCGGCGG | 17 | 5131 |
| BCL11A-4501 | + | GGGGCGGGCGGCGGCGGCGG | 20 | 5132 |
| BCL11A-4502 | + | GGGGGAGGGGCGGGCCG | 17 | 5133 |
| BCL11A-4503 | + | GGGGGAGGUGCGGGGCG | 17 | 5134 |
| BCL11A-4504 | + | GGGGGCGCUGGGGCCGC | 17 | 5135 |
| BCL11A-4505 | + | GGGGUGGCAGGGGUGGG | 17 | 5136 |
| BCL11A-4506 | + | GGGGUGGGAGGAAAGGG | 17 | 5137 |
| BCL11A-4507 | + | GGGGUGGGAGGAAAGGGUGG | 20 | 5138 |
| BCL11A-4508 | + | GGGGUUUGCCUUGCUUG | 17 | 5139 |
| BCL11A-4509 | + | GGGUGGGAGGAAAGGGU | 17 | 5140 |
| BCL11A-4510 | + | GGGUGGGAGGAAAGGGUGGG | 20 | 5141 |
| BCL11A-4511 | − | GGUAAAAGAGAUAAAGG | 17 | 5142 |
| BCL11A-4512 | + | GGUGGCAGGGGUGGGAGGAA | 20 | 5143 |
| BCL11A-4513 | + | GGUGGGAGGAAAGGGUG | 17 | 5144 |
| BCL11A-4514 | + | GGUGGGAGGAAAGGGUGGGG | 20 | 5145 |
| BCL11A-4515 | + | GGUUCCAGAUGGGAUGA | 17 | 5146 |
| BCL11A-4516 | − | GUAUUAUUUCUAAUUUAUUU | 20 | 5147 |
| BCL11A-4517 | − | GUCGAGGUAAAAGAGAUAAA | 20 | 5148 |
| BCL11A-4518 | + | GUGCGGGAGGGGGAGGUGC | 20 | 5149 |
| BCL11A-4519 | + | GUGCGGGCGGGGGCUCCG | 20 | 5150 |
| BCL11A-4520 | + | GUGGCAGGGGUGGGAGGAAA | 20 | 5151 |
| BCL11A-4521 | + | GUGGCCGGGAGAAGAAAG | 20 | 5152 |
| BCL11A-4522 | + | GUGGGAGGAAAGGGUGG | 17 | 5153 |
| BCL11A-4523 | + | GUGGGCUGCGGGGCGGG | 17 | 5154 |

TABLE 10C-continued

3rd Tier

| gRNA Name | DNA Strand | Targeting Domain | Target Site Length | SEQ ID NO |
|---|---|---|---|---|
| BCL11A-4524 | + | GUGGGCUGCGGGGCGGGCGG | 20 | 5155 |
| BCL11A-4525 | − | GUGUGUGGGGGGGAGCA | 17 | 5156 |

Table 10D provides exemplary targeting domains for knocking down expression of the BCL11A gene according to forth tier parameters. The targeting domains bind between 500 bp upstream and 500 bp downstream of transcription start site and do not start with G. It is contemplated herein that the targeting domain hybridizes to the target domain through complementary base pairing. Any of the targeting domains in the table can be used with a *S. pyogenes* eiCas9 molecule to cause a steric block at the target region, e.g., between 500 bp upstream and 500 bp downstream of transcription start site to block transcription resulting in the repression of the BCL11A gene. Alternatively, any of the targeting domains in the table can be used with a *S. pyogenes* eiCas9 fused to a transcriptional repressor to decrease transcription and therefore downregulate gene expression.

TABLE 10D

4th Tier

| gRNA Name | DNA Strand | Targeting Domain | Target Site Length | SEQ ID NO |
|---|---|---|---|---|
| BCL11A-4526 | + | AAAAAAAAAAAAAAAAAAAG | 20 | 5157 |
| BCL11A-4527 | + | AAAAAAAAAAAAAAAAAAGA | 20 | 5158 |
| BCL11A-4528 | + | AAAAAAAAAAAAAAAG | 17 | 5159 |
| BCL11A-4529 | + | AAAAAAAAAAAAAAGA | 17 | 5160 |
| BCL11A-4530 | + | AAAACAUGGGCAGGGCGAGC | 20 | 5161 |
| BCL11A-4531 | − | AAAACCCUCAUCCCAUC | 17 | 5162 |
| BCL11A-4532 | − | AAAACCUCCGAGAGUCG | 17 | 5163 |
| BCL11A-4533 | − | AAAAGCGAGGGGGAGAG | 17 | 5164 |
| BCL11A-4534 | − | AAAGCGAGGGGGAGAGA | 17 | 5165 |
| BCL11A-4535 | + | AAAGGGGUGGCAGGGGU | 17 | 5166 |
| BCL11A-4536 | + | AAAGGGGUGGCAGGGGUGGG | 20 | 5167 |
| BCL11A-4537 | + | AAAUAAUACAAAGAUGGCGC | 20 | 5168 |
| BCL11A-4538 | − | AACCCCAGCACUUAAGCAAA | 20 | 5169 |
| BCL11A-4539 | + | AACGUCAGGAGUCUGGA | 17 | 5170 |
| BCL11A-4540 | + | AAGAAAGGGUGGCAGGGGU | 20 | 5171 |
| BCL11A-4541 | + | AAGAGACCAGGACAAGCCAA | 20 | 5172 |
| BCL11A-4542 | + | AAGCCAAUGGCCAGUGC | 17 | 5173 |
| BCL11A-4543 | − | AAGCGAGGGGGAGAGAG | 17 | 5174 |
| BCL11A-4544 | + | AAGUGCAUACACGGCAA | 17 | 5175 |
| BCL11A-4545 | + | AAUAAUACAAAGAUGGCGCA | 20 | 5176 |

TABLE 10D-continued

4th Tier

| gRNA Name | DNA Strand | Targeting Domain | Target Site Length | SEQ ID NO |
|---|---|---|---|---|
| BCL11A-4546 | + | AAUACAAAGAUGGCGCA | 17 | 5177 |
| BCL11A-4547 | + | AAUGGACACACAUCAGGGGC | 20 | 5178 |
| BCL11A-4548 | + | AAUGGCCAGUGCGGGGA | 17 | 5179 |
| BCL11A-4549 | + | AAUGGUUCCAGAUGGGAUGA | 20 | 5180 |
| BCL11A-4550 | + | AAUUAAUAAAAUUAAA | 17 | 5181 |
| BCL11A-4551 | + | AAUUAGAAAUAAUACAAAGA | 20 | 5182 |
| BCL11A-4552 | − | AAUUUAUUUUGGAUGUCAAA | 20 | 5183 |
| BCL11A-4553 | + | ACAAGCCAAUGGCCAGUGCG | 20 | 5184 |
| BCL11A-4554 | + | ACACACAAAACAUGGGC | 17 | 5185 |
| BCL11A-4555 | + | ACACCAAUGGACACACAUCA | 20 | 5186 |
| BCL11A-4556 | + | ACAUGGGCAGGGCGAGC | 17 | 5187 |
| BCL11A-4557 | + | ACCAAUGGACACACAUC | 17 | 5188 |
| BCL11A-4558 | − | ACCCCAGCACUUAAGCAAAC | 20 | 5189 |
| BCL11A-4559 | − | ACCCCUUUCUUCUCUCC | 17 | 5190 |
| BCL11A-4560 | + | ACGCCAGACGCGGCCCC | 17 | 5191 |
| BCL11A-4561 | + | ACGCCAGACGCGGCCCCCGG | 20 | 5192 |
| BCL11A-4562 | + | ACGCGGCCCCCGGGGA | 17 | 5193 |
| BCL11A-4563 | + | ACGGCAAUGGUUCCAGA | 17 | 5194 |
| BCL11A-4564 | − | ACUAGAAGCAAAAGCGA | 17 | 5195 |
| BCL11A-4565 | − | ACUGAUGAAGAUAUUUUCUC | 20 | 5196 |
| BCL11A-4566 | − | ACUUGAACUUGCAGCUC | 17 | 5197 |
| BCL11A-4567 | − | ACUUGAACUUGCAGCUCAGG | 20 | 5198 |
| BCL11A-4568 | − | AGAAAACCUCCGAGAGUCG | 20 | 5199 |
| BCL11A-4569 | + | AGAAGAAAGGGGUGGCA | 17 | 5200 |
| BCL11A-4570 | + | AGAAGGGGAGGAGGGAA | 17 | 5201 |
| BCL11A-4571 | + | AGACACACAAAACAUGGCA | 20 | 5202 |
| BCL11A-4572 | + | AGACAUGGUGGGCUGCG | 17 | 5203 |
| BCL11A-4573 | + | AGACAUGGUGGGCUGCGGGG | 20 | 5204 |
| BCL11A-4574 | + | AGACCAGGACAAGCCAA | 17 | 5205 |
| BCL11A-4575 | + | AGACGCGGCCCCCGGGGAG | 20 | 5206 |
| BCL11A-4576 | + | AGAGAAGAAAGGGGUGGCAG | 20 | 5207 |
| BCL11A-4577 | + | AGAGAAGGGGAGGAGGGAAG | 20 | 5208 |
| BCL11A-4578 | + | AGAGACACACAAAACAU | 17 | 5209 |
| BCL11A-4579 | + | AGAGAGAAGAGAGAUAG | 17 | 5210 |
| BCL11A-4580 | + | AGAGAGAAGAGAGAUAGA | 20 | 5211 |
| BCL11A-4581 | + | AGAGAGAGAUGAAAAAAA | 20 | 5212 |
| BCL11A-4582 | − | AGAGUCCGCGUGUGUGG | 17 | 5213 |

TABLE 10D-continued

4th Tier

| gRNA Name | DNA Strand | Targeting Domain | Target Site Length | SEQ ID NO |
|---|---|---|---|---|
| BCL11A-4583 | - | AGCAAAAGCGAGGGGGAGAG | 20 | 5214 |
| BCL11A-4584 | + | AGCAGGAGAGAAGGGGAGGA | 20 | 5215 |
| BCL11A-4585 | + | AGCCAAUGGCCAGUGCG | 17 | 5216 |
| BCL11A-4586 | + | AGCCAAUGGCCAGUGCGGGG | 20 | 5217 |
| BCL11A-4587 | - | AGCCCCUGAUGUGUGUCCAU | 20 | 5218 |
| BCL11A-4588 | + | AGCGAGCGCCGCGGCGG | 17 | 5219 |
| BCL11A-4589 | + | AGCUGCAAGUUCAAGUG | 17 | 5220 |
| BCL11A-4590 | - | AGGACUAGAAGCAAAAGCGA | 20 | 5221 |
| BCL11A-4591 | + | AGGAGAGAAGGGGAGGA | 17 | 5222 |
| BCL11A-4592 | + | AGGGCGAGCAGGAGAGA | 17 | 5223 |
| BCL11A-4593 | + | AGGGGCGGGCCGAGGGG | 17 | 5224 |
| BCL11A-4594 | + | AGGGGCGGGCCGAGGGGAGG | 20 | 5225 |
| BCL11A-4595 | + | AGGGGGAGGUGCGGGGC | 17 | 5226 |
| BCL11A-4596 | + | AGGGGGAGGUGCGGGGCGGG | 20 | 5227 |
| BCL11A-4597 | + | AGGGGGCGCUGGGGCCG | 17 | 5228 |
| BCL11A-4598 | + | AGGGGUGGGAGGAAAGGGUG | 20 | 5229 |
| BCL11A-4599 | - | AGGUAAAAGAGAUAAAG | 17 | 5230 |
| BCL11A-4600 | - | AGUCCGCGUGUGUGGGG | 17 | 5231 |
| BCL11A-4601 | - | AGUCGAGGUAAAAGAGAUAA | 20 | 5232 |
| BCL11A-4602 | + | AGUGCGGGGAGGGGAGGUG | 20 | 5233 |
| BCL11A-4603 | + | AGUGGCCGCAGCGAGCGCCG | 20 | 5234 |
| BCL11A-4604 | + | AUAAUUAUUAUUACUAUUAU | 20 | 5235 |
| BCL11A-4605 | + | AUCUCUUUUACCUCGACUCU | 20 | 5236 |
| BCL11A-4606 | + | AUGGCCAGUGCGGGGAG | 17 | 5237 |
| BCL11A-4607 | + | AUGGUGGGCUGCGGGGC | 17 | 5238 |
| BCL11A-4608 | + | AUGGUGGGCUGCGGGGCGGG | 20 | 5239 |
| BCL11A-4609 | + | AUUAUUAUUACUAUUAU | 17 | 5240 |
| BCL11A-4610 | - | AUUUUAGAGUCCGCGUGUGU | 20 | 5241 |
| BCL11A-4611 | - | CAAAAGCGAGGGGGAGAGAG | 20 | 5242 |
| BCL11A-4612 | + | CAAAAGUGCAUACACGGCAA | 20 | 5243 |
| BCL11A-4613 | + | CAAGCCAAUGGCCAGUG | 17 | 5244 |
| BCL11A-4614 | + | CAAUGGACACACAUCAG | 17 | 5245 |
| BCL11A-4615 | + | CAAUGGCCAGUGCGGGG | 17 | 5246 |
| BCL11A-4616 | + | CAAUGGCCAGUGCGGGGAGG | 20 | 5247 |
| BCL11A-4617 | + | CAAUGGUUCCAGAUGGGAUG | 20 | 5248 |
| BCL11A-4618 | + | CACACAAAACAUGGGCA | 17 | 5249 |
| BCL11A-4619 | + | CACACCAAUGGACACACAUC | 20 | 5250 |
| BCL11A-4620 | + | CACCAAUGGACACACAUCAG | 20 | 5251 |
| BCL11A-4621 | - | CACCGCCGCGGCGCUCGCUG | 20 | 5252 |
| BCL11A-4622 | - | CACUGGCCAUUGGCUUGUCC | 20 | 5253 |
| BCL11A-4623 | - | CACUUGAACUUGCAGCUCAG | 20 | 5254 |
| BCL11A-4624 | + | CAGACGCGGCCCCCGGGGA | 20 | 5255 |
| BCL11A-4625 | + | CAGAGACACACAAAACA | 17 | 5256 |
| BCL11A-4626 | - | CAGGACUAGAAGCAAAAGCG | 20 | 5257 |
| BCL11A-4627 | + | CAGGAGAGAAGGGGAGG | 17 | 5258 |
| BCL11A-4628 | + | CAGGGAAGAUGAAUUGU | 17 | 5259 |
| BCL11A-4629 | + | CAGGGCGAGCAGGAGAGAAG | 20 | 5260 |
| BCL11A-4630 | + | CAGGGGUGGGAGGAAAGGGU | 20 | 5261 |
| BCL11A-4631 | + | CAUGGUGGGCUGCGGGG | 17 | 5262 |
| BCL11A-4632 | + | CCAAUGGACACACAUCA | 17 | 5263 |
| BCL11A-4633 | + | CCAAUGGCCAGUGCGGGGAG | 20 | 5264 |
| BCL11A-4634 | + | CCAGACGCGGCCCCCGG | 17 | 5265 |
| BCL11A-4635 | + | CCAGACGCGGCCCCCGGGGG | 20 | 5266 |
| BCL11A-4636 | - | CCAGCACUUAAGCAAAC | 17 | 5267 |
| BCL11A-4637 | - | CCAGCGCCCCCUCCCCU | 17 | 5268 |
| BCL11A-4638 | + | CCAGUGCGGGGAGGGGG | 17 | 5269 |
| BCL11A-4639 | - | CCCAGCACUUAAGCAAA | 17 | 5270 |
| BCL11A-4640 | - | CCCCCGGGGGCCGCGUC | 17 | 5271 |
| BCL11A-4641 | - | CCCCUCCCCGCACUGGCCAU | 20 | 5272 |
| BCL11A-4642 | + | CCCGGGGGAGGGGCGGGCCG | 20 | 5273 |
| BCL11A-4643 | + | CCCGUUUGCUUAAGUGC | 17 | 5274 |
| BCL11A-4644 | - | CCCUCGGCCCGCCCCUCCCC | 20 | 5275 |
| BCL11A-4645 | - | CCCUGAUGUGUGUCCAU | 17 | 5276 |
| BCL11A-4646 | + | CCGAGGGGAGGGGCGC | 17 | 5277 |
| BCL11A-4647 | - | CCGCGUGUGUGGGGGGAGC | 20 | 5278 |
| BCL11A-4648 | + | CCGGGGGAGGGGCGGGCCGA | 20 | 5279 |
| BCL11A-4649 | + | CCGUUUGCUUAAGUGCU | 17 | 5280 |
| BCL11A-4650 | - | CCUCCCCCGGGGGCCGCGUC | 20 | 5281 |
| BCL11A-4651 | - | CCUCCCCCUCCCCGCAC | 17 | 5282 |
| BCL11A-4652 | - | CCUCGGCCCGCCCCUCCCCC | 20 | 5283 |
| BCL11A-4653 | + | CCUGCUCCCCCCCACACACG | 20 | 5284 |
| BCL11A-4654 | + | CGAGACAUGGUGGGCUG | 17 | 5285 |
| BCL11A-4655 | + | CGAGCGCCGCGGCGGUGGCG | 20 | 5286 |
| BCL11A-4656 | + | CGAGGGGAGGGGCGCU | 17 | 5287 |

TABLE 10D-continued

4th Tier

| gRNA Name | DNA Strand | Targeting Domain | Target Site Length | SEQ ID NO |
|---|---|---|---|---|
| BCL11A-4657 | - | CGAGGUAAAAGAGAUAA | 17 | 5288 |
| BCL11A-4658 | - | CGAGGUAAAAGAGAUAAAGG | 20 | 5289 |
| BCL11A-4659 | - | CGCACUUGAACUUGCAGCUC | 20 | 5290 |
| BCL11A-4660 | + | CGCAGCGAGCGCCGCGG | 17 | 5291 |
| BCL11A-4661 | + | CGCAGCGAGCGCCGCGGCGG | 20 | 5292 |
| BCL11A-4662 | + | CGCCAGACGCGGCCCCC | 17 | 5293 |
| BCL11A-4663 | - | CGCCGCGGCGCUCGCUG | 17 | 5294 |
| BCL11A-4664 | + | CGCCGCGGCGGUGGCGUGGC | 20 | 5295 |
| BCL11A-4665 | + | CGCGGCCCCCGGGGGAG | 17 | 5296 |
| BCL11A-4666 | + | CGCGGCCCCCGGGGAGGGG | 20 | 5297 |
| BCL11A-4667 | + | CGCGGCGGUGGCGUGGC | 17 | 5298 |
| BCL11A-4668 | - | CGCGUGUGUGGGGGGGAGCA | 20 | 5299 |
| BCL11A-4669 | + | CGGCAAUGGUUCCAGAU | 17 | 5300 |
| BCL11A-4670 | - | CGGCCACGCCACCGCCG | 17 | 5301 |
| BCL11A-4671 | - | CGGCCCGCCCCUCCCCC | 17 | 5302 |
| BCL11A-4672 | + | CGGCGAGACAUGGUGGGCUG | 20 | 5303 |
| BCL11A-4673 | + | CGGCGGCGGCGGGCGGACGA | 20 | 5304 |
| BCL11A-4674 | + | CGGCGGCGGGCGGACGA | 17 | 5305 |
| BCL11A-4675 | + | CGGGGAGGGGGAGGUGC | 17 | 5306 |
| BCL11A-4676 | + | CGGGGCGGGGGGCUCCG | 17 | 5307 |
| BCL11A-4677 | + | CGGGGGAGGGGCGGGCCGAG | 20 | 5308 |
| BCL11A-4678 | + | CGUGGCCGGGAGAGAAGAAA | 20 | 5309 |
| BCL11A-4679 | - | CGUGUGUGGGGGGGAGC | 17 | 5310 |
| BCL11A-4680 | + | CGUUUGCUUAAGUGCUG | 17 | 5311 |
| BCL11A-4681 | - | CUAGAAGCAAAAGCGAG | 17 | 5312 |
| BCL11A-4682 | - | CUCCCCGCACUGGCCAU | 17 | 5313 |
| BCL11A-4683 | - | CUCGGCCCGCCCCUCCCCCG | 20 | 5314 |
| BCL11A-4684 | + | CUGAGCUGCAAGUUCAAGUG | 20 | 5315 |
| BCL11A-4685 | + | CUGCGAACUUGAACGUC | 17 | 5316 |
| BCL11A-4686 | + | CUGGACAUGAAAAGAGACC | 20 | 5317 |
| BCL11A-4687 | + | CUGUCUCAAAAGUGCAUACA | 20 | 5318 |
| BCL11A-4688 | + | CUUGAACGUCAGGAGUC | 17 | 5319 |
| BCL11A-4689 | - | CUUGAACUUGCAGCUCA | 17 | 5320 |
| BCL11A-4690 | - | CUUGAACUUGCAGCUCAGGG | 20 | 5321 |
| BCL11A-4691 | + | CUUGCGGCGAGACAUGG | 17 | 5322 |
| BCL11A-4692 | + | GUUCACAUCGGGAGAGC | 17 | 5323 |
| BCL11A-4693 | + | UAAUACAAAGAUGGCGC | 17 | 5324 |
| BCL11A-4694 | + | UAAUUAUUAUUACUAUUAUU | 20 | 5325 |
| BCL11A-4695 | + | UACACGGCAAUGGUUCCAGA | 20 | 5326 |
| BCL11A-4696 | + | UAGAAAUAAUACAAAGA | 17 | 5327 |
| BCL11A-4697 | - | UAGAAGCAAAAGCGAGG | 17 | 5328 |
| BCL11A-4698 | - | UAGAGUCCGCGUGUGUG | 17 | 5329 |
| BCL11A-4699 | - | UAGAGUCCGCGUGUGUGGGG | 20 | 5330 |
| BCL11A-4700 | - | UCCCGGCCACGCCACCGCCG | 20 | 5331 |
| BCL11A-4701 | + | UCCCGUUUGCUUAAGUGCUG | 20 | 5332 |
| BCL11A-4702 | + | UCCCUGCGAACUUGAACGUC | 20 | 5333 |
| BCL11A-4703 | - | UCGAGGUAAAAGAGAUAAAG | 20 | 5334 |
| BCL11A-4704 | - | UCGGCCCGCCCCUCCCC | 17 | 5335 |
| BCL11A-4705 | - | UCGGCCCGCCCCUCCCCCGG | 20 | 5336 |
| BCL11A-4706 | + | UCUCAAAAGUGCAUACA | 17 | 5337 |
| BCL11A-4707 | - | UCUCCUUCUUUCUAACC | 17 | 5338 |
| BCL11A-4708 | + | UCUUUUACCUCGACUCU | 17 | 5339 |
| BCL11A-4709 | - | UGAACUUGCAGCUCAGG | 17 | 5340 |
| BCL11A-4710 | - | UGCGGCCACUGGUGAGCCCG | 20 | 5341 |
| BCL11A-4711 | + | UGCGGGGAGGGGGAGGUGCG | 20 | 5342 |
| BCL11A-4712 | + | UGCGGGGCGGGCGGCGG | 17 | 5343 |
| BCL11A-4713 | + | UGCGGGGCGGGCGGCGGCGG | 20 | 5344 |
| BCL11A-4714 | - | UGCUUAAAAAAAGCCAUGA | 20 | 5345 |
| BCL11A-4715 | + | UGGCCAGUGCGGGGAGG | 17 | 5346 |
| BCL11A-4716 | + | UGGCCAGUGCGGGGAGGGGG | 20 | 5347 |
| BCL11A-4717 | - | UGGCCAUUGGCUUGUCC | 17 | 5348 |
| BCL11A-4718 | + | UGGCCGGGAGAGAAGAA | 17 | 5349 |
| BCL11A-4719 | + | UGGGAGGAAAGGGUGGG | 17 | 5350 |
| BCL11A-4720 | + | UGGGGCCGCGGGCUCACCAG | 20 | 5351 |
| BCL11A-4721 | + | UGGUUCCAGAUGGGAUG | 17 | 5352 |
| BCL11A-4722 | - | UUAAAAAAAGCCAUGA | 17 | 5353 |
| BCL11A-4723 | - | UUAGAGUCCGCGUGUGUGGG | 20 | 5354 |
| BCL11A-4724 | + | UUAUUAUUACUAUUAUU | 17 | 5355 |
| BCL11A-4725 | - | UUAUUUCUAAUUUAUUU | 17 | 5356 |
| BCL11A-4726 | - | UUAUUUUGGAUGUCAAA | 17 | 5357 |
| BCL11A-4727 | + | UUCACAUCGGGAGAGCC | 17 | 5358 |
| BCL11A-4728 | + | UUCCCGUUUGCUUAAGUGCU | 20 | 5359 |
| BCL11A-4729 | + | UUGAACGUCAGGAGUCGGA | 20 | 5360 |
| BCL11A-4730 | - | UUGAACUUGCAGCUCAG | 17 | 5361 |

TABLE 10D-continued

4th Tier

| gRNA Name | DNA Strand | Targeting Domain | Target Site Length | SEQ ID NO |
|---|---|---|---|---|
| BCL11A-4731 | + | UUGCUUGCGGCGAGACAUGG | 20 | 5362 |
| BCL11A-4732 | + | UUGUGGGAGAGCCGUCA | 17 | 5363 |
| BCL11A-4733 | − | UUUUAGAGUCCGCGUGUGUG | 20 | 5364 |

Table 11A provides exemplary targeting domains for knocking down expression of the BCL11A gene according to first tier parameters. The targeting domains bind between 500 bp upstream and 500 bp downstream of transcription start site, good orthogonality, starts with G. It is contemplated herein that the targeting domain hybridizes to the target domain through complementary base pairing. Any of the targeting domains in the table can be used with a S. aureus eiCas9 molecule to cause a steric block at the target region, e.g., between 500 bp upstream and 500 bp downstream of transcription start site to block transcription resulting in the repression of the BCL11A gene. Alternatively, any of the targeting domains in the table can be used with a S. aureus eiCas9 fused to a transcriptional repressor to decrease transcription and therefore downregulate gene expression.

TABLE 11A

1st Tier

| gRNA Name | DNA Strand | Targeting Domain | Target Site Length | SEQ ID NO |
|---|---|---|---|---|
| BCL11A-4734 | + | GACGACGGCUCGGUUCACAU | 20 | 6365 |
| BCL11A-4735 | + | GACGGCUCGGUUCACAU | 17 | 6366 |
| BCL11A-4736 | + | GACGGCUCGGUUCACAUCGG | 20 | 6367 |
| BCL11A-4737 | + | GACGUGACGUCCCUGCGAAC | 20 | 6368 |
| BCL11A-4738 | + | GCGGACGUGACGUCCCU | 17 | 6369 |
| BCL11A-4739 | + | GGACGACGGCUCGGUUCACA | 20 | 6370 |
| BCL11A-4740 | − | GGACGUCACGUCCGCAC | 17 | 6371 |
| BCL11A-4741 | + | GGCUCGGUUCACAUCGG | 17 | 6372 |
| BCL11A-4742 | − | GGCUCUCCCGAUGUGAA | 17 | 6373 |
| BCL11A-4743 | + | GGUUCACAUCGGGAGAG | 17 | 6374 |
| BCL11A-4744 | + | GUCCCUGCGAACUUGAACGU | 20 | 6375 |
| BCL11A-4745 | + | GUGACGUCCCUGCGAAC | 17 | 6376 |

Table 11B provides exemplary targeting domains for knocking down expression of the BCL11A gene according to second tier parameters. The targeting domains bind between 500 bp upstream and 500 bp downstream of transcription start site, good orthogonality and do not start with G. It is contemplated herein that the targeting domain hybridizes to the target domain through complementary base pairing. Any of the targeting domains in the table can be used with a S. aureus eiCas9 molecule to cause a steric block at the target region, e.g., between 500 bp upstream and 500 bp downstream of transcription start site to block transcription resulting in the repression of the BCL11A gene. Alternatively, any of the targeting domains in the table can be used with a S. aureus eiCas9 fused to a transcriptional repressor to decrease transcription and therefore downregulate gene expression.

TABLE 11B

2nd Tier

| gRNA Name | DNA Strand | Targeting Domain | Target Site Length | SEQ ID NO |
|---|---|---|---|---|
| BCL11A-4746 | + | ACGACGGCUCGGUUCACAUC | 20 | 6377 |
| BCL11A-4747 | − | ACGAGAGCGCGCAGGAC | 17 | 6378 |
| BCL11A-4748 | + | ACGGCUCGGUUCACAUC | 17 | 6379 |
| BCL11A-4749 | + | AGUGCGGACGUGACGUCCCU | 20 | 6380 |
| BCL11A-4750 | − | AUCACGAGAGCGCGCAGGAC | 20 | 6381 |
| BCL11A-4751 | − | CAGGGACGUCACGUCCGCAC | 20 | 6382 |
| BCL11A-4752 | + | CAUCGGGAGAGCCGGGU | 17 | 6383 |
| BCL11A-4753 | − | CCCGGCUCUCCCGAUGUGAA | 20 | 6384 |
| BCL11A-4754 | + | CCUGCGAACUUGAACGU | 17 | 6385 |
| BCL11A-4755 | + | CGACGGCUCGGUUCACA | 17 | 6386 |
| BCL11A-4756 | + | CUCGGUUCACAUCGGGAGAG | 20 | 6387 |
| BCL11A-4757 | + | CUGCGAACUUGAACGUC | 17 | 6388 |
| BCL11A-4758 | + | UCACAUCGGGAGAGCCGGGU | 20 | 6389 |
| BCL11A-4759 | + | UCCCUGCGAACUUGAACGUC | 20 | 6390 |

Table 11C provides exemplary targeting domains for knocking down expression of the BCL11A gene according to third tier parameters. The targeting domains bind between 500 bp upstream and 500 bp downstream of transcription start site and start with G. It is contemplated herein that the targeting domain hybridizes to the target domain through complementary base pairing. Any of the targeting domains in the table can be used with a S. aureus eiCas9 molecule to cause a steric block at the target region, e.g., between 500 bp upstream and 500 bp downstream of transcription start site to block transcription resulting in the repression of the BCL11A gene. Alternatively, any of the targeting domains in the table can be used with a S. aureus eiCas9 fused to a transcriptional repressor to decrease transcription and therefore downregulate gene expression.

TABLE 11C

3rd Tier

| gRNA Name | DNA Strand | Targeting Domain | Target Site Length | SEQ ID NO |
|---|---|---|---|---|
| BCL11A-4760 | − | GAAAAAACCCUCAUCCCAUC | 20 | 6391 |
| BCL11A-4761 | + | GAAAGAAGGAGACUCCA | 17 | 6392 |
| BCL11A-4762 | + | GAAAGGGUGGCAGGGG | 17 | 6393 |
| BCL11A-4763 | + | GAAAGGGUGGCAGGGGUGG | 20 | 6394 |
| BCL11A-4764 | + | GAAAUAAUACAAAGAUGGCG | 20 | 6395 |

TABLE 11C-continued

3rd Tier

| gRNA Name | DNA Strand | Targeting Domain | Target Site Length | SEQ ID NO |
|---|---|---|---|---|
| BCL11A-4765 | + | GAACGUCAGGAGUCUGG | 17 | 6396 |
| BCL11A-4766 | + | GAAGAAGGGGUGGCAGGGG | 20 | 6397 |
| BCL11A-4767 | + | GAAGAGAGAUAGAGGGA | 17 | 6398 |
| BCL11A-4768 | − | GAAGCAAAAGCGAGGGG | 17 | 6399 |
| BCL11A-4769 | + | GAAGGGGAGGAGGGAAG | 17 | 6400 |
| BCL11A-4770 | + | GACAAGCCAAUGGCCAGUGC | 20 | 6401 |
| BCL11A-4771 | + | GACACACAAAACAUGGG | 17 | 6402 |
| BCL11A-4772 | + | GACGCCAGACGCGGCCC | 17 | 6403 |
| BCL11A-4773 | + | GACGCCAGACGCGGCCCCCG | 20 | 6404 |
| BCL11A-4774 | + | GACGCGGCCCCCGGGGG | 17 | 6405 |
| BCL11A-4775 | − | GACUAGAAGCAAAAGCG | 17 | 6406 |
| BCL11A-4776 | − | GACUAGAAGCAAAAGCGAGG | 20 | 6407 |
| BCL11A-4777 | + | GACUCUCGGAGGUUUUUCUC | 20 | 6408 |
| BCL11A-4778 | + | GAGAAGAAAGGGGUGGC | 17 | 6409 |
| BCL11A-4779 | + | GAGAAGAGAGAUAGAGG | 17 | 6410 |
| BCL11A-4780 | + | GAGAAGGGGAGGAGGGA | 17 | 6411 |
| BCL11A-4781 | + | GAGACAUGGUGGGCUGCGGG | 20 | 6412 |
| BCL11A-4782 | + | GAGAGAAGAGAGAUAGA | 17 | 6413 |
| BCL11A-4783 | + | GAGAGAAGGGGAGGAGGGAA | 20 | 6414 |
| BCL11A-4784 | + | GAGAGAGAAGAGAGAUA | 17 | 6415 |
| BCL11A-4785 | + | GAGAGAGAGAAGAGAGA | 17 | 6416 |
| BCL11A-4786 | + | GAGAGAGAGAAGAGAGAUAG | 20 | 6417 |
| BCL11A-4787 | + | GAGAGAGAGAGAGAGAG | 17 | 6418 |
| BCL11A-4788 | + | GAGAGAUAGAGGGAGAGAGA | 20 | 6419 |
| BCL11A-4789 | + | GAGAUAGAGGGAGAGAGA | 20 | 6420 |
| BCL11A-4790 | + | GAGCAGGAGAGAAGGGG | 17 | 6421 |
| BCL11A-4791 | + | GAGCAGGAGAGAAGGGGAGG | 20 | 6422 |
| BCL11A-4792 | + | GAGCCGGGUUAGAAAGA | 17 | 6423 |
| BCL11A-4793 | + | GAGCUGCAAGUUCAAGU | 17 | 6424 |
| BCL11A-4794 | + | GAGGGAGAGAGAGAGAA | 17 | 6425 |
| BCL11A-4795 | + | GAGGGGCGGGCCGAGGG | 17 | 6426 |
| BCL11A-4796 | + | GAGGGGGAGGUGCGGGG | 17 | 6427 |
| BCL11A-4797 | + | GAGGGGGCGCUGGGGCC | 17 | 6428 |
| BCL11A-4798 | − | GAGGUAAAAGAGAUAAA | 17 | 6429 |
| BCL11A-4799 | − | GAGUCCGCGUGUGUGGG | 17 | 6430 |
| BCL11A-4800 | − | GAGUCGAGGUAAAAGAGAUA | 20 | 6431 |
| BCL11A-4801 | + | GAUAGAGGGAGAGAGAGAGA | 20 | 6432 |
| BCL11A-4802 | − | GAUGAAGAUAUUUCUC | 17 | 6433 |
| BCL11A-4803 | − | GAUGUCAAAAGGCACUG | 17 | 6434 |
| BCL11A-4804 | − | GAUGUGUGUCCAUUGGU | 17 | 6435 |
| BCL11A-4805 | + | GCAAUGGUUCCAGAUGGGAU | 20 | 6436 |
| BCL11A-4806 | − | GCACUUGAACUUGCAGCUCA | 20 | 6437 |
| BCL11A-4807 | − | GCAGGACUAGAAGCAAAAGC | 20 | 6438 |
| BCL11A-4808 | + | GCAGGAGAGAAGGGGAG | 17 | 6439 |
| BCL11A-4809 | + | GCAGGGAAGAUGAAUUG | 17 | 6440 |
| BCL11A-4810 | + | GCAGGGAAGAUGAAUUGUGG | 20 | 6441 |
| BCL11A-4811 | + | GCAGGGCGAGCAGGAGAGAA | 20 | 6442 |
| BCL11A-4812 | + | GCAGGGGUGGGAGGAAAGGG | 20 | 6443 |
| BCL11A-4813 | − | GCAUUUUUAAAUUUUUC | 17 | 6444 |
| BCL11A-4814 | + | GCCAAUGGCCAGUGCGGGGA | 20 | 6445 |
| BCL11A-4815 | + | GCCAGACGCGGCCCCCG | 17 | 6446 |
| BCL11A-4816 | + | GCCAGACGCGGCCCCCGGGG | 20 | 6447 |
| BCL11A-4817 | + | GCCCCCGGGGAGGGGCGGG | 20 | 6448 |
| BCL11A-4818 | + | GCCGAGGGGAGGGGCG | 17 | 6449 |
| BCL11A-4819 | + | GCCGCGGCGGUGGCGUGGCC | 20 | 6450 |
| BCL11A-4820 | − | GCCGCGUCUGGCGUCCG | 17 | 6451 |
| BCL11A-4821 | + | GCGAGACAUGGUGGGCU | 17 | 6452 |
| BCL11A-4822 | − | GCGCAGGACUAGAAGCAAAA | 20 | 6453 |
| BCL11A-4823 | + | GCGCAGGGAAGAUGAAUUGU | 20 | 6454 |
| BCL11A-4824 | + | GCGCCGCGGCGGUGGCGUGG | 20 | 6455 |
| BCL11A-4825 | + | GCGGACGCCAGACGCGGCCC | 20 | 6456 |
| BCL11A-4826 | + | GCGGCGAGACAUGGUGGGCU | 20 | 6457 |
| BCL11A-4827 | + | GCGGCGGUGGCGUGGCC | 17 | 6458 |
| BCL11A-4828 | + | GCGGGGAGGGGAGGUG | 17 | 6459 |
| BCL11A-4829 | + | GCGGGCGGGGGCUCC | 17 | 6460 |
| BCL11A-4830 | + | GCGUGGCCGGGAGAGAAGAA | 20 | 6461 |
| BCL11A-4831 | − | GCGUGUGGGGGGGAG | 17 | 6462 |
| BCL11A-4832 | + | GCUCACCAGUGGCCGCA | 17 | 6463 |
| BCL11A-4833 | − | GCUCGCUGCGGCCACUG | 17 | 6464 |
| BCL11A-4834 | + | GCUGGACAUGAAAAGAGAC | 20 | 6465 |
| BCL11A-4835 | + | GCUUGCGGCGAGACAUG | 17 | 6466 |
| BCL11A-4836 | − | GGAAAAACCCUCAUCCCAU | 20 | 6467 |
| BCL11A-4837 | + | GGAAGGGGAAGCUCACACCA | 20 | 6468 |
| BCL11A-4838 | + | GGACAAGCCAAUGGCCAGUG | 20 | 6469 |

TABLE 11C-continued

3rd Tier

| gRNA Name | DNA Strand | Targeting Domain | Target Site Length | SEQ ID NO |
|---|---|---|---|---|
| BCL11A-4839 | + | GGACAUGAAAAAGAGAC | 17 | 6470 |
| BCL11A-4840 | + | GGACGCCAGACGCGGCCCCC | 20 | 6471 |
| BCL11A-4841 | - | GGACUAGAAGCAAAAGC | 17 | 6472 |
| BCL11A-4842 | - | GGACUAGAAGCAAAAGCGAG | 20 | 6473 |
| BCL11A-4843 | + | GGAGAGAAGAAAGGGGUGGC | 20 | 6474 |
| BCL11A-4844 | + | GGAGAGAAGGGGAGGAGGGA | 20 | 6475 |
| BCL11A-4845 | + | GGAGAGAGAGAAGAGAGA | 20 | 6476 |
| BCL11A-4846 | + | GGAGAGCCGGGUUAGAAAGA | 20 | 6477 |
| BCL11A-4847 | + | GGAGGGGCGGGCCGAGGGGA | 20 | 6478 |
| BCL11A-4848 | + | GGAGGGGGAGGUGCGGG | 17 | 6479 |
| BCL11A-4849 | + | GGAGGGGGAGGUGCGGGGCG | 20 | 6480 |
| BCL11A-4850 | + | GGCAGGGCGAGCAGGAGAGA | 20 | 6481 |
| BCL11A-4851 | + | GGCAGGGGUGGGAGGAAAGG | 20 | 6482 |
| BCL11A-4852 | - | GGCCGCGUCUGGCGUCC | 17 | 6483 |
| BCL11A-4853 | + | GGCGAGCAGGAGAGAAG | 17 | 6484 |
| BCL11A-4854 | + | GGCGAGCAGGAGAGAAGGGG | 20 | 6485 |
| BCL11A-4855 | + | GGCGCAGGGAAGAUGAAUUG | 20 | 6486 |
| BCL11A-4856 | - | GGCGCUCGCUGCGGCCACUG | 20 | 6487 |
| BCL11A-4857 | + | GGCGGCGGCGGCGGCGG | 17 | 6488 |
| BCL11A-4858 | + | GGCGGCGGCGGCGGCGGCGG | 20 | 6489 |
| BCL11A-4859 | + | GGCGGUGGCGUGGCCGG | 17 | 6490 |
| BCL11A-4860 | + | GGCGUGGCCGGGAGAGAAGA | 20 | 6491 |
| BCL11A-4861 | + | GGGAAGAUGAAUUGUGG | 17 | 6492 |
| BCL11A-4862 | + | GGGAGAGAAGAAAGGGGUGG | 20 | 6493 |
| BCL11A-4863 | + | GGGAGAGCCGGGUUAGA | 17 | 6494 |
| BCL11A-4864 | + | GGGAGAGCCGGGUUAGAAAG | 20 | 6495 |
| BCL11A-4865 | + | GGGAGGAAAGGGUGGGG | 17 | 6496 |
| BCL11A-4866 | + | GGGAGGGGCGGGCCGAG | 17 | 6497 |
| BCL11A-4867 | + | GGGAGGGGCGGGCCGAGGGG | 20 | 6498 |
| BCL11A-4868 | + | GGGAGGGGGAGGUGCGGGGC | 20 | 6499 |
| BCL11A-4869 | + | GGGCAGGGCGAGCAGGA | 17 | 6500 |
| BCL11A-4870 | + | GGGCAGGGCGAGCAGGAGAG | 20 | 6501 |
| BCL11A-4871 | + | GGGCCGAGGGGAGGGGCGC | 20 | 6502 |
| BCL11A-4872 | + | GGGCGAGCAGGAGAGAA | 17 | 6503 |
| BCL11A-4873 | + | GGGCGAGCAGGAGAGAAGGG | 20 | 6504 |
| BCL11A-4874 | + | GGGGAGGGGCGGGCCGA | 17 | 6505 |
| BCL11A-4875 | + | GGGGAGGGGCGGGCCGAGGG | 20 | 6506 |
| BCL11A-4876 | + | GGGGAGGGGGAGGUGCGGGG | 20 | 6507 |
| BCL11A-4877 | + | GGGGAGGGGGCGCUGGGGCC | 20 | 6508 |
| BCL11A-4878 | - | GGGGCCGCGUCUGGCGUCCG | 20 | 6509 |
| BCL11A-4879 | + | GGGGCGGGCCGAGGGGA | 17 | 6510 |
| BCL11A-4880 | + | GGGGGAGGGGCGGGCCG | 17 | 6511 |
| BCL11A-4881 | + | GGGGGAGGUGCGGGGCG | 17 | 6512 |
| BCL11A-4882 | - | GGGGGCCGCGUCUGGCGUCC | 20 | 6513 |
| BCL11A-4883 | + | GGGGUGGCAGGGGUGGG | 17 | 6514 |
| BCL11A-4884 | + | GGGGUGGGAGGAAAGGG | 17 | 6515 |
| BCL11A-4885 | + | GGGGUGGGAGGAAAGGGUGG | 20 | 6516 |
| BCL11A-4886 | + | GGGUGGCAGGGGUGGGAGGA | 20 | 6517 |
| BCL11A-4887 | + | GGGUGGGAGGAAAGGGU | 17 | 6518 |
| BCL11A-4888 | + | GGGUGGGAGGAAAGGGUGGG | 20 | 6519 |
| BCL11A-4889 | - | GGUAAAAGAGAUAAAGG | 17 | 6520 |
| BCL11A-4890 | + | GGUGCGGGCGGGGGCUCC | 20 | 6521 |
| BCL11A-4891 | + | GGUGGGAGGAAAGGGUG | 17 | 6522 |
| BCL11A-4892 | + | GGUGGGAGGAAAGGGUGGGG | 20 | 6523 |
| BCL11A-4893 | + | GGUUAGAAAGAAGGAGACUC | 20 | 6524 |
| BCL11A-4894 | + | GGUUUGCCUUGCUUGCG | 17 | 6525 |
| BCL11A-4895 | - | GUCGAGGUAAAAGAGAUAAA | 20 | 6526 |
| BCL11A-4896 | + | GUGGCCGGGAGAGAAGA | 17 | 6527 |
| BCL11A-4897 | + | GUGGGAGGAAAGGGUGG | 17 | 6528 |

Table 11D provides exemplary targeting domains for knocking down expression of the BCL11A gene according to forth tier parameters. The targeting domains bind between 500 bp upstream and 500 bp downstream of transcription start site and do not start with G. It is contemplated herein that the targeting domain hybridizes to the target domain through complementary base pairing. Any of the targeting domains in the table can be used with a S. aureus eiCas9 molecule to cause a steric block at the target region, e.g., between 500 bp upstream and 500 bp downstream of transcription start site to block transcription resulting in the repression of the BCL11A gene. Alternatively, any of the targeting domains in the table can be used with a S. aureus eiCas9 fused to a transcriptional repressor to decrease transcription and therefore downregulate gene expression.

TABLE 11D

4th Tier

| gRNA Name | DNA Strand | Targeting Domain | Target Site Length | SEQ ID NO |
|---|---|---|---|---|
| BCL11A-4898 | + | AAAAAAAAAAAAAAAAA | 17 | 6529 |
| BCL11A-4899 | + | AAAAAAAAAAAAAAAAAAAA | 20 | 6530 |

TABLE 11D-continued

4th Tier

| gRNA Name | DNA Strand | Targeting Domain | Target Site Length | SEQ ID NO |
|---|---|---|---|---|
| BCL11A-4900 | + | AAAAAAAAAAAAAAAAAAAG | 20 | 6531 |
| BCL11A-4901 | + | AAAAAAAAAAAAAAAAAAGA | 20 | 6532 |
| BCL11A-4902 | + | AAAAAAAAAAAAAAAAG | 17 | 6533 |
| BCL11A-4903 | + | AAAAAAAAAAAAAAAGAGG | 20 | 6534 |
| BCL11A-4904 | + | AAAAAAAAAAAAAAGA | 17 | 6535 |
| BCL11A-4905 | + | AAAAAAAAAAAAGAGGGA | 20 | 6536 |
| BCL11A-4906 | + | AAAAAAAAAAAGAGG | 17 | 6537 |
| BCL11A-4907 | + | AAAAAAAAAAGAGGGAGA | 20 | 6538 |
| BCL11A-4908 | + | AAAAAAAAAAGAGGGA | 17 | 6539 |
| BCL11A-4909 | + | AAAAAAAAAGAGGGAGAGA | 20 | 6540 |
| BCL11A-4910 | + | AAAAAAAAGAGGGAGA | 17 | 6541 |
| BCL11A-4911 | + | AAAAAAAGAGGGAGAGAGA | 20 | 6542 |
| BCL11A-4912 | + | AAAAAAGAGGGAGAGA | 17 | 6543 |
| BCL11A-4913 | + | AAAAAUGGCAAAAGCCCCC | 20 | 6544 |
| BCL11A-4914 | − | AAAAACCCUCAUCCCAU | 17 | 6545 |
| BCL11A-4915 | + | AAAAAGAGGGAGAGAGA | 17 | 6546 |
| BCL11A-4916 | + | AAAAAGAGGGAGAGAGAGAG | 20 | 6547 |
| BCL11A-4917 | + | AAAACAUGGGCAGGGCGAGC | 20 | 6548 |
| BCL11A-4918 | − | AAAACCCUCAUCCCAUC | 17 | 6549 |
| BCL11A-4919 | − | AAAAGCGAGGGGGAGAG | 17 | 6550 |
| BCL11A-4920 | − | AAACCCCAGCACUUAAGCAA | 20 | 6551 |
| BCL11A-4921 | + | AAAGAGGGAGAGAGAGAGAA | 20 | 6552 |
| BCL11A-4922 | + | AAAGGGGUGGCAGGGGU | 17 | 6553 |
| BCL11A-4923 | + | AAAGGGGUGGCAGGGUGGG | 20 | 6554 |
| BCL11A-4924 | + | AAAUAAUACAAAGAUGGCGC | 20 | 6555 |
| BCL11A-4925 | + | AAAUGGCAAAAGCCCCC | 17 | 6556 |
| BCL11A-4926 | + | AACAUGGGCAGGGCGAG | 17 | 6557 |
| BCL11A-4927 | + | AACAUGGGCAGGGCGAGCAG | 20 | 6558 |
| BCL11A-4928 | − | AACCCCAGCACUUAAGCAAA | 20 | 6559 |
| BCL11A-4929 | − | AACCCGGCUCUCCCGAU | 17 | 6560 |
| BCL11A-4930 | + | AAGAAAGGGUGGCAGGGGU | 20 | 6561 |
| BCL11A-4931 | + | AAGAGAGAUAGAGGGAGAGA | 20 | 6562 |
| BCL11A-4932 | + | AAGAGGGAGAGAGAG | 17 | 6563 |
| BCL11A-4933 | + | AAGAUGGCGCAGGGAAG | 17 | 6564 |
| BCL11A-4934 | − | AAGCAAAGCGAGGGGAGA | 20 | 6565 |
| BCL11A-4935 | + | AAGCCAUGGCCAGUGC | 17 | 6566 |
| BCL11A-4936 | + | AAGCCAUGGCCAGUGCGGG | 20 | 6567 |
| BCL11A-4937 | − | AAUAAUAAUUAUUAAUAAUC | 20 | 6568 |
| BCL11A-4938 | + | AAUAAUACAAAGAUGGCGCA | 20 | 6569 |
| BCL11A-4939 | − | AAUAAUUAUUAAUAAUC | 17 | 6570 |
| BCL11A-4940 | + | AAUAAUUAUUAUUACUAUUA | 20 | 6571 |
| BCL11A-4941 | + | AAUACAAAGAUGGCGCA | 17 | 6572 |
| BCL11A-4942 | + | AAUGGCCAGUGCGGGA | 17 | 6573 |
| BCL11A-4943 | + | AAUUAUUAUUACUAUUA | 17 | 6574 |
| BCL11A-4944 | + | AAUUCCCGUUUGCUUAAGUG | 20 | 6575 |
| BCL11A-4945 | + | ACAAAGAUGGCGCAGGGAAG | 20 | 6576 |
| BCL11A-4946 | + | ACAAGCCAUGGCCAGU | 17 | 6577 |
| BCL11A-4947 | + | ACAAGCCAUGGCCAGUGCG | 20 | 6578 |
| BCL11A-4948 | + | ACACACAAAACAUGGGCAGG | 20 | 6579 |
| BCL11A-4949 | + | ACACACAUCAGGGGCUGGAC | 20 | 6580 |
| BCL11A-4950 | + | ACAGAGACACACAAAAC | 17 | 6581 |
| BCL11A-4951 | + | ACAUGGGCAGGGCGAGC | 17 | 6582 |
| BCL11A-4952 | + | ACAUGGUGGGCUGCGGG | 17 | 6583 |
| BCL11A-4953 | + | ACCAAUGGACACACAUC | 17 | 6584 |
| BCL11A-4954 | − | ACCCCAGCACUUAAGCAAAC | 20 | 6585 |
| BCL11A-4955 | − | ACCUCCGAGAUCGAGGUAA | 20 | 6586 |
| BCL11A-4956 | − | ACGAGAAAAACCUCCGAGAG | 20 | 6587 |
| BCL11A-4957 | + | ACGCCAGACGCGGCCCC | 17 | 6588 |
| BCL11A-4958 | + | ACGCCAGACGCGGCCCCGG | 20 | 6589 |
| BCL11A-4959 | + | ACGCGGCCCCGGGGAGGG | 20 | 6590 |
| BCL11A-4960 | + | ACGGCAAUGGUUCCAGA | 17 | 6591 |
| BCL11A-4961 | + | ACGUCAGGAGUCUGGAUGGA | 20 | 6592 |
| BCL11A-4962 | − | ACUAGAAGCAAAAGCGA | 17 | 6593 |
| BCL11A-4963 | + | ACUAUUAUUGGGUUACUUAC | 20 | 6594 |
| BCL11A-4964 | − | ACUCCUGACGUUCAAGUUCG | 20 | 6595 |
| BCL11A-4965 | − | ACUGAUGAAGAUAUUUCUC | 20 | 6596 |
| BCL11A-4966 | + | ACUUGAACGUCAGGAGU | 17 | 6597 |
| BCL11A-4967 | − | ACUUGAACUUGCAGCUC | 17 | 6598 |
| BCL11A-4968 | − | AGAAAACCUCCGAGAG | 17 | 6599 |
| BCL11A-4969 | + | AGAAAGGGUGGCAGGG | 17 | 6600 |
| BCL11A-4970 | + | AGAAGAAAGGGUGGCAGGG | 20 | 6601 |
| BCL11A-4971 | + | AGAAGAGAGAUAGAGGGAGA | 20 | 6602 |
| BCL11A-4972 | − | AGAAGCAAAAGCGAGGGGA | 20 | 6603 |
| BCL11A-4973 | + | AGAAGGGGAGGAGGGAA | 17 | 6604 |

TABLE 11D-continued

4th Tier

| gRNA Name | DNA Strand | Targeting Domain | Target Site Length | SEQ ID NO |
|---|---|---|---|---|
| BCL11A-4974 | + | AGACGCGGCCCCCGGGG | 17 | 6605 |
| BCL11A-4975 | + | AGAGAAGAAAGGGUGG | 17 | 6606 |
| BCL11A-4976 | + | AGAGAAGAGAGAUAGAGGGA | 20 | 6607 |
| BCL11A-4977 | + | AGAGAAGGGGAGGAGGG | 17 | 6608 |
| BCL11A-4978 | + | AGAGAAGGGGAGGAGGGAAG | 20 | 6609 |
| BCL11A-4979 | + | AGAGACACACAAAACAUGGG | 20 | 6610 |
| BCL11A-4980 | + | AGAGAGAAGAGAGAUAG | 17 | 6611 |
| BCL11A-4981 | + | AGAGAGAAGAGAGAUAGAGG | 20 | 6612 |
| BCL11A-4982 | + | AGAGAGAGAAGAGAGAUAGA | 20 | 6613 |
| BCL11A-4983 | + | AGAGAGAGAGAAGAGAGAUA | 20 | 6614 |
| BCL11A-4984 | + | AGAGAGAUAGAGGGAGA | 17 | 6615 |
| BCL11A-4985 | + | AGAGAUAGAGGGAGAGA | 17 | 6616 |
| BCL11A-4986 | + | AGAGCCGGGUUAGAAAG | 17 | 6617 |
| BCL11A-4987 | + | AGAGGGAGAGAGAGAGA | 17 | 6618 |
| BCL11A-4988 | − | AGAGUCCGCGUGUGUGG | 17 | 6619 |
| BCL11A-4989 | + | AGAUAGAGGGAGAGAGA | 17 | 6620 |
| BCL11A-4990 | − | AGCAAAAGCGAGGGGGA | 17 | 6621 |
| BCL11A-4991 | − | AGCAAAAGCGAGGGGGAGAG | 20 | 6622 |
| BCL11A-4992 | + | AGCAGGAGAGAAGGGGAGGA | 20 | 6623 |
| BCL11A-4993 | + | AGCCAAUGGCCAGUGCG | 17 | 6624 |
| BCL11A-4994 | + | AGCCAAUGGCCAGUGCGGGG | 20 | 6625 |
| BCL11A-4995 | + | AGGACAAGCCAAUGGCCAGU | 20 | 6626 |
| BCL11A-4996 | − | AGGACUAGAAGCAAAAGCGA | 20 | 6627 |
| BCL11A-4997 | + | AGGAGAAGGGGAGGA | 17 | 6628 |
| BCL11A-4998 | + | AGGAGAGAAGGGGAGGAGGG | 20 | 6629 |
| BCL11A-4999 | + | AGGGAGAGAGAGAGAGAGAG | 20 | 6630 |
| BCL11A-5000 | + | AGGGCGAGCAGGAGAGA | 17 | 6631 |
| BCL11A-5001 | + | AGGGGAAGCUCACACCA | 17 | 6632 |
| BCL11A-5002 | + | AGGGGCGGGCCGAGGGG | 17 | 6633 |
| BCL11A-5003 | + | AGGGGCUGGACAUGAAA | 17 | 6634 |
| BCL11A-5004 | + | AGGGGGAGGUGCGGGGC | 17 | 6635 |
| BCL11A-5005 | + | AGGGGUGGCAGGGGUGG | 17 | 6636 |
| BCL11A-5006 | + | AGGGGUGGGAGGAAAGG | 17 | 6637 |
| BCL11A-5007 | + | AGGGGUGGGAGGAAAGGGUG | 20 | 6638 |
| BCL11A-5008 | − | AGGUAAAAGAGAUAAAG | 17 | 6639 |
| BCL11A-5009 | − | AGUCCGCGUGUGUGGGG | 17 | 6640 |
| BCL11A-5010 | − | AGUCGAGGUAAAAGAGAUAA | 20 | 6641 |
| BCL11A-5011 | + | AGUGCGGGGAGGGGGAGGUG | 20 | 6642 |
| BCL11A-5012 | + | AUAAUACAAAGAUGGCG | 17 | 6643 |
| BCL11A-5013 | − | AUAAUCACGAGAGCGCG | 17 | 6644 |
| BCL11A-5014 | + | AUACACGGCAAUGGUUCCAG | 20 | 6645 |
| BCL11A-5015 | + | AUAGAGGGAGAGAGAGA | 17 | 6646 |
| BCL11A-5016 | + | AUCAGGGGCUGGACAUGAAA | 20 | 6647 |
| BCL11A-5017 | + | AUCGGGAGAGCCGGGUUAGA | 20 | 6648 |
| BCL11A-5018 | + | AUCUCUUUUACCUCGACUCU | 20 | 6649 |
| BCL11A-5019 | + | AUGGCCAGUGCGGGGAG | 17 | 6650 |
| BCL11A-5020 | + | AUGGGCAGGGCGAGCAG | 17 | 6651 |
| BCL11A-5021 | + | AUGGUUCCAGAUGGGAU | 17 | 6652 |
| BCL11A-5022 | + | AUUAUUGGGUUACUUAC | 17 | 6653 |
| BCL11A-5023 | − | AUUAUUUCUAAUUUAUU | 17 | 6654 |
| BCL11A-5024 | + | AUUCCCGUUUGCUUAAGUGC | 20 | 6655 |
| BCL11A-5025 | − | AUUUUAGAGUCCGCGUGUGU | 20 | 6656 |
| BCL11A-5026 | − | AUUUUAAAAUUUUUCAC | 17 | 6657 |
| BCL11A-5027 | − | AUUUUUCACGAGAAAAACCU | 20 | 6658 |
| BCL11A-5028 | + | CAAAACAUGGGCAGGGCGAG | 20 | 6659 |
| BCL11A-5029 | − | CAAAAGCGAGGGGGAGA | 17 | 6660 |
| BCL11A-5030 | + | CAAGCCAAUGGCCAGUG | 17 | 6661 |
| BCL11A-5031 | + | CAAUGGACACACAUCAGGGG | 20 | 6662 |
| BCL11A-5032 | + | CAAUGGCCAGUGCGGGG | 17 | 6663 |
| BCL11A-5033 | + | CAAUGGCCAGUGCGGGGAGG | 20 | 6664 |
| BCL11A-5034 | + | CAAUGGUUCCAGAUGGG | 17 | 6665 |
| BCL11A-5035 | + | CACAAAACAUGGGCAGG | 17 | 6666 |
| BCL11A-5036 | + | CACACCAAUGGACACACAUC | 20 | 6667 |
| BCL11A-5037 | + | CACACGCGGACUCUAAA | 17 | 6668 |
| BCL11A-5038 | + | CACAUCAGGGGCUGGAC | 17 | 6669 |
| BCL11A-5039 | + | CACCAAUGGACACACAU | 17 | 6670 |
| BCL11A-5040 | + | CACGGCAAUGGUUCCAG | 17 | 6671 |
| BCL11A-5041 | − | CACUGAUGAAGAUAUUUUCU | 20 | 6672 |
| BCL11A-5042 | − | CACUUGAACUUGCAGCU | 17 | 6673 |
| BCL11A-5043 | − | CACUUGAACUUGCAGCUCAG | 20 | 6674 |
| BCL11A-5044 | − | CAGGACUAGAAGCAAAA | 17 | 6675 |
| BCL11A-5045 | − | CAGGACUAGAAGCAAAAGCG | 20 | 6676 |
| BCL11A-5046 | + | CAGGAGAGAAGGGGAGG | 17 | 6677 |
| BCL11A-5047 | + | CAGGGAAGAUGAAUUGU | 17 | 6678 |

TABLE 11D-continued

4th Tier

| gRNA Name | DNA Strand | Targeting Domain | Target Site Length | SEQ ID NO |
|---|---|---|---|---|
| BCL11A-5048 | + | CAGGGCGAGCAGGAGAG | 17 | 6679 |
| BCL11A-5049 | + | CAGGGCGAGCAGGAGAAG | 20 | 6680 |
| BCL11A-5050 | + | CAGGGGUGGGAGGAAAGGGU | 20 | 6681 |
| BCL11A-5051 | + | CAGUGCGGGGAGGGGGAGGU | 20 | 6682 |
| BCL11A-5052 | − | CAUGCAUUUUAAAUUUUUC | 20 | 6683 |
| BCL11A-5053 | + | CAUGGGCAGGGCGAGCAGGA | 20 | 6684 |
| BCL11A-5054 | − | CAUUUUAGAGUCCGCGUGUG | 20 | 6685 |
| BCL11A-5055 | + | CCAAUGGCCAGUGCGGG | 17 | 6686 |
| BCL11A-5056 | + | CCAAUGGCCAGUGCGGGGAG | 20 | 6687 |
| BCL11A-5057 | + | CCACACACGCGGACUCUAAA | 20 | 6688 |
| BCL11A-5058 | + | CCAGACGCGGCCCCCGG | 17 | 6689 |
| BCL11A-5059 | + | CCAGACGCGGCCCCCGGGG | 20 | 6690 |
| BCL11A-5060 | − | CCAGCACUUAAGCAAAC | 17 | 6691 |
| BCL11A-5061 | − | CCAUUGCCGUGUAUGCACUU | 20 | 6692 |
| BCL11A-5062 | − | CCCAGCACUUAAGCAAA | 17 | 6693 |
| BCL11A-5063 | − | CCCCAGCACUUAAGCAA | 17 | 6694 |
| BCL11A-5064 | + | CCCCGGGGAGGGGCGGCC | 20 | 6695 |
| BCL11A-5065 | − | CCCCUCGGCCCGCCCCUCCC | 20 | 6696 |
| BCL11A-5066 | + | CCCGGGGAGGGGCGGG | 17 | 6697 |
| BCL11A-5067 | + | CCCGGGGAGGGGCGGGCCG | 20 | 6698 |
| BCL11A-5068 | + | CCCGUUUGCUUAAGUGC | 17 | 6699 |
| BCL11A-5069 | − | CCCUCGGCCCGCCCCUCCCC | 20 | 6700 |
| BCL11A-5070 | + | CCCUGCUCCCCCCCACACAC | 20 | 6701 |
| BCL11A-5071 | + | CCGAGGGGAGGGGCGC | 17 | 6702 |
| BCL11A-5072 | − | CCGCACUUAACUUGCAGCU | 20 | 6703 |
| BCL11A-5073 | + | CCGCGGCGGUGGCGUGG | 17 | 6704 |
| BCL11A-5074 | + | CCGGGGAGGGGCGGGCCGA | 20 | 6705 |
| BCL11A-5075 | − | CCUCGGCCCGCCCCUCCCCC | 20 | 6706 |
| BCL11A-5076 | − | CCUGACGUUCAAGUUCG | 17 | 6707 |
| BCL11A-5077 | + | CCUGAGCUGCAAGUUCAAGU | 20 | 6708 |
| BCL11A-5078 | − | CCUGAUGUGUGUCCAUUGGU | 20 | 6709 |
| BCL11A-5079 | + | CGAACUUGAACGUCAGGAGU | 20 | 6710 |
| BCL11A-5080 | + | CGAGACAUGGUGGGCUG | 17 | 6711 |
| BCL11A-5081 | + | CGAGCAGGAGAGAAGGG | 17 | 6712 |
| BCL11A-5082 | + | CGAGCAGGAGAGAAGGGGAG | 20 | 6713 |
| BCL11A-5083 | − | CGAGGUAAAAGAGAUAA | 17 | 6714 |
| BCL11A-5084 | − | CGAGGUAAAAGAGAUAAAGG | 20 | 6715 |
| BCL11A-5085 | − | CGCACUUGAACUUGCAGCUC | 20 | 6716 |
| BCL11A-5086 | + | CGCAGGGAAGAUGAAUU | 17 | 6717 |
| BCL11A-5087 | + | CGCCAGACGCGGCCCCC | 17 | 6718 |
| BCL11A-5088 | + | CGCCGCGGCGGUGGCGUGGC | 20 | 6719 |
| BCL11A-5089 | + | CGCGGCGGUGGCGUGGC | 17 | 6720 |
| BCL11A-5090 | + | CGCGGCGGUGGCGUGGCCGG | 20 | 6721 |
| BCL11A-5091 | + | CGGACGCCAGACGCGGCCCC | 20 | 6722 |
| BCL11A-5092 | + | CGGCAAUGGUUCCAGAUGGG | 20 | 6723 |
| BCL11A-5093 | + | CGGCCCCGGGGAGGG | 17 | 6724 |
| BCL11A-5094 | − | CGGCCCGCCCCUCCCCC | 17 | 6725 |
| BCL11A-5095 | + | CGGCGAGACAUGGUGGGCUG | 20 | 6726 |
| BCL11A-5096 | + | CGGCGGCGGCGGCGGCG | 17 | 6727 |
| BCL11A-5097 | + | CGGCGGCGGCGGCGGCGCG | 20 | 6728 |
| BCL11A-5098 | + | CGGCGGUGGCGUGGCCGGGA | 20 | 6729 |
| BCL11A-5099 | + | CGGGCCGAGGGGAGGGGCG | 20 | 6730 |
| BCL11A-5100 | + | CGGGCUCACCAGUGGCCGCA | 20 | 6731 |
| BCL11A-5101 | + | CGGGGAGGGGAGGUGCGGG | 20 | 6732 |
| BCL11A-5102 | + | CGGGGGAGGGGCGGGCC | 17 | 6733 |
| BCL11A-5103 | + | CGGGGGAGGGGCGGGCCGAG | 20 | 6734 |
| BCL11A-5104 | + | CGGUGGCGUGGCCGGGA | 17 | 6735 |
| BCL11A-5105 | + | CGGUGGCGUGGCCGGGAGAG | 20 | 6736 |
| BCL11A-5106 | − | CUAGAAGCAAAAGCGAG | 17 | 6737 |
| BCL11A-5107 | − | CUAGAAGCAAAAGCGAGGGG | 20 | 6738 |
| BCL11A-5108 | − | CUCCUGACGUUCAAGUUCGC | 20 | 6739 |
| BCL11A-5109 | − | CUCGGCCCGCCCCUCCC | 17 | 6740 |
| BCL11A-5110 | + | CUCUUUUACCUCGACUC | 17 | 6741 |
| BCL11A-5111 | − | CUGACGUUCAAGUUCGC | 17 | 6742 |
| BCL11A-5112 | + | CUUGAACGUCAGGAGUCUGG | 20 | 6743 |
| BCL11A-5113 | − | CUUGAACUUGCAGCUCA | 17 | 6744 |
| BCL11A-5114 | + | CUUGCUUGCGGCGAGACAUG | 20 | 6745 |
| BCL11A-5115 | − | UAAUAAUUAUUAAUAAUCAC | 20 | 6746 |
| BCL11A-5116 | + | UAAUACAAAGAUGGCGC | 17 | 6747 |
| BCL11A-5117 | − | UAAUUAUUAAUAAUCAC | 17 | 6748 |
| BCL11A-5118 | + | UACACGGCAAUGGUUCCAGA | 20 | 6749 |
| BCL11A-5119 | + | UAGAAGAAGGAGACUC | 17 | 6750 |
| BCL11A-5120 | − | UAGAAGCAAAAGCGAGG | 17 | 6751 |
| BCL11A-5121 | − | UAGAGUCCGCGUGUGUG | 17 | 6752 |

TABLE 11D-continued

4th Tier

| gRNA Name | DNA Strand | Targeting Domain | Target Site Length | SEQ ID NO |
|---|---|---|---|---|
| BCL11A-5122 | - | UAGAGUCCGCGUGUGUGGGG | 20 | 6753 |
| BCL11A-5123 | + | UAUCUCUUUUACCUCGACUC | 20 | 6754 |
| BCL11A-5124 | + | UAUUAUUGGGUUACUUACGC | 20 | 6755 |
| BCL11A-5125 | + | UAUUGGGUUACUUACGC | 17 | 6756 |
| BCL11A-5126 | + | UCACACCAAUGGACACACAU | 20 | 6757 |
| BCL11A-5127 | - | UCACGAGAAAAACCUCC | 17 | 6758 |
| BCL11A-5128 | + | UCAGGAGUCUGGAUGGA | 17 | 6759 |
| BCL11A-5129 | - | UCAUUUUAGAGUCCGCGUGU | 20 | 6760 |
| BCL11A-5130 | + | UCCCGUUUGCUUAAGUG | 17 | 6761 |
| BCL11A-5131 | - | UCCGAGAGUCGAGGUAA | 17 | 6762 |
| BCL11A-5132 | - | UCCGCGUGUGUGGGGGGGAG | 20 | 6763 |
| BCL11A-5133 | - | UCGAGGUAAAAGAGAUA | 17 | 6764 |
| BCL11A-5134 | - | UCGAGGUAAAAGAGAUAAAG | 20 | 6765 |
| BCL11A-5135 | - | UCGGCCCGCCCCUCCCC | 17 | 6766 |
| BCL11A-5136 | - | UCUAACCCGGCUCUCCCGAU | 20 | 6767 |
| BCL11A-5137 | + | UCUCGGAGGUUUUUCUC | 17 | 6768 |
| BCL11A-5138 | + | UCUUUUACCUCGACUCU | 17 | 6769 |
| BCL11A-5139 | + | UGACAUCCAAAAUAAAU | 17 | 6770 |
| BCL11A-5140 | - | UGAUGAAGAUAUUUUCU | 17 | 6771 |
| BCL11A-5141 | - | UGCAUUUUAAAUUUUUCAC | 20 | 6772 |
| BCL11A-5142 | + | UGCGGGGAGGGGGAGGU | 17 | 6773 |
| BCL11A-5143 | + | UGCUCCCCCCCACACAC | 17 | 6774 |
| BCL11A-5144 | + | UGGACACACAUCAGGGG | 17 | 6775 |
| BCL11A-5145 | + | UGGACAGAGACACACAAAAC | 20 | 6776 |
| BCL11A-5146 | + | UGGCAGGGGUGGGAGGA | 17 | 6777 |
| BCL11A-5147 | + | UGGCCAGUGCGGGGAGG | 17 | 6778 |
| BCL11A-5148 | + | UGGCCGGGAGAGAAGAA | 17 | 6779 |
| BCL11A-5149 | + | UGGCGCAGGGAAGAUGAAUU | 20 | 6780 |
| BCL11A-5150 | + | UGGCGUGGCCGGGAGAG | 17 | 6781 |
| BCL11A-5151 | + | UGGGAGGAAAGGGUGGG | 17 | 6782 |
| BCL11A-5152 | + | UGGGGUUUGCCUUGCUUGCG | 20 | 6783 |
| BCL11A-5153 | - | UGUAUUAUUUCUAAUUUAUU | 20 | 6784 |
| BCL11A-5154 | - | UUAAUAAUCACGAGAGCGCG | 20 | 6785 |
| BCL11A-5155 | + | UUAGAAAGAAGGAGACUCCA | 20 | 6786 |
| BCL11A-5156 | - | UUAGAGUCCGCGUGUGU | 17 | 6787 |
| BCL11A-5157 | - | UUAGAGUCCGCGUGUGUGGG | 20 | 6788 |
| BCL11A-5158 | - | UUGAACUUGCAGCUCAG | 17 | 6789 |
| BCL11A-5159 | - | UUGCCGUGUAUGCACUU | 17 | 6790 |
| BCL11A-5160 | - | UUGGAUGUCAAAAGGCACUG | 20 | 6791 |
| BCL11A-5161 | - | UUUAGAGUCCGCGUGUG | 17 | 6792 |
| BCL11A-5162 | - | UUUAGAGUCCGCGUGUGUGG | 20 | 6793 |
| BCL11A-5163 | - | UUUCACGAGAAAAACCU | 17 | 6794 |
| BCL11A-5164 | - | UUUUAGAGUCCGCGUGU | 17 | 6795 |
| BCL11A-5165 | - | UUUUAGAGUCCGCGUGUGUG | 20 | 6796 |
| BCL11A-5166 | - | UUUUCACGAGAAAAACCUCC | 20 | 6797 |
| BCL11A-5167 | + | UUUUGACAUCCAAAAUAAAU | 20 | 6798 |

Table 12 provides exemplary targeting domains for knocking down expression of the BCL11A gene. The targeting domains bind between 500 bp upstream and 500 bp downstream of transcription start site. It is contemplated herein that the targeting domain hybridizes to the target domain through complementary base pairing. Any of the targeting domains in the table can be used with a N. meningitidis meningitidis eiCas9 molecule to cause a steric block at the target region, e.g., between 500 bp upstream and 500 bp downstream of transcription start site to block transcription resulting in the repression of the BCL11A gene. Alternatively, any of the targeting domains in the table can be used with a N. meningitidis meningitidis eiCas9 fused to a transcriptional repressor to decrease transcription and therefore downregulate gene expression.

TABLE 12

| gRNA Name | DNA Strand | Targeting Domain | Target Site Length | SEQ ID NO |
|---|---|---|---|---|
| BCL11A-5168 | + | GCUUCUAGUCCUGCGCGCUC | 20 | 6799 |
| BCL11A-5169 | + | ACACACGCGGACUCUAAAAU | 20 | 6800 |
| BCL11A-5170 | + | UCUAGUCCUGCGCGCUC | 17 | 6801 |
| BCL11A-5171 | + | CACGCGGACUCUAAAAU | 17 | 6802 |

Table 13A provides exemplary targeting domains for the E6V target site in the HBB gene selected according to the first tier parameters. The targeting domains bind within 100 bp upstream and 100 bp downstream of the target position, good orthogonality and start with G. It is contemplated herein that the targeting domain hybridizes to the target domain through complementary base pairing. Any of the targeting domains in the table can be used with a S. pyogenes Cas9 molecule that generates a double strand break (Cas9 nuclease) or a single-strand break (Cas9 nickase).

Any of the targeting domains in the table can be used with a S. pyogenes Cas9 (nickase) molecule to generate a single strand break. In an embodiment, dual targeting is used to create two nicks on opposite DNA strands by using S. pyogenes Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. Exemplary gRNA pairs are: HBB-9 and HBB-11, HBB-9 and HBB-39, HBB-20 and HBB-11 and HBB-20 and HBB-39.

TABLE 13A

1st Tier

| gRNA Name | DNA Strand | Targeting Domain | Target Site Length | SEQ ID NO |
|---|---|---|---|---|
| HBB-1 | − | GGUGCACCUGACUCCUG | 17 | 6803 |
| HBB-2 | + | GUAACGGCAGACUUCUCCAC | 20 | 6804 |

Table 13B provides exemplary targeting domains for the E6V target site in the HBB gene selected according to the second tier parameters. The targeting domains bind within 100 bp upstream and 100 bp downstream of the target position, good orthogonality and do not start with G. It is contemplated herein that the targeting domain hybridizes to the target domain through complementary base pairing. Any of the targeting domains in the table can be used with a *S. pyogenes* Cas9 molecule that generates a double strand break (Cas9 nuclease) or a single-strand break (Cas9 nickase).

Any of the targeting domains in the table can be used with a *S. pyogenes* Cas9 (nickase) molecule to generate a single strand break. In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 13B

2nd Tier

| gRNA Name | DNA Strand | Targeting Domain | Target Site Length | SEQ ID NO |
|---|---|---|---|---|
| HBB-3 | + | ACGGCAGACUUCUCCAC | 17 | 6805 |
| HBB-4 | + | ACUUCUCCACAGGAGUC | 17 | 6806 |
| HBB-5 | + | AGGAGUCAGGUGCACCA | 17 | 6807 |
| HBB-6 | − | CAUGGUGCACCUGACUCCUG | 20 | 6808 |
| HBB-7 | + | CACAGGAGUCAGGUGCACCA | 20 | 6809 |
| HBB-8 | + | CAGACUUCUCCACAGGAGUC | 20 | 6810 |

Table 13C provides exemplary targeting domains for the E6V target site in the HBB gene selected according to the third tier parameters. The targeting domains bind within 100 bp upstream and 100 bp downstream of the target position, and start with G. It is contemplated herein that the targeting domain hybridizes to the target domain through complementary base pairing. Any of the targeting domains in the table can be used with a *S. pyogenes* Cas9 molecule that generates a double strand break (Cas9 nuclease) or a single-strand break (Cas9 nickase).

Any of the targeting domains in the table can be used with a *S. pyogenes* Cas9 (nickase) molecule to generate a single strand break. In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 13C

3rd Tier

| gRNA Name | DNA Strand | Targeting Domain | Target Site Length | SEQ ID NO |
|---|---|---|---|---|
| HBB-9 | − | GAAGUUGGUGGUGAGGCCCU | 20 | 6811 |
| HBB-10 | − | GCAACCUCAAACAGACACCA | 20 | 6812 |
| HBB-11 | + | GCCCCACAGGGCAGUAA | 17 | 6813 |
| HBB-12 | − | GCCGUUACUGCCCUGUG | 17 | 6814 |
| HBB-13 | − | GGAUGAAGUUGGUGGUG | 17 | 6815 |
| HBB-14 | − | GUCUGCCGUUACUGCCCUGU | 20 | 6816 |
| HBB-15 | − | GUGAACGUGGAUGAAGU | 17 | 6817 |
| HBB-16 | − | GUGAACGUGGAUGAAGUUGG | 20 | 6818 |
| HBB-17 | − | GUGGGGCAAGGUGAACG | 17 | 6819 |
| HBB-18 | − | GUGGUGAGGCCCUGGGC | 17 | 6820 |
| HBB-19 | + | GUUCACCUUGCCCCACA | 17 | 6821 |
| HBB-20 | − | GUUGGUGGUGAGGCCCU | 17 | 6822 |

Table 13D provides exemplary targeting domains for the E6V target site in the HBB gene selected according to the fourth tier parameters. The targeting domains bind within 100 bp upstream and 100 bp downstream of the target position, and do not start with G. It is contemplated herein that the targeting domain hybridizes to the target domain through complementary base pairing. Any of the targeting domains in the table can be used with a *S. pyogenes* Cas9 molecule that generates a double strand break (Cas9 nuclease) or a single-strand break (Cas9 nickase).

Any of the targeting domains in the table can be used with a *S. pyogenes* Cas9 (nickase) molecule to generate a single strand break. In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 13D

4th Tier

| gRNA Name | DNA Strand | Targeting Domain | Target Site Length | SEQ ID NO |
|---|---|---|---|---|
| HBB-21 | - | AACGUGGAUGAAGUUGG | 17 | 6823 |
| HBB-22 | + | AAGCAAAUGUAAGCAAUAGA | 20 | 6824 |
| HBB-23 | - | AAGGUGAACGUGGAUGAAGU | 20 | 6825 |
| HBB-24 | + | ACCAUGGUGUCUGUUUG | 17 | 6826 |
| HBB-25 | - | ACCUCAAACAGACACCA | 17 | 6827 |
| HBB-26 | + | ACCUUGAUACCAACCUGCCC | 20 | 6828 |
| HBB-27 | - | AGUCUGCCGUUACUGCCCUG | 20 | 6829 |
| HBB-28 | - | AGUUGGUGGUGAGGCCC | 17 | 6830 |
| HBB-29 | + | CAAAUGUAAGCAAUAGA | 17 | 6831 |
| HBB-30 | + | CACGUUCACCUUGCCCCACA | 20 | 6832 |
| HBB-31 | + | CCACGUUCACCUUGCCCCAC | 20 | 6833 |
| HBB-32 | - | CCCUGGGCAGGUUGGUAUCA | 20 | 6834 |
| HBB-33 | - | CCUGUGGGGCAAGGUGAACG | 20 | 6835 |
| HBB-34 | + | CCUUGAUACCAACCUGCCCA | 20 | 6836 |
| HBB-35 | - | CGUGGAUGAAGUUGGUGGUG | 20 | 6837 |
| HBB-36 | - | CGUUACUGCCCUGUGGGGCA | 20 | 6838 |
| HBB-37 | + | CGUUCACCUUGCCCCAC | 17 | 6839 |
| HBB-38 | - | CUGCCGUUACUGCCCUG | 17 | 6840 |
| HBB-39 | + | CUUGCCCCACAGGGCAGUAA | 20 | 6841 |
| HBB-40 | - | UACUGCCCUGUGGGGCA | 17 | 6842 |
| HBB-41 | - | UAUCAAGGUUACAAGAC | 17 | 6843 |
| HBB-42 | - | UCUGCCGUUACUGCCCUGUG | 20 | 6844 |
| HBB-43 | - | UGAAGUUGGUGGUGAGGCCC | 20 | 6845 |
| HBB-44 | - | UGAGGCCCUGGGCAGGU | 17 | 6846 |
| HBB-45 | + | UGAUACCAACCUGCCCA | 17 | 6847 |
| HBB-46 | + | UGCACCAUGGUGUCUGUUUG | 20 | 6848 |
| HBB-47 | - | UGCCGUUACUGCCCUGU | 17 | 6849 |
| HBB-48 | - | UGGGCAGGUUGGUAUCA | 17 | 6850 |
| HBB-49 | - | UGGUAUCAAGGUUACAAGAC | 20 | 6851 |
| HBB-50 | - | UGGUGAGGCCCUGGGCAGGU | 20 | 6852 |
| HBB-51 | + | UUGAUACCAACCUGCCC | 17 | 6853 |
| HBB-52 | - | UUGGUGGUGAGGCCCUGGGC | 20 | 6854 |

Table 14A provides exemplary targeting domains for the E6V target site in the HBB gene selected according to the first tier parameters. The targeting domains bind within 100 bp upstream and 100 bp downstream of the target position, good orthogonality and start with G. It is contemplated herein that the targeting domain hybridizes to the target domain through complementary base pairing. Any of the targeting domains in the table can be used with a S. aureus Cas9 molecule that generates a double strand break (Cas9 nuclease) or a single-strand break (Cas9 nickase).

Any of the targeting domains in the table can be used with a S. aureus Cas9 (nickase) molecule to generate a single strand break. In an embodiment, dual targeting is used to create two nicks on opposite DNA strands by using S. aureus Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. Exemplary gRNA pairs are: HBB-9 and HBB-11, HBB-9 and HBB-39, HBB-20 and HBB-11 and HBB-20 and HBB-39.

TABLE 14A

1st Tier

| gRNA Name | DNA Strand | Targeting Domain | Target Site Length | SEQ ID NO |
|---|---|---|---|---|
| HBB-53 | + | GUAACGGCAGACUUCUCCAC | 20 | 6855 |

Table 14B provides exemplary targeting domains for the E6V target site in the HBB gene selected according to the second tier parameters. The targeting domains bind within 100 bp upstream and 100 bp downstream of the target position, good orthogonality and do not start with G. It is contemplated herein that the targeting domain hybridizes to the target domain through complementary base pairing. Any of the targeting domains in the table can be used with a S. aureus Cas9 molecule that generates a double strand break (Cas9 nuclease) or a single-strand break (Cas9 nickase).

Any of the targeting domains in the table can be used with a S. aureus Cas9 (nickase) molecule to generate a single strand break. In an embodiment, dual targeting is used to create two nicks on opposite DNA strands by using S. aureus Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 14B

2nd Tier

| gRNA Name | DNA Strand | Targeting Domain | Target Site Length | SEQ ID NO |
|---|---|---|---|---|
| HBB-54 | - | CCCUGUGGGGCAAGGUGGAC | 20 | 6856 |

Table 14C provides exemplary targeting domains for the E6V target site in the HBB gene selected according to the fifth tier parameters. The targeting domains bind within 100 bp upstream and 100 bp downstream of the target position and PAM is NNGRRV. It is contemplated herein that the targeting domain hybridizes to the target domain through complementary base pairing. Any of the targeting domains in the table can be used with a S. aureus Cas9 molecule that generates a double strand break (Cas9 nuclease) or a single-strand break (Cas9 nickase).

Any of the targeting domains in the table can be used with a *S. aureus* Cas9 (nickase) molecule to generate a single strand break. In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 14C

5th Tier

| gRNA Name | DNA Strand | Targeting Domain | Target Site Length | SEQ ID NO |
|---|---|---|---|---|
| HBB-55 | − | AGUCUGCCGUUACUGCCCUG | 20 | 6857 |
| HBB-56 | − | AAGUCUGCCGUUACUGCCCU | 20 | 6858 |
| HBB-57 | + | AACCUUGAUACCAACCUGCC | 20 | 6859 |
| HBB-58 | + | UCCACGUUCACCUUGCCCCA | 20 | 6860 |
| HBB-59 | + | GCUAGUGAACACAGUUGUGU | 20 | 6861 |
| HBB-60 | − | CCAUGGUGCACCUGACUCCU | 20 | 6862 |
| HBB-61 | − | CAUGGUGCACCUGACUCCUG | 20 | 6863 |
| HBB-62 | + | AGGUGCACCAUGGUGUCUGU | 20 | 6864 |
| HBB-63 | − | UGGUGCACCUGACUCCUGUG | 20 | 6865 |
| HBB-64 | − | GAACGUGGAUGAAGUUGGUG | 20 | 6866 |
| HBB-65 | − | UUACUGCCCUGUGGGGCAAG | 20 | 6867 |
| HBB-66 | + | GUGUCUGUUUGAGGUUGCUA | 20 | 6868 |
| HBB-67 | − | GUGGGGCAAGGUGAACGUGG | 20 | 6869 |
| HBB-68 | − | AUGAAGUUGGUGGUGAGGCC | 20 | 6870 |
| HBB-69 | + | AGUAACGGCAGACUUCUCCA | 20 | 6871 |

Table 15A provides exemplary targeting domains for knocking out the BCL11A gene selected according to the first tier parameters. The targeting domains bind within the first 500 bp of the coding sequence (e.g., within 500 bp downstream from the start codon) and have a high level of orthogonality. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 15A

1st Tier

| gRNA Name | DNA Strand | Targeting Domain | Target Site Length | SEQ ID NO: |
|---|---|---|---|---|
| BCL11A-5318 | + | UCAUCUCGAUUGGUGAA | 17 | 6872 |
| BCL11A-5319 | + | UUGCUUGCGGCGAGACA | 17 | 6873 |
| BCL11A-5320 | − | AUGUCUCGCCGCAAGCA | 17 | 6874 |

TABLE 15A-continued

1st Tier

| gRNA Name | DNA Strand | Targeting Domain | Target Site Length | SEQ ID NO: |
|---|---|---|---|---|
| BCL11A-5321 | − | GCAGAAUAUGCCCCGCA | 17 | 6875 |
| BCL11A-5322 | − | CCGUUGGGAGCUCCAGA | 17 | 6876 |
| BCL11A-5323 | + | CUCCAUGUGCAGAACGA | 17 | 6877 |
| BCL11A-5324 | + | UCGAUUGGUGAAGGGGA | 17 | 6878 |
| BCL11A-5325 | + | CAUCCUCUGGCGUGACC | 17 | 6879 |
| BCL11A-5326 | − | GCUCUAAUCCCCACGCC | 17 | 6880 |
| BCL11A-5327 | + | CCCGUUUGCUUAAGUGC | 17 | 6881 |
| BCL11A-5328 | + | AAACAAUCGUCAUCCUC | 17 | 6882 |
| BCL11A-5329 | + | CCCAACGGGCCGUGGUC | 17 | 6883 |
| BCL11A-5330 | + | CAUCUCGAUUGGUGAAG | 17 | 6884 |
| BCL11A-5331 | − | CAUCCAGGUCACGCCAG | 17 | 6885 |
| BCL11A-5332 | − | UUAUCAACGUCAUCUAG | 17 | 6886 |
| BCL11A-5333 | + | GAGCUCCCAACGGGCCG | 17 | 6887 |
| BCL11A-5334 | + | UGCACUCAUCCCAGGCG | 17 | 6888 |
| BCL11A-5335 | + | AGACAUGGUGGGCUGCG | 17 | 6889 |
| BCL11A-5336 | + | CGUUUGCUUAAGUGCUG | 17 | 6890 |
| BCL11A-5337 | + | GCUUUUUCAUCUCGAU | 17 | 6891 |
| BCL11A-5338 | + | CCGUUUGCUUAAGUGCU | 17 | 6892 |
| BCL11A-5339 | − | UCCAAUCCCGUGGAGGU | 17 | 6893 |
| BCL11A-5340 | + | UUGCGGCGAGACAUGGU | 17 | 6894 |
| BCL11A-5341 | − | AUGACCUCCUCACCUGU | 17 | 6895 |
| BCL11A-5342 | − | UUAUUUUAUCGAGCACAAA | 20 | 6896 |
| BCL11A-5343 | + | UCCCCUUCUGGAGCUCCCAA | 20 | 6897 |
| BCL11A-5344 | + | UUUUCAUCUCGAUUGGUGAA | 20 | 6898 |
| BCL11A-5345 | + | GCCUUGCUUGCGGCGAGACA | 20 | 6899 |
| BCL11A-5346 | − | ACCAUGUCUCGCCGCAAGCA | 20 | 6900 |
| BCL11A-5347 | + | GAGCUCCAUGUGCAGAACGA | 20 | 6901 |
| BCL11A-5348 | − | UCACAGAUAAACUUCUGCAC | 20 | 6902 |
| BCL11A-5349 | + | CGUCAUCCUCUGGCGUGACC | 20 | 6903 |
| BCL11A-5350 | − | GGAGCUCUAAUCCCCACGCC | 20 | 6904 |
| BCL11A-5351 | − | UCCCGUGGAGGUUGGCAUCC | 20 | 6905 |
| BCL11A-5352 | + | AUUCCCGUUUGCUUAAGUGC | 20 | 6906 |
| BCL11A-5353 | + | CCCCCAAUGGGAAGUUCAUC | 20 | 6907 |
| BCL11A-5354 | + | GCUCCCAACGGGCCGUGGUC | 20 | 6908 |
| BCL11A-5355 | + | UUUCAUCUCGAUUGGUGAAG | 20 | 6909 |
| BCL11A-5356 | − | UGUUUAUCAACGUCAUCUAG | 20 | 6910 |
| BCL11A-5357 | + | AGAGCUCCAUGUGCAGAACG | 20 | 6911 |

TABLE 15A-continued

1st Tier

| gRNA Name | DNA Strand | Targeting Domain | Target Site Length | SEQ ID NO: |
|---|---|---|---|---|
| BCL11A-5358 | − | GAAAAAAGCAUCCAAUCCCG | 20 | 6912 |
| BCL11A-5359 | + | GCGAGACAUGGUGGGCUGCG | 20 | 6913 |
| BCL11A-5360 | − | CAGAUAAACUUCUGCACUGG | 20 | 6914 |
| BCL11A-5361 | + | CGGCGAGACAUGGUGGGCUG | 20 | 6915 |
| BCL11A-5362 | + | CUGCACUCAUCCCAGGCGUG | 20 | 6916 |
| BCL11A-5363 | − | UGAACCAGACCACGGCCCGU | 20 | 6917 |
| BCL11A-5364 | − | GCAUCCAAUCCCGUGGAGGU | 20 | 6918 |
| BCL11A-5365 | + | UGCUUGCGGCGAGACAUGGU | 20 | 6919 |
| BCL11A-5366 | + | UCAAGAGGCUCGGCUGUGGU | 20 | 6920 |
| BCL11A-5367 | − | AUCAUGACCUCCUCACCUGU | 20 | 6921 |

Table 15B provides exemplary targeting domains for knocking out the BCL11A gene selected according to the second tier parameters. The targeting domains bind within the first 500 bp of the coding sequence (e.g., within 500 bp downstream from the start codon). It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 15B

2nd Tier

| gRNA Name | DNA Strand | Targeting Domain | Target Site Length | SEQ ID NO: |
|---|---|---|---|---|
| BCL11A-5368 | − | UUUUUAUCGAGCACAAA | 17 | 6922 |
| BCL11A-5369 | − | CCCAGCACUUAAGCAAA | 17 | 6923 |
| BCL11A-5370 | + | AUAAGAAUGUCCCCCAA | 17 | 6924 |
| BCL11A-5371 | + | CCUUCUGGAGCUCCCAA | 17 | 6925 |
| BCL11A-5372 | − | AAACGGAAACAAUGCAA | 17 | 6926 |
| BCL11A-5373 | + | UUCAUCAUCUGUAAGAA | 17 | 6927 |
| BCL11A-5374 | − | CGUUGGGAGCUCCAGAA | 17 | 6928 |
| BCL11A-5375 | − | UCCCCUCGUUCUGCACA | 17 | 6929 |
| BCL11A-5376 | − | GAUGAUGAACCAGACCA | 17 | 6930 |
| BCL11A-5377 | + | CUGGAUGCCAACCUCCA | 17 | 6931 |
| BCL11A-5378 | − | CAGGUAAAUGAGAAGCA | 17 | 6932 |
| BCL11A-5379 | − | UAAACUUCUGCACUGGA | 17 | 6933 |
| BCL11A-5380 | + | UUCAUCUCGAUUGGUGA | 17 | 6934 |
| BCL11A-5381 | + | CAUUUGUAGAAGAAAUA | 17 | 6935 |
| BCL11A-5382 | − | AGGAAUUUGCCCCAAAC | 17 | 6936 |

TABLE 15B-continued

2nd Tier

| gRNA Name | DNA Strand | Targeting Domain | Target Site Length | SEQ ID NO: |
|---|---|---|---|---|
| BCL11A-5383 | − | CCAGCACUUAAGCAAAC | 17 | 6937 |
| BCL11A-5384 | + | CUUCUGGAGCUCCCAAC | 17 | 6938 |
| BCL11A-5385 | + | CAUCUGGCACUGCCCAC | 17 | 6939 |
| BCL11A-5386 | + | UGGAUGCCAACCUCCAC | 17 | 6940 |
| BCL11A-5387 | − | CAGAUAAACUUCUGCAC | 17 | 6941 |
| BCL11A-5388 | + | UAUUCUGCACUCAUCCC | 17 | 6942 |
| BCL11A-5389 | − | CGUGGAGGUUGGCAUCC | 17 | 6943 |
| BCL11A-5390 | − | AAACAGGAACACAUAGC | 17 | 6944 |
| BCL11A-5391 | − | UGCAGAAUAUGCCCCGC | 17 | 6945 |
| BCL11A-5392 | + | AUGGUGGGCUGCGGGGC | 17 | 6946 |
| BCL11A-5393 | + | ACUUACAAAUACCCUGC | 17 | 6947 |
| BCL11A-5394 | + | UGUACAUGUGUAGCUGC | 17 | 6948 |
| BCL11A-5395 | + | GAGACAUGGUGGGCUGC | 17 | 6949 |
| BCL11A-5396 | − | GUGUUGUAUUAUUUGC | 17 | 6950 |
| BCL11A-5397 | + | CCAAUGGGAAGUUCAUC | 17 | 6951 |
| BCL11A-5398 | + | AGGUCAUGAUCCCCUUC | 17 | 6952 |
| BCL11A-5399 | + | GUAAGAAUGGCUUCAAG | 17 | 6953 |
| BCL11A-5400 | − | GUUGGGAGCUCCAGAAG | 17 | 6954 |
| BCL11A-5401 | + | CAGCUUUUUCUAAGCAG | 17 | 6955 |
| BCL11A-5402 | + | UCCAUGUGCAGAACGAG | 17 | 6956 |
| BCL11A-2671 | + | CAGAACGAGGGGAGGAG | 17 | 6957 |
| BCL11A-5403 | − | AAACUUCUGCACUGGAG | 17 | 6958 |
| BCL11A-5404 | + | GCUCCAUGUGCAGAACG | 17 | 6959 |
| BCL11A-5405 | − | AAAAGCAUCCAAUCCCG | 17 | 6960 |
| BCL11A-5406 | + | CUUACAAAUACCCUGCG | 17 | 6961 |
| BCL11A-5407 | + | AUUGGUGAAGGGGAAGG | 17 | 6962 |
| BCL11A-5408 | + | ACUGCCCACAGGUGAGG | 17 | 6963 |
| BCL11A-4500 | + | GGGGCGGGCGGCGGCGG | 17 | 6964 |
| BCL11A-5409 | + | UGCGGGGCGGGCGGCGG | 17 | 6965 |
| BCL11A-5410 | + | GGCUGCGGGGCGGGCGG | 17 | 6966 |
| BCL11A-5411 | + | GUGGGCUGCGGGGCGGG | 17 | 6967 |
| BCL11A-5412 | + | AUGUGCAGAACGAGGGG | 17 | 6968 |
| BCL11A-5413 | + | CAUGGUGGGCUGCGGGG | 17 | 6969 |
| BCL11A-5414 | + | CUUGCGGCGAGACAUGG | 17 | 6970 |
| BCL11A-5415 | − | AUAAACUUCUGCACUGG | 17 | 6971 |
| BCL11A-5416 | − | AGCAUCCAAUCCCGUGG | 17 | 6972 |
| BCL11A-5417 | − | GAUGAACUUCCCAUUGG | 17 | 6973 |

TABLE 15B-continued

2nd Tier

| gRNA Name | DNA Strand | Targeting Domain | Target Site Length | SEQ ID NO: |
|---|---|---|---|---|
| BCL11A-5418 | - | CAUGACCUCCUCACCUG | 17 | 6974 |
| BCL11A-5419 | + | AACUUACAAAUACCCUG | 17 | 6975 |
| BCL11A-5420 | - | CUGCUUAGAAAAAGCUG | 17 | 6976 |
| BCL11A-5421 | + | UUCAAGAGGCUCGGCUG | 17 | 6977 |
| BCL11A-5422 | + | CGAGACAUGGUGGGCUG | 17 | 6978 |
| BCL11A-5423 | + | CACUCAUCCCAGGCGUG | 17 | 6979 |
| BCL11A-5424 | + | GGCACUGCCCACAGGUG | 17 | 6980 |
| BCL11A-5425 | - | AGAUGAACUUCCCAUUG | 17 | 6981 |
| BCL11A-5426 | + | GGGGUUUGCCUUGCUUG | 17 | 6982 |
| BCL11A-5427 | + | CUAUGUGUUCCUGUUUG | 17 | 6983 |
| BCL11A-5428 | + | UAAGAAUGUCCCCCAAU | 17 | 6984 |
| BCL11A-5429 | - | CCAGAUGAACUUCCCAU | 17 | 6985 |
| BCL11A-5430 | + | GCCAACCUCCACGGGAU | 17 | 6986 |
| BCL11A-5431 | + | AUUAUUAUUACUAUUAU | 17 | 6987 |
| BCL11A-5432 | - | CUCUAAUCCCCACGCCU | 17 | 6988 |
| BCL11A-5433 | + | AAUGGCUUCAAGAGGCU | 17 | 6989 |
| BCL11A-5434 | + | GUACAUGUGUAGCUGCU | 17 | 6990 |
| BCL11A-5435 | - | ACCAGACCACGGCCCGU | 17 | 6991 |
| BCL11A-5436 | + | GCACUCAUCCCAGGCGU | 17 | 6992 |
| BCL11A-5437 | + | AGAGGCUCGGCUGUGGU | 17 | 6993 |
| BCL11A-5438 | - | CAGAUGAACUUCCCAUU | 17 | 6994 |
| BCL11A-5439 | + | UUAUUAUUACUAUUAUU | 17 | 6995 |
| BCL11A-5440 | - | CCAGACCACGGCCCGUU | 17 | 6996 |
| BCL11A-5441 | + | UGCUAUGUGUUCCUGUU | 17 | 6997 |
| BCL11A-5442 | + | GCUAUGUGUUCCUGUUU | 17 | 6998 |
| BCL11A-5443 | - | AACCCCAGCACUUAAGCAAA | 20 | 6999 |
| BCL11A-5444 | + | AAAAUAAGAAUGUCCCCCAA | 20 | 7000 |
| BCL11A-5445 | - | CACAAACGGAAACAAUGCAA | 20 | 7001 |
| BCL11A-5446 | + | UGGUUCAUCAUCGUAAGAA | 20 | 7002 |
| BCL11A-5447 | - | GCCCGUUGGGAGCUCCAGAA | 20 | 7003 |
| BCL11A-5448 | - | UCCUCCCCUCGUUCUGCACA | 20 | 7004 |
| BCL11A-5449 | - | ACAGAUGAUGAACCAGACCA | 20 | 7005 |
| BCL11A-5450 | + | GACCUGGAUGCCAACCUCCA | 20 | 7006 |
| BCL11A-5451 | - | UAGCAGGUAAAUGAGAAGCA | 20 | 7007 |
| BCL11A-5452 | - | AGUGCAGAAUAUGCCCCGCA | 20 | 7008 |
| BCL11A-5453 | + | GGCCCGUUGGGAGCUCCAGA | 20 | 7009 |
| BCL11A-5454 | + | AUCUCGAUUGGUGAAGGGA | 20 | 7010 |
| BCL11A-5455 | - | AGAUAAACUUCUGCACUGGA | 20 | 7011 |
| BCL11A-5456 | + | UUUUUCAUCUCGAUUGGUGA | 20 | 7012 |
| BCL11A-5457 | - | UAGAGGAAUUUGCCCCAAAC | 20 | 7013 |
| BCL11A-5458 | - | ACCCCAGCACUUAAGCAAAC | 20 | 7014 |
| BCL11A-5459 | + | CCCCUUCUGGAGCUCCCAAC | 20 | 7015 |
| BCL11A-5460 | + | GUUCAUCUGGCACUGCCCAC | 20 | 7016 |
| BCL11A-5461 | + | ACCUGGAUGCCAACCUCCAC | 20 | 7017 |
| BCL11A-5462 | + | GCAUAUUCUGCACUCAUCCC | 20 | 7018 |
| BCL11A-5463 | - | CCCAAACAGGAACACAUAGC | 20 | 7019 |
| BCL11A-5464 | - | GAGUGCAGAAUAUGCCCCGC | 20 | 7020 |
| BCL11A-5465 | + | GACAUGGUGGGCUGCGGGGC | 20 | 7021 |
| BCL11A-5466 | + | UCAACUUACAAAUACCCUGC | 20 | 7022 |
| BCL11A-5467 | + | AGUUGUACAUGUGUAGCUGC | 20 | 7023 |
| BCL11A-5468 | + | GGCGAGACAUGGUGGGCUGC | 20 | 7024 |
| BCL11A-5469 | - | UUGGUGUUGUAUUAUUUGC | 20 | 7025 |
| BCL11A-5470 | + | GAUAAACAAUCGUCAUCCUC | 20 | 7026 |
| BCL11A-5471 | + | AGGAGGUCAUGAUCCCCUUC | 20 | 7027 |
| BCL11A-5472 | + | UCUGUAAGAAUGGCUUCAAG | 20 | 7028 |
| BCL11A-5473 | - | CCCGUUGGGAGCUCCAGAAG | 20 | 7029 |
| BCL11A-5474 | - | UGGCAUCCAGGUCACGCCAG | 20 | 7030 |
| BCL11A-5475 | + | CCACAGCUUUUUCUAAGCAG | 20 | 7031 |
| BCL11A-5476 | + | AGCUCCAUGUGCAGAACGAG | 20 | 7032 |
| BCL11A-5477 | + | GUGCAGAACGAGGGGAGGAG | 20 | 7033 |
| BCL11A-5478 | - | GAUAAACUUCUGCACUGGAG | 20 | 7034 |
| BCL11A-5479 | + | CUGGAGCUCCAACGGGCCG | 20 | 7035 |
| BCL11A-5480 | + | UUCUGCACUCAUCCCAGGCG | 20 | 7036 |
| BCL11A-5481 | + | CAACUUACAAAUACCCUGCG | 20 | 7037 |
| BCL11A-5482 | + | UCGAUUGGUGAAGGGAAGG | 20 | 7038 |
| BCL11A-5483 | + | GGCACUGCCCACAGGUGAGG | 20 | 7039 |
| BCL11A-5484 | + | UGCGGGGCGGGCGGCGGCGG | 20 | 7040 |
| BCL11A-5485 | + | GGCUGCGGGGCGGGCGGCGG | 20 | 7041 |
| BCL11A-5486 | + | GUGGGCUGCGGGGCGGGCGG | 20 | 7042 |
| BCL11A-5487 | + | AUGGUGGGCUGCGGGGCGGG | 20 | 7043 |
| BCL11A-5488 | + | UCCAUGUGCAGAACGAGGGG | 20 | 7044 |
| BCL11A-5489 | + | AGACAUGGUGGGCUGCGGGG | 20 | 7045 |
| BCL11A-5490 | + | UUGCUUGCGGCGAGACAUGG | 20 | 7046 |
| BCL11A-5491 | - | AAAAGCAUCCAAUCCCGUGG | 20 | 7047 |

TABLE 15B-continued

2nd Tier

| gRNA Name | DNA Strand | Targeting Domain | Target Site Length | SEQ ID NO: |
|---|---|---|---|---|
| BCL11A-5492 | - | CCAGAUGAACUUCCCAUUGG | 20 | 7048 |
| BCL11A-5493 | - | GAUCAUGACCUCCUCACCUG | 20 | 7049 |
| BCL11A-5494 | + | CUCAACUUACAAAUACCCUG | 20 | 7050 |
| BCL11A-5495 | - | CCUCUGCUUAGAAAAAGCUG | 20 | 7051 |
| BCL11A-5496 | + | GGCUUCAAGAGGCUCGGCUG | 20 | 7052 |
| BCL11A-5497 | + | UCCCGUUUGCUUAAGUGCUG | 20 | 7053 |
| BCL11A-5498 | + | UCUGGCACUGCCCACAGGUG | 20 | 7054 |
| BCL11A-5499 | - | GCCAGAUGAACUUCCCAUUG | 20 | 7055 |
| BCL11A-5500 | + | GCUGGGGUUUGCCUUGCUUG | 20 | 7056 |
| BCL11A-5501 | + | CUGCUAUGUGUUCCUGUUUG | 20 | 7057 |
| BCL11A-5502 | + | AAAUAAGAAUGUCCCCCAAU | 20 | 7058 |
| BCL11A-5503 | - | GUGCCAGAUGAACUUCCCAU | 20 | 7059 |
| BCL11A-5504 | + | GAUGCUUUUUUCAUCUCGAU | 20 | 7060 |
| BCL11A-5505 | + | GAUGCCAACCUCCACGGGAU | 20 | 7061 |
| BCL11A-5506 | - | GAGCUCUAAUCCCCACGCCU | 20 | 7062 |
| BCL11A-5507 | + | AAGAAUGGCUUCAAGAGGCU | 20 | 7063 |
| BCL11A-5508 | + | GUUGUACAUGUGUAGCUGCU | 20 | 7064 |
| BCL11A-5509 | + | UUCCCGUUUGCUUAAGUGCU | 20 | 7065 |
| BCL11A-5510 | + | UCUGCACUCAUCCCAGGCGU | 20 | 7066 |
| BCL11A-5511 | - | UGCCAGAUGAACUUCCCAUU | 20 | 7067 |
| BCL11A-5512 | - | GAACCAGACCACGGCCCGUU | 20 | 7068 |
| BCL11A-5513 | + | ACCUGCUAUGUGUUCCUGUU | 20 | 7069 |
| BCL11A-5514 | + | CCUGCUAUGUGUUCCUGUUU | 20 | 7070 |

Table 15C provides exemplary targeting domains for knocking out the BCL11A gene selected according to the third tier parameters. The targeting domains fall in the coding sequence of the gene, downstream of the first 500 bp of coding sequence (e.g., anywhere from +500 (relative to the start codon) to the stop codon of the gene). It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 15C

3rd Tier

| gRNA Name | DNA Strand | Targeting Domain | Target Site Length | SEQ ID NO: |
|---|---|---|---|---|
| BCL11A-5515 | + | UCCGACGAGGAGGCAAA | 17 | 7071 |
| BCL11A-5516 | + | AUUCUUAGCAGGUUAAA | 17 | 7072 |
| BCL11A-5517 | - | GCUGCGGUUGAAUCCAA | 17 | 7073 |
| BCL11A-5518 | - | GGCCCAGCCCUAUGCAA | 17 | 7074 |
| BCL11A-5519 | + | CCGCAGCACCCUGUCAA | 17 | 7075 |
| BCL11A-5520 | - | CUUCCGGCCUGGCAGAA | 17 | 7076 |
| BCL11A-5521 | + | UUGAUGCGCUUAGAGAA | 17 | 7077 |
| BCL11A-5522 | - | AACCUGAUCCCGGAGAA | 17 | 7078 |
| BCL11A-5523 | - | GAGCACUCCUCGGAGAA | 17 | 7079 |
| BCL11A-5524 | + | CUGGGUACUACGCCGAA | 17 | 7080 |
| BCL11A-5525 | + | UCUCCGAAGCUAAGGAA | 17 | 7081 |
| BCL11A-5526 | + | GGGGGCGUCGCCAGGAA | 17 | 7082 |
| BCL11A-5527 | + | UUGCUACCGGCUGGAA | 17 | 7083 |
| BCL11A-5528 | + | CUGCACCUAGUCCUGAA | 17 | 7084 |
| BCL11A-5529 | + | AACCAUGCACUGGUGAA | 17 | 7085 |
| BCL11A-5530 | + | AUUUCUCAGAACUUAA | 17 | 7086 |
| BCL11A-5531 | + | UAUUCUUAGCAGGUUAA | 17 | 7087 |

TABLE 15C-continued

3rd Tier

| gRNA Name | DNA Strand | Targeting Domain | Target Site Length | SEQ ID NO: |
|---|---|---|---|---|
| BCL11A-5532 | − | GACGAUGGCACUGUUAA | 17 | 7088 |
| BCL11A-5533 | + | CGGUGGUGGACUAAACA | 17 | 7089 |
| BCL11A-5534 | − | GGCCGCGAUGCCCAACA | 17 | 7090 |
| BCL11A-5535 | − | UACUUAGAAAGCGAACA | 17 | 7091 |
| BCL11A-2969 | − | GCACCGGCGCAGCCACA | 17 | 7092 |
| BCL11A-2924 | − | CGAGGCCGAGGGCCACA | 17 | 7093 |
| BCL11A-5536 | − | CCCGAGUGCCUUUGACA | 17 | 7094 |
| BCL11A-5537 | + | CUUGAACUUGGCCACCA | 17 | 7095 |
| BCL11A-5538 | − | AAAAUUUGAAGCCCCCA | 17 | 7096 |
| BCL11A-5539 | + | CUGCAAUAUGAAUCCCA | 17 | 7097 |
| BCL11A-5540 | − | UAUGGAGCCUCCCGCCA | 17 | 7098 |
| BCL11A-5541 | + | CGGGUGAUGGGUGGCCA | 17 | 7099 |
| BCL11A-5542 | + | UCUCCUAGAGAAAUCCA | 17 | 7100 |
| BCL11A-5543 | − | UCCCAGCCACCUCUCCA | 17 | 7101 |
| BCL11A-5544 | − | CUCGGGGCGCAGCGGCA | 17 | 7102 |
| BCL11A-5545 | − | CGACGUCAUGCAGGGCA | 17 | 7103 |
| BCL11A-5546 | + | CUGCAUGACGUCGGGCA | 17 | 7104 |
| BCL11A-5547 | − | GACUUAGAGAGCUGGCA | 17 | 7105 |
| BCL11A-5548 | − | CUGCCCGACGUCAUGCA | 17 | 7106 |
| BCL11A-5549 | + | CUCGCUGAAGUGCUGCA | 17 | 7107 |
| BCL11A-5550 | − | AGCCAUUCACCAGUGCA | 17 | 7108 |
| BCL11A-5551 | − | CACGCACAGAACACUCA | 17 | 7109 |
| BCL11A-5552 | + | GUCGGACUUGACCGUCA | 17 | 7110 |
| BCL11A-5553 | + | ACCAACCCGCGGGUCA | 17 | 7111 |
| BCL11A-5554 | − | AGGCCCAGCUCAAAAGA | 17 | 7112 |
| BCL11A-5555 | − | GCUUCCGGCCUGGCAGA | 17 | 7113 |
| BCL11A-5556 | − | CCUGGGGGCGGAAGAGA | 17 | 7114 |
| BCL11A-5557 | + | CUUGAUGCGCUUAGAGA | 17 | 7115 |
| BCL11A-5558 | − | GCUGACGGAGAGCGAGA | 17 | 7116 |
| BCL11A-5559 | − | GCGCAUCAAGCUCGAGA | 17 | 7117 |
| BCL11A-5560 | − | UCGGACCGCAUAGACGA | 17 | 7118 |
| BCL11A-5561 | − | ACGGUCAAGUCCGACGA | 17 | 7119 |
| BCL11A-5562 | − | CACCUGGCCGAGGCCGA | 17 | 7120 |
| BCL11A-5563 | + | GUCUCCGAAGCUAAGGA | 17 | 7121 |
| BCL11A-5564 | + | GGGGGGCGUCGCCAGGA | 17 | 7122 |
| BCL11A-5565 | + | AGGUUGGAGACAGAGGA | 17 | 7123 |
| BCL11A-5566 | + | GGGCGGAUUGCAGAGGA | 17 | 7124 |

TABLE 15C-continued

3rd Tier

| gRNA Name | DNA Strand | Targeting Domain | Target Site Length | SEQ ID NO: |
|---|---|---|---|---|
| BCL11A-5567 | + | GGGGCUGGGAGGGAGGA | 17 | 7125 |
| BCL11A-5568 | − | CCGGGGAGCUGGACGGA | 17 | 7126 |
| BCL11A-5569 | − | GUGUGGCAGUUUUCGGA | 17 | 7127 |
| BCL11A-5570 | + | GGAUUGCAGAGGAGGGA | 17 | 7128 |
| BCL11A-5571 | + | UUGACCGGGGCUGGGA | 17 | 7129 |
| BCL11A-5572 | + | UGGAGAGGUGGCUGGGA | 17 | 7130 |
| BCL11A-5573 | − | CCGCCCGGGGAGCUGGA | 17 | 7131 |
| BCL11A-5574 | − | GCGGCACGGGAAGUGGA | 17 | 7132 |
| BCL11A-5575 | + | GCCCAGGACCUGGUGGA | 17 | 7133 |
| BCL11A-5576 | − | CAAAUCGUCCCCCAUGA | 17 | 7134 |
| BCL11A-5577 | + | UCUGCACCUAGUCCUGA | 17 | 7135 |
| BCL11A-5578 | − | GGAGGAGGAGGAGCUGA | 17 | 7136 |
| BCL11A-5579 | + | CAAAGGCACUCGGGUGA | 17 | 7137 |
| BCL11A-5580 | + | GGCCCGGACCACUAAUA | 17 | 7138 |
| BCL11A-5581 | + | GCAGUAACCUUUGCAUA | 17 | 7139 |
| BCL11A-5582 | − | AGCGAGAGGGUGGACUA | 17 | 7140 |
| BCL11A-5583 | + | UGGAGUCUCCGAAGCUA | 17 | 7141 |
| BCL11A-5584 | − | GUUGAAUCCAAUGGCUA | 17 | 7142 |
| BCL11A-5585 | + | CACAGGUUGCACUUGUA | 17 | 7143 |
| BCL11A-5586 | + | AAUUUCUCAGAACUUA | 17 | 7144 |
| BCL11A-5587 | + | UCGGUGGUGGACUAAAC | 17 | 7145 |
| BCL11A-5588 | − | ACCUGAUCCCGGAGAAC | 17 | 7146 |
| BCL11A-5589 | − | AGCACUCCUCGGAGAAC | 17 | 7147 |
| BCL11A-2979 | − | CACCGGCGCAGCCACAC | 17 | 7148 |
| BCL11A-2916 | − | CCGAGGCCGAGGGCCAC | 17 | 7149 |
| BCL11A-5590 | + | UGCACGCGUGGUCGCAC | 17 | 7150 |
| BCL11A-5591 | − | UCGGGGCGCAGCGGCAC | 17 | 7151 |
| BCL11A-5592 | + | CAAGAGAAACCAUGCAC | 17 | 7152 |
| BCL11A-5593 | − | GCAACCUGGUGGUGCAC | 17 | 7153 |
| BCL11A-5594 | + | GCAGCAGCUUUUUGGAC | 17 | 7154 |
| BCL11A-5595 | + | CAUGACUUGGACUUGAC | 17 | 7155 |
| BCL11A-5596 | − | ACCCGAGUGCCUUUGAC | 17 | 7156 |
| BCL11A-5597 | − | CAAAUUUCAGAGCAACC | 17 | 7157 |
| BCL11A-5598 | − | GCCAGCUCCCCGGAACC | 17 | 7158 |
| BCL11A-5599 | + | UGCGCCGGUGCACCACC | 17 | 7159 |
| BCL11A-5600 | − | GCAUAAGCGCGGCCACC | 17 | 7160 |
| BCL11A-5601 | − | CAGCGAGGCCUUCCACC | 17 | 7161 |
| BCL11A-5602 | + | GCUUCUCGCCCAGGACC | 17 | 7162 |

TABLE 15C-continued

3rd Tier

| gRNA Name | DNA Strand | Targeting Domain | Target Site Length | SEQ ID NO: |
|---|---|---|---|---|
| BCL11A-5603 | + | AUGACUUGGACUUGACC | 17 | 7163 |
| BCL11A-5604 | − | AACCUGCUAAGAAUACC | 17 | 7164 |
| BCL11A-5605 | + | AAGGGCGGCUUGCUACC | 17 | 7165 |
| BCL11A-5606 | − | CGACCACGCGUGCACCC | 17 | 7166 |
| BCL11A-5607 | − | GAAAAUUUGAAGCCCCC | 17 | 7167 |
| BCL11A-5608 | + | CCAUCUCUUCCGCCCCC | 17 | 7168 |
| BCL11A-5609 | − | UCCUCCCUCCCAGCCCC | 17 | 7169 |
| BCL11A-5610 | − | GGAGUUCGACCUGCCCC | 17 | 7170 |
| BCL11A-5611 | + | CCUCCGUCCAGCUCCCC | 17 | 7171 |
| BCL11A-5612 | − | GGCCGCGGCUGCUCCCC | 17 | 7172 |
| BCL11A-5613 | − | AGCCCACCGCUGUCCCC | 17 | 7173 |
| BCL11A-5614 | − | GCUUCUCCACACCGCCC | 17 | 7174 |
| BCL11A-5615 | + | CCGAGGCCGACUCGCCC | 17 | 7175 |
| BCL11A-5616 | + | GCUUAUGCUUCUCGCCC | 17 | 7176 |
| BCL11A-5617 | − | AUUAGUGGUCCGGGCCC | 17 | 7177 |
| BCL11A-5618 | − | GGCGGAAGAGAUGGCCC | 17 | 7178 |
| BCL11A-5619 | + | UUGAGCUGGGCCUGCCC | 17 | 7179 |
| BCL11A-5620 | − | CUCCACCGCCAGCUCCC | 17 | 7180 |
| BCL11A-5621 | + | CCCUCCGUCCAGCUCCC | 17 | 7181 |
| BCL11A-5622 | − | UGGCCGCGGCUGCUCCC | 17 | 7182 |
| BCL11A-5623 | − | CUGCAACCAUUCCAGCC | 17 | 7183 |
| BCL11A-5624 | − | CGGCUUCGGGCUGAGCC | 17 | 7184 |
| BCL11A-5625 | − | CGCUUCUCCACACCGCC | 17 | 7185 |
| BCL11A-5626 | − | CCACCGCAUAGAGCGCC | 17 | 7186 |
| BCL11A-5627 | + | CCCGAGGCCGACUCGCC | 17 | 7187 |
| BCL11A-5628 | + | GGAGGGGGGCGUCGCC | 17 | 7188 |
| BCL11A-5629 | + | AUAGGGCUGGGCCGGCC | 17 | 7189 |
| BCL11A-5630 | − | GAGAGAGGCUUCCGGCC | 17 | 7190 |
| BCL11A-5631 | + | UGUUGGGCAUCGCGGCC | 17 | 7191 |
| BCL11A-5632 | + | GGCCCUCGGCCUCGGCC | 17 | 7192 |
| BCL11A-5633 | + | CUGGGCCUGCCCGGGCC | 17 | 7193 |
| BCL11A-5634 | − | UAUUAGUGGUCCGGGCC | 17 | 7194 |
| BCL11A-5635 | + | GCUUCAGCUUGCUGGCC | 17 | 7195 |
| BCL11A-5636 | + | UCGGGUGAUGGGUGGCC | 17 | 7196 |
| BCL11A-5637 | + | UUUGAGCUGGGCCUGCC | 17 | 7197 |
| BCL11A-5638 | + | GGGAUCUUUGAGCUGCC | 17 | 7198 |
| BCL11A-5639 | + | GAAAGCGCCCUUCUGCC | 17 | 7199 |

TABLE 15C-continued

3rd Tier

| gRNA Name | DNA Strand | Targeting Domain | Target Site Length | SEQ ID NO: |
|---|---|---|---|---|
| BCL11A-5640 | + | ACCAAGUCGCUGGUGCC | 17 | 7200 |
| BCL11A-5641 | + | UCUCUCGAUACUGAUCC | 17 | 7201 |
| BCL11A-5642 | − | CGACCCCAACCUGAUCC | 17 | 7202 |
| BCL11A-5643 | + | GGUGGCGCGCCGCCUCC | 17 | 7203 |
| BCL11A-5644 | − | CCGGCUACGCGGCCUCC | 17 | 7204 |
| BCL11A-5645 | + | CCUCGUCCCCGUUCUCC | 17 | 7205 |
| BCL11A-5646 | − | GGCCUUCCACCAGGUCC | 17 | 7206 |
| BCL11A-5647 | − | CCCCAUAUUAGUGGUCC | 17 | 7207 |
| BCL11A-5648 | − | UAGCAAGCCGCCCUUCC | 17 | 7208 |
| BCL11A-5649 | + | CGCUGGUGCCGGGUUCC | 17 | 7209 |
| BCL11A-5650 | − | UAGGAGACUUAGAGAGC | 17 | 7210 |
| BCL11A-5651 | + | GAAGGGCUCAGCGAGC | 17 | 7211 |
| BCL11A-2886 | − | CACACCGCCCGGGGAGC | 17 | 7212 |
| BCL11A-5652 | + | GCCGGGUUCCGGGGAGC | 17 | 7213 |
| BCL11A-5653 | + | UCUGCCCUCUUUUGAGC | 17 | 7214 |
| BCL11A-5654 | + | CCUGGAGGCCGCGUAGC | 17 | 7215 |
| BCL11A-5655 | + | AUCCUGGUAUUCUUAGC | 17 | 7216 |
| BCL11A-5656 | + | AAGGGAUACCAACCCGC | 17 | 7217 |
| BCL11A-5657 | − | AAGUCCCUGACCCCGC | 17 | 7218 |
| BCL11A-5658 | + | CGCCCGUGUGGCUGCGC | 17 | 7219 |
| BCL11A-5659 | + | UAUGCGGUCCGACUCGC | 17 | 7220 |
| BCL11A-5660 | − | CCACGAGAACAGCUCGC | 17 | 7221 |
| BCL11A-5661 | − | UACUCGCAGUGGCUCGC | 17 | 7222 |
| BCL11A-5662 | + | GCUGCCCACCAAGUCGC | 17 | 7223 |
| BCL11A-5663 | − | CACCGCUGUCCCCAGGC | 17 | 7224 |
| BCL11A-5664 | + | GCGCCCUUCUGCCAGGC | 17 | 7225 |
| BCL11A-5665 | + | GUGUUGGGCAUCGCGGC | 17 | 7226 |
| BCL11A-5666 | + | UAACCUUUGCAUAGGGC | 17 | 7227 |
| BCL11A-5667 | − | GUGGUCCGGGCCCGGGC | 17 | 7228 |
| BCL11A-5668 | + | CCUGCAUGACGUCGGGC | 17 | 7229 |
| BCL11A-5669 | + | UGGACUUGACCGGGGGC | 17 | 7230 |
| BCL11A-5670 | + | GCAUCGCGGCCGGGGGC | 17 | 7231 |
| BCL11A-5671 | + | UUUGCAUAGGGCUGGGC | 17 | 7232 |
| BCL11A-5672 | + | CUAGAGAAAUCCAUGGC | 17 | 7233 |
| BCL11A-5673 | + | GCGGCUUGCUACCUGGC | 17 | 7234 |
| BCL11A-5674 | − | AGACUUAGAGAGCUGGC | 17 | 7235 |
| BCL11A-5675 | + | UCCCAUGGAGAGGUGGC | 17 | 7236 |
| BCL11A-5676 | − | GACGAAGACUCGGUGGC | 17 | 7237 |

TABLE 15C-continued

3rd Tier

| gRNA Name | DNA Strand | Targeting Domain | Target Site Length | SEQ ID NO: |
|---|---|---|---|---|
| BCL11A-5677 | − | CCUGCCCGACGUCAUGC | 17 | 7238 |
| BCL11A-5394 | + | UGUACAUGUGUAGCUGC | 17 | 7239 |
| BCL11A-5678 | + | GGACUUGAGCGCGCUGC | 17 | 7240 |
| BCL11A-5679 | − | GUCCAAAAAGCUGCUGC | 17 | 7241 |
| BCL11A-5680 | + | CACCAAGUCGCUGGUGC | 17 | 7242 |
| BCL11A-5681 | + | GUGGCGCUUCAGCUUGC | 17 | 7243 |
| BCL11A-5682 | + | CCCCGUUCUCCGGGAUC | 17 | 7244 |
| BCL11A-5683 | + | CCCUGUCAAAGGCACUC | 17 | 7245 |
| BCL11A-5684 | − | CCGGGCGAGUCGGCCUC | 17 | 7246 |
| BCL11A-5685 | − | CUGGACGGAGGGAUCUC | 17 | 7247 |
| BCL11A-5686 | + | ACACAUCUUGAGCUCUC | 17 | 7248 |
| BCL11A-5687 | + | UCCUCGUCCCCGUUCUC | 17 | 7249 |
| BCL11A-5688 | + | AUGCCCUGCAUGACGUC | 17 | 7250 |
| BCL11A-5689 | + | UACCAACCCGCGGGGUC | 17 | 7251 |
| BCL11A-5690 | − | GCCCCAUAUUAGUGGUC | 17 | 7252 |
| BCL11A-5691 | + | GGCAAAAGGCGAUUGUC | 17 | 7253 |
| BCL11A-5692 | − | CGGGUUGGUAUCCCUUC | 17 | 7254 |
| BCL11A-5693 | − | GUAUCGAGAGAGGCUUC | 17 | 7255 |
| BCL11A-5694 | − | GGGUGGACUACGGCUUC | 17 | 7256 |
| BCL11A-5695 | + | UCGCUGGUGCCGGGUUC | 17 | 7257 |
| BCL11A-5696 | − | CAGGCCCAGCUCAAAAG | 17 | 7258 |
| BCL11A-5697 | + | GUGAAGAACCUAGAAAG | 17 | 7259 |
| BCL11A-5698 | + | UUCUUAGCAGGUUAAAG | 17 | 7260 |
| BCL11A-3087 | − | CGAGGAAGAGGAAGAAG | 17 | 7261 |
| BCL11A-5699 | + | UGAUGCGCUUAGAGAAG | 17 | 7262 |
| BCL11A-3083 | − | GGAGGACGACGAGGAAG | 17 | 7263 |
| BCL11A-3089 | − | GGAAGAAGAGGAGGAAG | 17 | 7264 |
| BCL11A-3075 | − | CGGGGACGAGGAGGAAG | 17 | 7265 |
| BCL11A-2876 | − | CGCAGCGGCACGGGAAG | 17 | 7266 |
| BCL11A-5700 | + | GGUGGUGGACUAAACAG | 17 | 7267 |
| BCL11A-5701 | + | AAAGAGGUUGGAGACAG | 17 | 7268 |
| BCL11A-5702 | + | GGCCGGCCUGGGGACAG | 17 | 7269 |
| BCL11A-5703 | − | AAAUUUGAAGCCCCCAG | 17 | 7270 |
| BCL11A-5704 | − | GGGAUCUCGGGGCGCAG | 17 | 7271 |
| BCL11A-5705 | − | AGAACGUGUACUCGCAG | 17 | 7272 |
| BCL11A-5706 | + | GGAGGGGCGGAUUGCAG | 17 | 7273 |
| BCL11A-5707 | + | CCAACCCGCGGGGUCAG | 17 | 7274 |

TABLE 15C-continued

3rd Tier

| gRNA Name | DNA Strand | Targeting Domain | Target Site Length | SEQ ID NO: |
|---|---|---|---|---|
| BCL11A-5708 | − | AGGAUCAGUAUCGAGAG | 17 | 7275 |
| BCL11A-5709 | − | AGCUGACGGAGAGCGAG | 17 | 7276 |
| BCL11A-5710 | + | GGUUGGAGACAGAGGAG | 17 | 7277 |
| BCL11A-5711 | + | GGGCUGGGAGGGAGGAG | 17 | 7278 |
| BCL11A-5712 | + | GAUUGCAGAGGAGGGAG | 17 | 7279 |
| BCL11A-5713 | + | ACUAAACAGGGGGGGAG | 17 | 7280 |
| BCL11A-5714 | + | AUAUGAAUCCCAUGGAG | 17 | 7281 |
| BCL11A-5715 | − | AGCACGCCCCAUAUUAG | 17 | 7282 |
| BCL11A-5716 | − | CCUGAUCCCGGAGAACG | 17 | 7283 |
| BCL11A-3081 | − | GGAAGAGGAGGACGACG | 17 | 7284 |
| BCL11A-5717 | + | CGAGGAGUGCUCCGACG | 17 | 7285 |
| BCL11A-2837 | − | CCCGGAGAACGGGGACG | 17 | 7286 |
| BCL11A-5718 | − | GUGGCUCGCCGGCUACG | 17 | 7287 |
| BCL11A-5719 | + | UGACUUGGACUUGACCG | 17 | 7288 |
| BCL11A-5720 | + | GAAGGGAUACCAACCCG | 17 | 7289 |
| BCL11A-5721 | − | GAAGUCCCUGACCCCG | 17 | 7290 |
| BCL11A-5722 | + | UUUGGACAGGCCCCCCG | 17 | 7291 |
| BCL11A-5723 | − | CUUCUCCACACCGCCCG | 17 | 7292 |
| BCL11A-5724 | + | CGAGGCCGACUCGCCCG | 17 | 7293 |
| BCL11A-2946 | + | CGCCCGGGGAGCAGCCG | 17 | 7294 |
| BCL11A-5725 | − | CCACCUGGCCGAGGCCG | 17 | 7295 |
| BCL11A-5726 | + | GUUGGGCAUCGCGGCCG | 17 | 7296 |
| BCL11A-5727 | − | GGCACUGUUAAUGGCCG | 17 | 7297 |
| BCL11A-5728 | − | GCGCGGCCACCUGGCCG | 17 | 7298 |
| BCL11A-5729 | + | CAAACUCCCGUUCUCCG | 17 | 7299 |
| BCL11A-5730 | − | CAGCGCGCUCAAGUCCG | 17 | 7300 |
| BCL11A-5731 | + | GCUGGUGCCGGGUUCCG | 17 | 7301 |
| BCL11A-5732 | − | GGCGAGAAGCAUAAGCG | 17 | 7302 |
| BCL11A-5733 | − | CAUGCAGCACUUCAGCG | 17 | 7303 |
| BCL11A-5734 | + | UGGCCUGGGUGCACGCG | 17 | 7304 |
| BCL11A-5735 | + | AGGGAUACCAACCCGCG | 17 | 7305 |
| BCL11A-5736 | − | CACGAGAACAGCUCGCG | 17 | 7306 |
| BCL11A-5737 | + | UGACGUCGGGCAGGGCG | 17 | 7307 |
| BCL11A-5738 | − | GAACAGCUCGCGGGGCG | 17 | 7308 |
| BCL11A-5739 | − | GGGCGCGGUCGUGGGCG | 17 | 7309 |
| BCL11A-5740 | + | CUCCGUGUUGGGCAUCG | 17 | 7310 |
| BCL11A-5741 | − | CGGGCGAGUCGGCCUCG | 17 | 7311 |
| BCL11A-5742 | − | ACCACGAGAACAGCUCG | 17 | 7312 |

TABLE 15C-continued

3rd Tier

| gRNA Name | DNA Strand | Targeting Domain | Target Site Length | SEQ ID NO: |
|---|---|---|---|---|
| BCL11A-5743 | - | UGGACGGAGGGAUCUCG | 17 | 7313 |
| BCL11A-5744 | + | CCCGCGAGCUGUUCUCG | 17 | 7314 |
| BCL11A-5745 | - | CUCGCGGGGCGCGGUCG | 17 | 7315 |
| BCL11A-5746 | + | GUGGUGGACUAAACAGG | 17 | 7316 |
| BCL11A-5747 | + | CCUCGGCCUCGGCCAGG | 17 | 7317 |
| BCL11A-3090 | - | GGAAGAGGAAGAAGAGG | 17 | 7318 |
| BCL11A-3091 | - | AGAAGAGGAGGAAGAGG | 17 | 7319 |
| BCL11A-3088 | - | GGACGAGGAGGAAGAGG | 17 | 7320 |
| BCL11A-5748 | + | GAGGUUGGAGACAGAGG | 17 | 7321 |
| BCL11A-5749 | + | GGGGCGGAUUGCAGAGG | 17 | 7322 |
| BCL11A-5750 | + | UGAAUCCCAUGGAGAGG | 17 | 7323 |
| BCL11A-5751 | + | GGAGUGCUCCGACGAGG | 17 | 7324 |
| BCL11A-3066 | - | GGAGAACGGGGACGAGG | 17 | 7325 |
| BCL11A-3092 | - | AGAGGAGGAAGAGGAGG | 17 | 7326 |
| BCL11A-5752 | + | GUUGGAGACAGAGGAGG | 17 | 7327 |
| BCL11A-3093 | - | GGAGGAAGAGGAGGAGG | 17 | 7328 |
| BCL11A-5753 | + | AUUGCAGAGGAGGGAGG | 17 | 7329 |
| BCL11A-5754 | + | GGGGGCUGGGAGGGAGG | 17 | 7330 |
| BCL11A-5755 | - | CGGGCUGAGCCUGGAGG | 17 | 7331 |
| BCL11A-5756 | - | CCCGGGGAGCUGGACGG | 17 | 7332 |
| BCL11A-5757 | + | GACUUGGACUUGACCGG | 17 | 7333 |
| BCL11A-5758 | + | UUGGGCAUCGCGGCCGG | 17 | 7334 |
| BCL11A-5759 | + | CGGCCUGGGGACAGCGG | 17 | 7335 |
| BCL11A-5760 | + | UUCCGGGGAGCUGGCGG | 17 | 7336 |
| BCL11A-5761 | + | CCAGGCGCUCUAUGCGG | 17 | 7337 |
| BCL11A-5762 | - | UUGCGACGAAGACUCGG | 17 | 7338 |
| BCL11A-5763 | - | GGGCGAGUCGGCCUCGG | 17 | 7339 |
| BCL11A-5764 | + | UCCAAGUGAUGUCUCGG | 17 | 7340 |
| BCL11A-5765 | + | GGCGUCGCCAGGAAGGG | 17 | 7341 |
| BCL11A-5766 | + | UGGUGGACUAAACAGGG | 17 | 7342 |
| BCL11A-3076 | - | GACGGAGAGCGAGAGGG | 17 | 7343 |
| BCL11A-5767 | + | CGGAUUGCAGAGGAGGG | 17 | 7344 |
| BCL11A-5768 | + | UUGCAGAGGAGGGAGGG | 17 | 7345 |
| BCL11A-5769 | + | ACCGGGGGCUGGGAGGG | 17 | 7346 |
| BCL11A-5770 | + | CCGUCCAGCUCCCCGGG | 17 | 7347 |
| BCL11A-5771 | + | GAGAAAUCCAUGGCGGG | 17 | 7348 |
| BCL11A-5772 | - | GGCGAGUCGGCCUCGGG | 17 | 7349 |

TABLE 15C-continued

3rd Tier

| gRNA Name | DNA Strand | Targeting Domain | Target Site Length | SEQ ID NO: |
|---|---|---|---|---|
| BCL11A-5773 | + | GGUGGACUAAACAGGGG | 17 | 7350 |
| BCL11A-5774 | − | UUUGAAGCCCCCAGGGG | 17 | 7351 |
| BCL11A-5775 | + | CUGGGAGGGAGGAGGGG | 17 | 7352 |
| BCL11A-5776 | + | UGCAGAGGAGGGAGGGG | 17 | 7353 |
| BCL11A-5777 | − | CAUAGAGCGCCUGGGGG | 17 | 7354 |
| BCL11A-5778 | − | AGCCCCCAGGGGUGGGG | 17 | 7355 |
| BCL11A-5779 | + | GGCACUCGGGUGAUGGG | 17 | 7356 |
| BCL11A-5780 | + | CUUGACCGGGGCUGGG | 17 | 7357 |
| BCL11A-5781 | + | AACAGGGGGGAGUGGG | 17 | 7358 |
| BCL11A-5782 | + | GGUACUACGCCGAAUGG | 17 | 7359 |
| BCL11A-5783 | + | CCUAGAGAAAUCCAUGG | 17 | 7360 |
| BCL11A-5784 | + | GGACUUGACCGUCAUGG | 17 | 7361 |
| BCL11A-5785 | − | AUUUCAGAGCAACCUGG | 17 | 7362 |
| BCL11A-5786 | + | UCUCGCCCAGGACCUGG | 17 | 7363 |
| BCL11A-5787 | − | CUUCGGGCUGAGCCUGG | 17 | 7364 |
| BCL11A-5788 | − | CCGCAUAGAGCGCCUGG | 17 | 7365 |
| BCL11A-5789 | + | AUCUUUGAGCUGCCUGG | 17 | 7366 |
| BCL11A-5790 | + | GGGUUCCGGGGAGCUGG | 17 | 7367 |
| BCL11A-5791 | − | AGCGGCACGGGAAGUGG | 17 | 7368 |
| BCL11A-5792 | − | CGCGCUCAAGUCCGUGG | 17 | 7369 |
| BCL11A-5793 | + | GCGAGCUGUUCUCGUGG | 17 | 7370 |
| BCL11A-5794 | + | GGCGCUCUAUGCGGUGG | 17 | 7371 |
| BCL11A-5795 | + | AAGUGAUGUCUCGGUGG | 17 | 7372 |
| BCL11A-5796 | − | CGGCACCAGCGACUUGG | 17 | 7373 |
| BCL11A-5797 | + | GGGUACUACGCCGAAUG | 17 | 7374 |
| BCL11A-5798 | + | CGGACUUGACCGUCAUG | 17 | 7375 |
| BCL11A-5799 | + | GCAUGUGCGUCUUCAUG | 17 | 7376 |
| BCL11A-5800 | + | CCCGGACCACUAAUAUG | 17 | 7377 |
| BCL11A-5801 | + | CCCCCAGGCGCUCUAUG | 17 | 7378 |
| BCL11A-5802 | + | CAGUGCCAUCGUCUAUG | 17 | 7379 |
| BCL11A-5803 | − | GACACUUGUGAGUACUG | 17 | 7380 |
| BCL11A-5804 | + | CGUCGCAAGUGUCCCUG | 17 | 7381 |
| BCL11A-5805 | − | ACCGCAUAGAGCGCCUG | 17 | 7382 |
| BCL11A-5806 | + | AGGGCUGGGCCGGCCUG | 17 | 7383 |
| BCL11A-5807 | + | AGGGGCUCAGCGAGCUG | 17 | 7384 |
| BCL11A-5808 | − | CCUUUGACAGGGUGCUG | 17 | 7385 |
| BCL11A-5809 | − | AAGUCAUGCGAGUUCUG | 17 | 7386 |
| BCL11A-5810 | + | AGGGCUUCUCGCCCGUG | 17 | 7387 |

TABLE 15C-continued

3rd Tier

| gRNA Name | DNA Strand | Targeting Domain | Target Site Length | SEQ ID NO: |
|---|---|---|---|---|
| BCL11A-5811 | + | CAGCUCCCCGGGCGGUG | 17 | 7388 |
| BCL11A-5812 | + | AGGCGCUCUAUGCGGUG | 17 | 7389 |
| BCL11A-5813 | − | UGAAGCCCCCAGGGGUG | 17 | 7390 |
| BCL11A-5814 | − | AGAGAGCUCAAGAUGUG | 17 | 7391 |
| BCL11A-5815 | + | UCUCCGGGAUCAGGUUG | 17 | 7392 |
| BCL11A-5816 | + | UGGGUACUACGCCGAAU | 17 | 7393 |
| BCL11A-5817 | + | GGAGGCUCCAUAGCCAU | 17 | 7394 |
| BCL11A-5818 | − | CCCAGCCACCUCUCCAU | 17 | 7395 |
| BCL11A-5819 | + | UGCAGUAACCUUUGCAU | 17 | 7396 |
| BCL11A-5820 | + | UCGGACUUGACCGUCAU | 17 | 7397 |
| BCL11A-5821 | + | AAAGGCACUCGGGUGAU | 17 | 7398 |
| BCL11A-5822 | + | GCCCGGACCACUAAUAU | 17 | 7399 |
| BCL11A-5823 | + | GUUCUCGCUCUUGAACU | 17 | 7400 |
| BCL11A-5824 | + | ACCCUGUCAAAGGCACU | 17 | 7401 |
| BCL11A-5825 | − | ACCACCGAGACAUCACU | 17 | 7402 |
| BCL11A-5826 | − | CACUUGCGACGAAGACU | 17 | 7403 |
| BCL11A-5827 | − | ACCCGGCACCAGCGACU | 17 | 7404 |
| BCL11A-5828 | − | GGUAUCCCUUCAGGACU | 17 | 7405 |
| BCL11A-5829 | + | GCAGAACUCGCAUGACU | 17 | 7406 |
| BCL11A-5830 | + | AGUGUCCCUGUGGCCCU | 17 | 7407 |
| BCL11A-5831 | − | CACCGCAUAGAGCGCCU | 17 | 7408 |
| BCL11A-5832 | + | UAGGGCUGGGCCGGCCU | 17 | 7409 |
| BCL11A-5833 | + | CCUGUGGCCCUCGGCCU | 17 | 7410 |
| BCL11A-5834 | − | CCCGGGCGAGUCGGCCU | 17 | 7411 |
| BCL11A-5835 | + | CUUCAGCUUGCUGGCCU | 17 | 7412 |
| BCL11A-5836 | − | CUCGUCGGAGCACUCCU | 17 | 7413 |
| BCL11A-5837 | − | GCCUUCCACCAGGUCCU | 17 | 7414 |
| BCL11A-5838 | + | AAGGGGCUCAGCGAGCU | 17 | 7415 |
| BCL11A-5839 | + | CUGCCCUCUUUUGAGCU | 17 | 7416 |
| BCL11A-5840 | + | AACCUUUGCAUAGGGCU | 17 | 7417 |
| BCL11A-5841 | + | GGACUUGACCGGGGCU | 17 | 7418 |
| BCL11A-5842 | + | CCCAUGGAGAGGUGGCU | 17 | 7419 |
| BCL11A-5434 | + | GUACAUGUGUAGCUGCU | 17 | 7420 |
| BCL11A-5843 | − | UCCAAAAAGCUGCUGCU | 17 | 7421 |
| BCL11A-5844 | − | GCUGGACGGAGGGAUCU | 17 | 7422 |
| BCL11A-5845 | + | CACAUCUUGAGCUCUCU | 17 | 7423 |
| BCL11A-5846 | − | CCGCCAUGGAUUUCUCU | 17 | 7424 |

TABLE 15C-continued

| | | 3rd Tier | | |
|---|---|---|---|---|
| gRNA Name | DNA Strand | Targeting Domain | Target Site Length | SEQ ID NO: |
| BCL11A-5847 | + | GGGUCCAAGUGAUGUCU | 17 | 7425 |
| BCL11A-5848 | - | GUCUCCAACCUCUUUCU | 17 | 7426 |
| BCL11A-5849 | - | CUCGGUGGCCGGCGAGU | 17 | 7427 |
| BCL11A-5850 | - | CUGCUCCCCGGGCGAGU | 17 | 7428 |
| BCL11A-5851 | + | CUAAACAGGGGGGGAGU | 17 | 7429 |
| BCL11A-5852 | + | CAUGCCCUGCAUGACGU | 17 | 7430 |
| BCL11A-5853 | - | GGCGCGGUCGUGGGCGU | 17 | 7431 |
| BCL11A-5854 | - | GCCUUUUGCCUCCUCGU | 17 | 7432 |
| BCL11A-5855 | + | GGUGGAGAGACCGUCGU | 17 | 7433 |
| BCL11A-5856 | - | UCGCGGGGCGCGGUCGU | 17 | 7434 |
| BCL11A-5857 | + | GUUCUCCGGGAUCAGGU | 17 | 7435 |
| BCL11A-5858 | + | AGAACCUAGAAAGAGGU | 17 | 7436 |
| BCL11A-5859 | + | GGCCUGGGGACAGCGGU | 17 | 7437 |
| BCL11A-5860 | + | CAGGCGCUCUAUGCGGU | 17 | 7438 |
| BCL11A-5861 | - | CCCCUGACCCCGCGGGU | 17 | 7439 |
| BCL11A-5862 | - | UUGAAGCCCCCAGGGGU | 17 | 7440 |
| BCL11A-5863 | - | GGCACCAGCGACUUGGU | 17 | 7441 |
| BCL11A-5864 | - | ACACUUGUGAGUACUGU | 17 | 7442 |
| BCL11A-5865 | + | GUACACGUUCUCCGUGU | 17 | 7443 |
| BCL11A-5866 | + | GCACAGGUUGCACUUGU | 17 | 7444 |
| BCL11A-5867 | - | CUUCACACACCCCCAUU | 17 | 7445 |
| BCL11A-5868 | - | GAUCCCUUCCUUAGCUU | 17 | 7446 |
| BCL11A-5869 | - | AGGGUGGACUACGGCUU | 17 | 7447 |
| BCL11A-5870 | + | UUCUCCGGGAUCAGGUU | 17 | 7448 |
| BCL11A-5871 | + | UACACGUUCUCCGUGUU | 17 | 7449 |
| BCL11A-5872 | + | GCCCAGCAGCAGCUUUU | 17 | 7450 |
| BCL11A-5873 | - | AGAUGUGUGGCAGUUUU | 17 | 7451 |
| BCL11A-5874 | + | UGCUCCGACGAGGAGGCAAA | 20 | 7452 |
| BCL11A-5875 | + | GGUAUUCUUAGCAGGUUAAA | 20 | 7453 |
| BCL11A-5876 | - | GGUGCUGCGGUUGAAUCCAA | 20 | 7454 |
| BCL11A-5877 | - | GCCGGCCCAGCCCUAUGCAA | 20 | 7455 |
| BCL11A-5878 | + | CAACCGCAGCACCCUGUCAA | 20 | 7456 |
| BCL11A-5879 | - | AGGCUUCCGGCCUGGCAGAA | 20 | 7457 |
| BCL11A-5880 | + | AGCUUGAUGCGCUUAGAGAA | 20 | 7458 |
| BCL11A-5881 | - | CCCAACCUGAUCCCGGAGAA | 20 | 7459 |
| BCL11A-5882 | - | UCGGAGCACUCCUCGGAGAA | 20 | 7460 |
| BCL11A-5883 | + | UCUCUGGGUACUACGCCGAA | 20 | 7461 |
| BCL11A-5884 | + | GAGUCUCCGAAGCUAAGGAA | 20 | 7462 |

TABLE 15C-continued

| gRNA Name | DNA Strand | Targeting Domain | Target Site Length | SEQ ID NO: |
|---|---|---|---|---|
| | | 3rd Tier | | |
| BCL11A-5885 | + | AGGGGGGGCGUCGCCAGGAA | 20 | 7463 |
| BCL11A-5886 | + | GGCUUGCUACCUGGCUGGAA | 20 | 7464 |
| BCL11A-5887 | + | AUUCUGCACCUAGUCCUGAA | 20 | 7465 |
| BCL11A-5888 | + | AGAAACCAUGCACUGGUGAA | 20 | 7466 |
| BCL11A-5889 | + | CAAAUUUCUCAGAACUUAA | 20 | 7467 |
| BCL11A-5890 | + | UGGUAUUCUUAGCAGGUUAA | 20 | 7468 |
| BCL11A-5891 | − | AUAGACGAUGGCACUGUUAA | 20 | 7469 |
| BCL11A-5892 | + | UCUCGGUGGUGGACUAAACA | 20 | 7470 |
| BCL11A-5893 | − | CCCGGCCGCGAUGCCCAACA | 20 | 7471 |
| BCL11A-5894 | − | AUCUACUUAGAAAGCGAACA | 20 | 7472 |
| BCL11A-5895 | − | GGUGCACCGGCGCAGCCACA | 20 | 7473 |
| BCL11A-3377 | − | GGCCGAGGCCGAGGGCCACA | 20 | 7474 |
| BCL11A-5896 | − | UCACCCGAGUGCCUUUGACA | 20 | 7475 |
| BCL11A-5897 | + | GCUCUUGAACUUGGCCACCA | 20 | 7476 |
| BCL11A-5898 | − | GAGAAAAUUUGAAGCCCCCA | 20 | 7477 |
| BCL11A-5899 | + | UGUCUGCAAUAUGAAUCCCA | 20 | 7478 |
| BCL11A-5900 | − | GGCUAUGGAGCCUCCCGCCA | 20 | 7479 |
| BCL11A-5901 | + | ACUCGGGUGAUGGGUGGCCA | 20 | 7480 |
| BCL11A-5902 | + | AAGUCUCCUAGAGAAAUCCA | 20 | 7481 |
| BCL11A-5903 | − | CCUUCCCAGCCACCUCUCCA | 20 | 7482 |
| BCL11A-5904 | − | GAUCUCGGGGCGCAGCGGCA | 20 | 7483 |
| BCL11A-5905 | − | GCCCGACGUCAUGCAGGGCA | 20 | 7484 |
| BCL11A-5906 | + | GCCCUGCAUGACGUCGGGCA | 20 | 7485 |
| BCL11A-5907 | − | GGAGACUUAGAGAGCUGGCA | 20 | 7486 |
| BCL11A-5908 | − | GCCCUGCCCGACGUCAUGCA | 20 | 7487 |
| BCL11A-5909 | + | GGCCUCGCUGAAGUGCUGCA | 20 | 7488 |
| BCL11A-5910 | − | AACAGCCAUUCACCAGUGCA | 20 | 7489 |
| BCL11A-5911 | − | CAACACGCACAGAACACUCA | 20 | 7490 |
| BCL11A-5912 | + | GUCGUCGGACUUGACCGUCA | 20 | 7491 |
| BCL11A-5913 | + | GAUACCAACCCGCGGGGUCA | 20 | 7492 |
| BCL11A-5914 | − | GGCAGGCCCAGCUCAAAAGA | 20 | 7493 |
| BCL11A-5915 | − | GAGGCUUCCGGCCUGGCAGA | 20 | 7494 |
| BCL11A-5916 | − | GCGCCUGGGGCGGAAGAGA | 20 | 7495 |
| BCL11A-5917 | + | GAGCUUGAUGCGCUUAGAGA | 20 | 7496 |
| BCL11A-5918 | − | GGAGCUGACGGAGAGCGAGA | 20 | 7497 |
| BCL11A-5919 | − | UAAGCGCAUCAAGCUCGAGA | 20 | 7498 |
| BCL11A-5920 | − | GAGUCGGACCGCAUAGACGA | 20 | 7499 |

TABLE 15C-continued

3rd Tier

| gRNA Name | DNA Strand | Targeting Domain | Target Site Length | SEQ ID NO: |
|---|---|---|---|---|
| BCL11A-5921 | - | AUGACGGUCAAGUCCGACGA | 20 | 7500 |
| BCL11A-5922 | - | GGCCACCUGGCCGAGGCCGA | 20 | 7501 |
| BCL11A-5923 | + | GGAGUCUCCGAAGCUAAGGA | 20 | 7502 |
| BCL11A-5924 | + | GAGGGGGGCGUCGCCAGGA | 20 | 7503 |
| BCL11A-5925 | + | AAGAGGUUGGAGACAGAGGA | 20 | 7504 |
| BCL11A-5926 | + | GAGGGGCGGAUUGCAGAGGA | 20 | 7505 |
| BCL11A-5927 | + | CCGGGGGCUGGGAGGGAGGA | 20 | 7506 |
| BCL11A-5928 | - | CGCCCGGGGAGCUGGACGGA | 20 | 7507 |
| BCL11A-5929 | - | GAUGUGUGGCAGUUUUCGGA | 20 | 7508 |
| BCL11A-5930 | + | GGCGGAUUGCAGAGGAGGGA | 20 | 7509 |
| BCL11A-5931 | + | GACUUGACCGGGGCUGGGA | 20 | 7510 |
| BCL11A-5932 | + | CCAUGGAGAGGUGGCUGGGA | 20 | 7511 |
| BCL11A-5933 | - | ACACCGCCCGGGGAGCUGGA | 20 | 7512 |
| BCL11A-5934 | - | GCAGCGGCACGGGAAGUGGA | 20 | 7513 |
| BCL11A-5935 | + | CUCGCCCAGGACCUGGUGGA | 20 | 7514 |
| BCL11A-5936 | - | GCACAAAUCGUCCCCAUGA | 20 | 7515 |
| BCL11A-5937 | + | CAUUCUGCACCUAGUCCUGA | 20 | 7516 |
| BCL11A-5938 | - | AGAGGAGGAGGAGGAGCUGA | 20 | 7517 |
| BCL11A-5939 | + | UGUCAAAGGCACUCGGGUGA | 20 | 7518 |
| BCL11A-5940 | + | CCGGGCCCGGACCACUAAUA | 20 | 7519 |
| BCL11A-5941 | + | GUUGCAGUAACCUUUGCAUA | 20 | 7520 |
| BCL11A-5942 | - | GAGAGCGAGAGGGUGGACUA | 20 | 7521 |
| BCL11A-5943 | + | GUCUGGAGUCUCCGAAGCUA | 20 | 7522 |
| BCL11A-5944 | - | GCGGUUGAAUCCAAUGGCUA | 20 | 7523 |
| BCL11A-5945 | + | UCGCACAGGUUGCACUUGUA | 20 | 7524 |
| BCL11A-5946 | + | UCAAAUUUCUCAGAACUUA | 20 | 7525 |
| BCL11A-5947 | + | GUCUCGGUGGUGGACUAAAC | 20 | 7526 |
| BCL11A-5948 | - | CCAACCUGAUCCCGGAGAAC | 20 | 7527 |
| BCL11A-5949 | - | CGGAGCACUCCUCGGAGAAC | 20 | 7528 |
| BCL11A-5950 | - | GUGCACCGGCGCAGCCACAC | 20 | 7529 |
| BCL11A-5951 | - | UGGCCGAGGCCGAGGGCCAC | 20 | 7530 |
| BCL11A-5952 | + | GGGUGCACGCGUGGUCGCAC | 20 | 7531 |
| BCL11A-5953 | - | AUCUCGGGGCGCAGCGGCAC | 20 | 7532 |
| BCL11A-5954 | + | UUGCAAGAGAAACCAUGCAC | 20 | 7533 |
| BCL11A-5955 | - | AGAGCAACCUGGUGGUGCAC | 20 | 7534 |
| BCL11A-5956 | + | CCAGCAGCAGCUUUUUGGAC | 20 | 7535 |
| BCL11A-5957 | + | UCGCAUGACUUGGACUUGAC | 20 | 7536 |
| BCL11A-5958 | - | AUCACCCGAGUGCCUUUGAC | 20 | 7537 |

TABLE 15C-continued

3rd Tier

| gRNA Name | DNA Strand | Targeting Domain | Target Site Length | SEQ ID NO: |
|---|---|---|---|---|
| BCL11A-5959 | − | GUUCAAAUUUCAGAGCAACC | 20 | 7538 |
| BCL11A-5960 | − | ACCGCCAGCUCCCCGGAACC | 20 | 7539 |
| BCL11A-5961 | + | GGCUGCGCCGGUGCACCACC | 20 | 7540 |
| BCL11A-5962 | − | GAAGCAUAAGCGCGGCCACC | 20 | 7541 |
| BCL11A-5963 | − | CUUCAGCGAGGCCUUCCACC | 20 | 7542 |
| BCL11A-5964 | + | UAUGCUUCUCGCCCAGGACC | 20 | 7543 |
| BCL11A-5965 | + | CGCAUGACUUGGACUUGACC | 20 | 7544 |
| BCL11A-5966 | − | UUUAACCUGCUAAGAAUACC | 20 | 7545 |
| BCL11A-5967 | + | AGGAAGGGCGGCUUGCUACC | 20 | 7546 |
| BCL11A-5968 | − | GUGCGACCACGCGUGCACCC | 20 | 7547 |
| BCL11A-5969 | − | UGAGAAAAUUUGAAGCCCCC | 20 | 7548 |
| BCL11A-5970 | + | GGGCCAUCUCUUCCGCCCCC | 20 | 7549 |
| BCL11A-5971 | − | CCCUCCUCCCUCCCAGCCCC | 20 | 7550 |
| BCL11A-5972 | − | GAAGGAGUUCGACCUGCCCC | 20 | 7551 |
| BCL11A-5973 | + | AUCCCUCCGUCCAGCUCCCC | 20 | 7552 |
| BCL11A-5974 | − | AAUGGCCGCGGCUGCUCCCC | 20 | 7553 |
| BCL11A-5975 | − | UCUAGCCCACCGCUGUCCCC | 20 | 7554 |
| BCL11A-5976 | − | UGCGCUUCUCCACACCGCCC | 20 | 7555 |
| BCL11A-5977 | + | CCCCCGAGGCCGACUCGCCC | 20 | 7556 |
| BCL11A-5978 | + | CGCGCUUAUGCUUCUCGCCC | 20 | 7557 |
| BCL11A-5979 | − | CAUAUUAGUGGUCCGGGCCC | 20 | 7558 |
| BCL11A-5980 | − | GGGGGCGGAAGAGAUGGCCC | 20 | 7559 |
| BCL11A-5981 | + | CUUUUGAGCUGGGCCUGCCC | 20 | 7560 |
| BCL11A-5982 | − | UCUCUCCACCGCCAGCUCCC | 20 | 7561 |
| BCL11A-5983 | + | GAUCCCUCCGUCCAGCUCCC | 20 | 7562 |
| BCL11A-5984 | − | UAAUGGCCGCGGCUGCUCCC | 20 | 7563 |
| BCL11A-5985 | − | UUACUGCAACCAUUCCAGCC | 20 | 7564 |
| BCL11A-5986 | − | CUACGGCUUCGGGCUGAGCC | 20 | 7565 |
| BCL11A-5987 | − | UUGCGCUUCUCCACACCGCC | 20 | 7566 |
| BCL11A-5988 | − | CCCCCACCGCAUAGAGCGCC | 20 | 7567 |
| BCL11A-5989 | + | CCCCCCGAGGCCGACUCGCC | 20 | 7568 |
| BCL11A-5990 | + | GAGGGAGGGGGGCGUCGCC | 20 | 7569 |
| BCL11A-5991 | + | UGCAUAGGGCUGGGCCGGCC | 20 | 7570 |
| BCL11A-5992 | − | AUCGAGAGAGGCUUCCGGCC | 20 | 7571 |
| BCL11A-5993 | + | CCGUGUUGGGCAUCGCGGCC | 20 | 7572 |
| BCL11A-5994 | + | UGUGGCCCUCGGCCUCGGCC | 20 | 7573 |
| BCL11A-5995 | + | GAGCUGGGCCUGCCCGGGCC | 20 | 7574 |

TABLE 15C-continued

3rd Tier

| gRNA Name | DNA Strand | Targeting Domain | Target Site Length | SEQ ID NO: |
|---|---|---|---|---|
| BCL11A-5996 | − | CCAUAUUAGUGGUCCGGGCC | 20 | 7575 |
| BCL11A-5997 | + | GGCGCUUCAGCUUGCUGGCC | 20 | 7576 |
| BCL11A-5998 | + | CACUCGGGUGAUGGGUGGCC | 20 | 7577 |
| BCL11A-5999 | + | UCUUUUGAGCUGGGCCUGCC | 20 | 7578 |
| BCL11A-6000 | + | GAAGGGAUCUUUGAGCUGCC | 20 | 7579 |
| BCL11A-6001 | + | GUGGAAAGCGCCCUUCUGCC | 20 | 7580 |
| BCL11A-6002 | + | CCCACCAAGUCGCUGGUGCC | 20 | 7581 |
| BCL11A-6003 | + | GCCUCUCUCGAUACUGAUCC | 20 | 7582 |
| BCL11A-6004 | − | GAACGACCCCAACCUGAUCC | 20 | 7583 |
| BCL11A-6005 | + | CGUGGUGGCGCGCCGCCUCC | 20 | 7584 |
| BCL11A-6006 | − | UCGCCGGCUACGCGGCCUCC | 20 | 7585 |
| BCL11A-6007 | + | CCUCCUCGUCCCCGUUCUCC | 20 | 7586 |
| BCL11A-6008 | − | CGAGGCCUUCCACCAGGUCC | 20 | 7587 |
| BCL11A-6009 | − | ACGCCCCAUAUUAGUGGUCC | 20 | 7588 |
| BCL11A-6010 | − | AGGUAGCAAGCCGCCCUUCC | 20 | 7589 |
| BCL11A-6011 | + | AGUCGCUGGUGCCGGGUUCC | 20 | 7590 |
| BCL11A-6012 | − | CUCUAGGAGACUUAGAGAGC | 20 | 7591 |
| BCL11A-6013 | + | AGAGAAGGGGCUCAGCGAGC | 20 | 7592 |
| BCL11A-6014 | − | CUCCACACCGCCCGGGGAGC | 20 | 7593 |
| BCL11A-6015 | + | GGUGCCGGGUUCCGGGGAGC | 20 | 7594 |
| BCL11A-6016 | + | GCGUCUGCCCUCUUUUGAGC | 20 | 7595 |
| BCL11A-6017 | + | CUGCCUGGAGGCCGCGUAGC | 20 | 7596 |
| BCL11A-6018 | + | CUGAUCCUGGUAUUCUUAGC | 20 | 7597 |
| BCL11A-6019 | + | CUGAAGGGAUACCAACCCGC | 20 | 7598 |
| BCL11A-6020 | − | CGGAAGUCCCCUGACCCCGC | 20 | 7599 |
| BCL11A-6021 | + | UCUCGCCCGUGUGGCUGCGC | 20 | 7600 |
| BCL11A-6022 | + | GUCUAUGCGGUCCGACUCGC | 20 | 7601 |
| BCL11A-6023 | − | CCACCACGAGAACAGCUCGC | 20 | 7602 |
| BCL11A-6024 | − | GUGUACUCGCAGUGGCUCGC | 20 | 7603 |
| BCL11A-6025 | + | GGCGCUGCCCACCAAGUCGC | 20 | 7604 |
| BCL11A-6026 | − | GCCCACCGCUGUCCCCAGGC | 20 | 7605 |
| BCL11A-6027 | + | AAAGCGCCCUUCUGCCAGGC | 20 | 7606 |
| BCL11A-6028 | + | UCCGUGUUGGGCAUCGCGGC | 20 | 7607 |
| BCL11A-6029 | + | CAGUAACCUUUGCAUAGGGC | 20 | 7608 |
| BCL11A-6030 | − | UUAGUGGUCCGGGCCCGGGC | 20 | 7609 |
| BCL11A-6031 | + | UGCCCUGCAUGACGUCGGGC | 20 | 7610 |
| BCL11A-6032 | + | ACUUGGACUUGACCGGGGGC | 20 | 7611 |
| BCL11A-6033 | + | UGGGCAUCGCGGCCGGGGGC | 20 | 7612 |

TABLE 15C-continued

| | | 3rd Tier | | |
|---|---|---|---|---|
| gRNA Name | DNA Strand | Targeting Domain | Target Site Length | SEQ ID NO: |
| BCL11A-6034 | + | ACCUUUGCAUAGGGCUGGGC | 20 | 7613 |
| BCL11A-6035 | + | CUCCUAGAGAAAUCCAUGGC | 20 | 7614 |
| BCL11A-6036 | + | AGGGCGGCUUGCUACCUGGC | 20 | 7615 |
| BCL11A-6037 | − | AGGAGACUUAGAGAGCUGGC | 20 | 7616 |
| BCL11A-6038 | + | GAAUCCCAUGGAGAGGUGGC | 20 | 7617 |
| BCL11A-6039 | − | UGCGACGAAGACUCGGUGGC | 20 | 7618 |
| BCL11A-6040 | − | CGCCCUGCCCGACGUCAUGC | 20 | 7619 |
| BCL11A-5467 | + | AGUUGUACAUGUGUAGCUGC | 20 | 7620 |
| BCL11A-6041 | + | CACGGACUUGAGCGCGCUGC | 20 | 7621 |
| BCL11A-6042 | − | CCUGUCCAAAAGCUGCUGC | 20 | 7622 |
| BCL11A-6043 | + | GCCCACCAAGUCGCUGGUGC | 20 | 7623 |
| BCL11A-6044 | + | CAUGUGGCGCUUCAGCUUGC | 20 | 7624 |
| BCL11A-6045 | + | CGUCCCCGUUCUCCGGGAUC | 20 | 7625 |
| BCL11A-6046 | + | GCACCCUGUCAAAGGCACUC | 20 | 7626 |
| BCL11A-6047 | − | UCCCCGGGCGAGUCGGCCUC | 20 | 7627 |
| BCL11A-6048 | − | GAGCUGGACGGAGGGAUCUC | 20 | 7628 |
| BCL11A-6049 | + | GCCACACAUCUUGAGCUCUC | 20 | 7629 |
| BCL11A-6050 | + | UCCUCCUCGUCCCCGUUCUC | 20 | 7630 |
| BCL11A-6051 | + | ACCAUGCCCUGCAUGACGUC | 20 | 7631 |
| BCL11A-6052 | + | GGAUACCAACCCGCGGGGUC | 20 | 7632 |
| BCL11A-6053 | − | CACGCCCCAUAUUAGUGGUC | 20 | 7633 |
| BCL11A-6054 | + | GGAGGCAAAAGGCGAUUGUC | 20 | 7634 |
| BCL11A-6055 | − | CCGCGGGUUGGUAUCCCUUC | 20 | 7635 |
| BCL11A-6056 | − | UCAGUAUCGAGAGAGGCUUC | 20 | 7636 |
| BCL11A-6057 | − | AGAGGGUGGACUACGGCUUC | 20 | 7637 |
| BCL11A-6058 | + | AAGUCGCUGGUGCCGGGUUC | 20 | 7638 |
| BCL11A-6059 | − | GGGCAGGCCCAGCUCAAAAG | 20 | 7639 |
| BCL11A-6060 | + | UGUGUGAAGAACCUAGAAAG | 20 | 7640 |
| BCL11A-6061 | + | GUAUUCUUAGCAGGUUAAAG | 20 | 7641 |
| BCL11A-3449 | − | CGACGAGGAAGAGGAAGAAG | 20 | 7642 |
| BCL11A-6062 | + | GCUUGAUGCGCUUAGAGAAG | 20 | 7643 |
| BCL11A-3448 | − | AGAGGAGGACGACGAGGAAG | 20 | 7644 |
| BCL11A-3453 | − | AGAGGAAGAAGAGGAGGAAG | 20 | 7645 |
| BCL11A-3441 | − | GAACGGGACGAGGAGGAAG | 20 | 7646 |
| BCL11A-3376 | − | GGGCGCAGCGGCACGGGAAG | 20 | 7647 |
| BCL11A-6063 | + | CUCGGUGGUGGACUAAACAG | 20 | 7648 |
| BCL11A-6064 | + | UAGAAAGAGGUUGGAGACAG | 20 | 7649 |

TABLE 15C-continued

3rd Tier

| gRNA Name | DNA Strand | Targeting Domain | Target Site Length | SEQ ID NO: |
|---|---|---|---|---|
| BCL11A-6065 | + | CUGGGCCGGCCUGGGGACAG | 20 | 7650 |
| BCL11A-6066 | – | AGAAAAUUUGAAGCCCCCAG | 20 | 7651 |
| BCL11A-6067 | – | GGAGGGAUCUCGGGGCGCAG | 20 | 7652 |
| BCL11A-6068 | – | CGGAGAACGUGUACUCGCAG | 20 | 7653 |
| BCL11A-6069 | + | GGAGGAGGGGCGGAUUGCAG | 20 | 7654 |
| BCL11A-6070 | + | AUACCAACCCGCGGGGUCAG | 20 | 7655 |
| BCL11A-6071 | – | ACCAGGAUCAGUAUCGAGAG | 20 | 7656 |
| BCL11A-6072 | – | AGGAGCUGACGGAGAGCGAG | 20 | 7657 |
| BCL11A-6073 | + | AGAGGUUGGAGACAGAGGAG | 20 | 7658 |
| BCL11A-6074 | + | CGGGGGCUGGGAGGGAGGAG | 20 | 7659 |
| BCL11A-6075 | + | GCGGAUUGCAGAGGAGGGAG | 20 | 7660 |
| BCL11A-6076 | + | UGGACUAAACAGGGGGGGAG | 20 | 7661 |
| BCL11A-6077 | + | GCAAUAUGAAUCCCAUGGAG | 20 | 7662 |
| BCL11A-6078 | – | GGGAGCACGCCCCAUAUUAG | 20 | 7663 |
| BCL11A-6079 | – | CAACCUGAUCCCGGAGAACG | 20 | 7664 |
| BCL11A-3450 | – | GGAGGAAGAGGAGGACGACG | 20 | 7665 |
| BCL11A-6080 | + | CUCCGAGGAGUGCUCCGACG | 20 | 7666 |
| BCL11A-6081 | – | GAUCCCGGAGAACGGGGACG | 20 | 7667 |
| BCL11A-6082 | – | GCAGUGGCUCGCCGGCUACG | 20 | 7668 |
| BCL11A-6083 | + | GCAUGACUUGGACUUGACCG | 20 | 7669 |
| BCL11A-6084 | + | CCUGAAGGGAUACCAACCCG | 20 | 7670 |
| BCL11A-6085 | – | ACGGAAGUCCCCUGACCCCG | 20 | 7671 |
| BCL11A-6086 | + | CUUUUUGGACAGGCCCCCCG | 20 | 7672 |
| BCL11A-6087 | – | GCGCUUCUCCACACCGCCCG | 20 | 7673 |
| BCL11A-6088 | + | CCCCGAGGCCGACUCGCCCG | 20 | 7674 |
| BCL11A-6089 | + | ACUCGCCCGGGGAGCAGCCG | 20 | 7675 |
| BCL11A-6090 | – | CGGCCACCUGGCCGAGGCCG | 20 | 7676 |
| BCL11A-6091 | + | CGUGUUGGGCAUCGCGGCCG | 20 | 7677 |
| BCL11A-6092 | – | GAUGGCACUGUUAAUGGCCG | 20 | 7678 |
| BCL11A-6093 | – | UAAGCGCGGCCACCUGGCCG | 20 | 7679 |
| BCL11A-6094 | + | GCGCAAACUCCCGUUCUCCG | 20 | 7680 |
| BCL11A-6095 | – | CAGCAGCGCGCUCAAGUCCG | 20 | 7681 |
| BCL11A-6096 | + | GUCGCUGGUGCCGGGUUCCG | 20 | 7682 |
| BCL11A-6097 | – | CUGGGCGAGAAGCAUAAGCG | 20 | 7683 |
| BCL11A-6098 | – | CUCCAUGCAGCACUUCAGCG | 20 | 7684 |
| BCL11A-6099 | + | UGCUGGCCUGGGUGCACGCG | 20 | 7685 |
| BCL11A-6100 | + | UGAAGGGAUACCAACCCGCG | 20 | 7686 |
| BCL11A-6101 | – | CACCACGAGAACAGCUCGCG | 20 | 7687 |

TABLE 15C-continued

3rd Tier

| gRNA Name | DNA Strand | Targeting Domain | Target Site Length | SEQ ID NO: |
|---|---|---|---|---|
| BCL11A-6102 | + | GCAUGACGUCGGGCAGGGCG | 20 | 7688 |
| BCL11A-6103 | - | CGAGAACAGCUCGCGGGGCG | 20 | 7689 |
| BCL11A-6104 | - | GCGGGCGCGGUCGUGGGCG | 20 | 7690 |
| BCL11A-6105 | + | GUUCUCCGUGUUGGGCAUCG | 20 | 7691 |
| BCL11A-6106 | - | CCCCGGGCGAGUCGGCCUCG | 20 | 7692 |
| BCL11A-6107 | - | GCCACCACGAGAACAGCUCG | 20 | 7693 |
| BCL11A-6108 | - | AGCUGGACGGAGGGAUCUCG | 20 | 7694 |
| BCL11A-6109 | + | CGCCCCGCGAGCUGUUCUCG | 20 | 7695 |
| BCL11A-6110 | - | CAGCUCGCGGGGCGCGGUCG | 20 | 7696 |
| BCL11A-6111 | + | UCGGUGGUGGACUAAACAGG | 20 | 7697 |
| BCL11A-6112 | + | GGCCCUCGGCCUCGGCCAGG | 20 | 7698 |
| BCL11A-3451 | - | CGAGGAAGAGGAAGAAGAGG | 20 | 7699 |
| BCL11A-3452 | - | GGAAGAAGAGGAGGAAGAGG | 20 | 7700 |
| BCL11A-3445 | - | CGGGGACGAGGAGGAAGAGG | 20 | 7701 |
| BCL11A-6113 | + | AAAGAGGUUGGAGACAGAGG | 20 | 7702 |
| BCL11A-6114 | + | GGAGGGGCGGAUUGCAGAGG | 20 | 7703 |
| BCL11A-6115 | + | AUAUGAAUCCCAUGGAGAGG | 20 | 7704 |
| BCL11A-6116 | + | CGAGGAGUGCUCCGACGAGG | 20 | 7705 |
| BCL11A-3330 | - | CCCGGAGAACGGGACGAGG | 20 | 7706 |
| BCL11A-3454 | - | AGAAGAGGAGGAAGAGGAGG | 20 | 7707 |
| BCL11A-6117 | + | GAGGUUGGAGACAGAGGAGG | 20 | 7708 |
| BCL11A-3455 | - | AGAGGAGGAAGAGGAGGAGG | 20 | 7709 |
| BCL11A-6118 | + | CGGAUUGCAGAGGAGGGAGG | 20 | 7710 |
| BCL11A-6119 | + | ACCGGGGGCUGGGAGGGAGG | 20 | 7711 |
| BCL11A-6120 | - | CUUCGGGCUGAGCCUGGAGG | 20 | 7712 |
| BCL11A-6121 | - | CCGCCCGGGGAGCUGGACGG | 20 | 7713 |
| BCL11A-6122 | + | CAUGACUUGGACUUGACCGG | 20 | 7714 |
| BCL11A-6123 | + | GUGUUGGGCAUCGCGGCCGG | 20 | 7715 |
| BCL11A-6124 | + | GGCCGGCCUGGGGACAGCGG | 20 | 7716 |
| BCL11A-6125 | + | GGGUUCCGGGGAGCUGGCGG | 20 | 7717 |
| BCL11A-6126 | + | CCCCCAGGCGCUCUAUGCGG | 20 | 7718 |
| BCL11A-6127 | - | CACUUGCGACGAAGACUCGG | 20 | 7719 |
| BCL11A-6128 | - | CCCGGGCGAGUCGGCCUCGG | 20 | 7720 |
| BCL11A-6129 | + | GGGUCCAAGUGAUGUCUCGG | 20 | 7721 |
| BCL11A-6130 | + | GGGGGCGUCGCCAGGAAGGG | 20 | 7722 |
| BCL11A-6131 | + | CGGUGGUGGACUAAACAGGG | 20 | 7723 |
| BCL11A-6132 | - | GCUGACGGAGAGCGAGAGGG | 20 | 7724 |

TABLE 15C-continued

3rd Tier

| gRNA Name | DNA Strand | Targeting Domain | Target Site Length | SEQ ID NO: |
|---|---|---|---|---|
| BCL11A-6133 | + | GGGCGGAUUGCAGAGGAGGG | 20 | 7725 |
| BCL11A-6134 | + | GGAUUGCAGAGGAGGGAGGG | 20 | 7726 |
| BCL11A-6135 | + | UUGACCGGGGCUGGGAGGG | 20 | 7727 |
| BCL11A-6136 | + | CCUCCGUCCAGCUCCCCGGG | 20 | 7728 |
| BCL11A-6137 | + | CUAGAGAAAUCCAUGGCGGG | 20 | 7729 |
| BCL11A-6138 | − | CCGGGCGAGUCGGCCUCGGG | 20 | 7730 |
| BCL11A-6139 | + | GGUGGUGGACUAAACAGGGG | 20 | 7731 |
| BCL11A-6140 | − | AAAUUUGAAGCCCCCAGGGG | 20 | 7732 |
| BCL11A-6141 | + | GGGCUGGGAGGGAGGAGGGG | 20 | 7733 |
| BCL11A-6142 | + | GAUUGCAGAGGAGGGAGGGG | 20 | 7734 |
| BCL11A-6143 | − | CCGCAUAGAGCGCCUGGGGG | 20 | 7735 |
| BCL11A-6144 | − | UGAAGCCCCCAGGGGUGGGG | 20 | 7736 |
| BCL11A-6145 | + | AAAGGCACUCGGGUGAUGGG | 20 | 7737 |
| BCL11A-6146 | + | GGACUUGACCGGGGCUGGG | 20 | 7738 |
| BCL11A-6147 | + | CUAAACAGGGGGGAGUGGG | 20 | 7739 |
| BCL11A-6148 | + | CUGGGUACUACGCCGAAUGG | 20 | 7740 |
| BCL11A-6149 | + | UCUCCUAGAGAAAUCCAUGG | 20 | 7741 |
| BCL11A-6150 | + | GUCGGACUUGACCGUCAUGG | 20 | 7742 |
| BCL11A-6151 | − | CAAAUUUCAGAGCAACCUGG | 20 | 7743 |
| BCL11A-6152 | + | GCUUCUCGCCCAGGACCUGG | 20 | 7744 |
| BCL11A-6153 | − | CGGCUUCGGGCUGAGCCUGG | 20 | 7745 |
| BCL11A-6154 | − | CCACCGCAUAGAGCGCCUGG | 20 | 7746 |
| BCL11A-6155 | + | GGGAUCUUUGAGCUGCCUGG | 20 | 7747 |
| BCL11A-6156 | + | GCCGGGUUCCGGGGAGCUGG | 20 | 7748 |
| BCL11A-6157 | − | CGCAGCGGCACGGGAAGUGG | 20 | 7749 |
| BCL11A-6158 | − | CAGCGCGCUCAAGUCCGUGG | 20 | 7750 |
| BCL11A-6159 | + | CCCGCGAGCUGUUCUCGUGG | 20 | 7751 |
| BCL11A-6160 | + | CCAGGCGCUCUAUGCGGUGG | 20 | 7752 |
| BCL11A-6161 | + | UCCAAGUGAUGUCUCGGUGG | 20 | 7753 |
| BCL11A-6162 | − | ACCCGGCACCAGCGACUUGG | 20 | 7754 |
| BCL11A-6163 | + | UCUGGGUACUACGCCGAAUG | 20 | 7755 |
| BCL11A-6164 | + | CGUCGGACUUGACCGUCAUG | 20 | 7756 |
| BCL11A-6165 | + | UGUGCAUGUGCGUCUUCAUG | 20 | 7757 |
| BCL11A-6166 | + | GGGCCCGGACCACUAAUAUG | 20 | 7758 |
| BCL11A-6167 | + | CCGCCCCAGGCGCUCUAUG | 20 | 7759 |
| BCL11A-6168 | + | UAACAGUGCCAUCGUCUAUG | 20 | 7760 |
| BCL11A-6169 | − | AGCGACACUUGUGAGUACUG | 20 | 7761 |
| BCL11A-6170 | + | CUUCGUCGCAAGUGUCCCUG | 20 | 7762 |

TABLE 15C-continued

3rd Tier

| gRNA Name | DNA Strand | Targeting Domain | Target Site Length | SEQ ID NO: |
|---|---|---|---|---|
| BCL11A-6171 | - | CCCACCGCAUAGAGCGCCUG | 20 | 7763 |
| BCL11A-6172 | + | CAUAGGGCUGGGCCGGCCUG | 20 | 7764 |
| BCL11A-6173 | + | AGAAGGGGCUCAGCGAGCUG | 20 | 7765 |
| BCL11A-6174 | - | GUGCCUUUGACAGGGUGCUG | 20 | 7766 |
| BCL11A-6175 | - | UCCAAGUCAUGCGAGUUCUG | 20 | 7767 |
| BCL11A-6176 | + | UGUAGGGCUUCUCGCCCGUG | 20 | 7768 |
| BCL11A-6177 | + | GUCCAGCUCCCCGGGCGGUG | 20 | 7769 |
| BCL11A-6178 | + | CCCAGGCGCUCUAUGCGGUG | 20 | 7770 |
| BCL11A-6179 | - | AUUUGAAGCCCCCAGGGGUG | 20 | 7771 |
| BCL11A-6180 | - | CCCAGAGAGCUCAAGAUGUG | 20 | 7772 |
| BCL11A-6181 | + | CGUUCUCCGGGAUCAGGUUG | 20 | 7773 |
| BCL11A-6182 | + | CUCUGGGUACUACGCCGAAU | 20 | 7774 |
| BCL11A-6183 | + | GCGGGAGGCUCCAUAGCCAU | 20 | 7775 |
| BCL11A-6184 | - | CUUCCCAGCCACCUCUCCAU | 20 | 7776 |
| BCL11A-6185 | + | GGUUGCAGUAACCUUUGCAU | 20 | 7777 |
| BCL11A-6186 | + | UCGUCGGACUUGACCGUCAU | 20 | 7778 |
| BCL11A-6187 | + | GUCAAAGGCACUCGGGUGAU | 20 | 7779 |
| BCL11A-6188 | + | CGGGCCCGGACCACUAAUAU | 20 | 7780 |
| BCL11A-6189 | + | GUCGUUCUCGCUCUUGAACU | 20 | 7781 |
| BCL11A-6190 | + | AGCACCCUGUCAAAGGCACU | 20 | 7782 |
| BCL11A-6191 | - | UCCACCACCGAGACAUCACU | 20 | 7783 |
| BCL11A-6192 | - | GGACACUUGCGACGAAGACU | 20 | 7784 |
| BCL11A-6193 | - | GGAACCCGGCACCAGCGACU | 20 | 7785 |
| BCL11A-6194 | - | GUUGGUAUCCCUUCAGGACU | 20 | 7786 |
| BCL11A-6195 | + | GCCGCAGAACUCGCAUGACU | 20 | 7787 |
| BCL11A-6196 | + | GCAAGUGUCCCUGUGGCCCU | 20 | 7788 |
| BCL11A-6197 | - | CCCCACCGCAUAGAGCGCCU | 20 | 7789 |
| BCL11A-6198 | + | GCAUAGGGCUGGGCCGGCCU | 20 | 7790 |
| BCL11A-6199 | + | GUCCCUGUGGCCCUCGGCCU | 20 | 7791 |
| BCL11A-6200 | - | CUCCCCGGGCGAGUCGGCCU | 20 | 7792 |
| BCL11A-6201 | + | GCGCUUCAGCUUGCUGGCCU | 20 | 7793 |
| BCL11A-6202 | - | CUCCUCGUCGGAGCACUCCU | 20 | 7794 |
| BCL11A-6203 | - | GAGGCCUUCCACCAGGUCCU | 20 | 7795 |
| BCL11A-6204 | + | GAGAAGGGGCUCAGCGAGCU | 20 | 7796 |
| BCL11A-6205 | + | CGUCUGCCCUCUUUUGAGCU | 20 | 7797 |
| BCL11A-6206 | + | AGUAACCUUUGCAUAGGGCU | 20 | 7798 |
| BCL11A-6207 | + | CUUGGACUUGACCGGGGCU | 20 | 7799 |

TABLE 15C-continued

3rd Tier

| gRNA Name | DNA Strand | Targeting Domain | Target Site Length | SEQ ID NO: |
|---|---|---|---|---|
| BCL11A-6208 | + | AAUCCCAUGGAGAGGUGGCU | 20 | 7800 |
| BCL11A-5508 | + | GUUGUACAUGUGUAGCUGCU | 20 | 7801 |
| BCL11A-6209 | - | CUGUCCAAAAGCUGCUGCU | 20 | 7802 |
| BCL11A-6210 | - | GGAGCUGGACGGAGGGAUCU | 20 | 7803 |
| BCL11A-6211 | + | CCACACAUCUUGAGCUCUCU | 20 | 7804 |
| BCL11A-6212 | - | CUCCCGCCAUGGAUUUCUCU | 20 | 7805 |
| BCL11A-6213 | + | UGGGGGUCCAAGUGAUGUCU | 20 | 7806 |
| BCL11A-6214 | - | UCUGUCUCCAACCUCUUUCU | 20 | 7807 |
| BCL11A-6215 | - | AGACUCGGUGGCCGGCGAGU | 20 | 7808 |
| BCL11A-6216 | - | CGGCUGCUCCCCGGGCGAGU | 20 | 7809 |
| BCL11A-6217 | + | GGACUAAACAGGGGGGGAGU | 20 | 7810 |
| BCL11A-6218 | + | CACCAUGCCCUGCAUGACGU | 20 | 7811 |
| BCL11A-6219 | - | CGGGGCGCGGUCGUGGGCGU | 20 | 7812 |
| BCL11A-6220 | - | AUCGCCUUUUGCCUCCUCGU | 20 | 7813 |
| BCL11A-6221 | + | GGCGGUGGAGAGACCGUCGU | 20 | 7814 |
| BCL11A-6222 | - | AGCUCGCGGGGCGCGGUCGU | 20 | 7815 |
| BCL11A-6223 | + | CCCGUUCUCCGGGAUCAGGU | 20 | 7816 |
| BCL11A-6224 | + | UGAAGAACCUAGAAAGAGGU | 20 | 7817 |
| BCL11A-6225 | + | GCCGGCCUGGGGACAGCGGU | 20 | 7818 |
| BCL11A-6226 | + | CCCCAGGCGCUCUAUGCGGU | 20 | 7819 |
| BCL11A-6227 | - | AGUCCCUGACCCCGCGGGU | 20 | 7820 |
| BCL11A-6228 | - | AAUUUGAAGCCCCCAGGGGU | 20 | 7821 |
| BCL11A-6229 | - | CCCGGCACCAGCGACUUGGU | 20 | 7822 |
| BCL11A-6230 | - | GCGACACUUGUGAGUACUGU | 20 | 7823 |
| BCL11A-6231 | + | CGAGUACACGUUCUCCGUGU | 20 | 7824 |
| BCL11A-6232 | + | GUCGCACAGGUUGCACUUGU | 20 | 7825 |
| BCL11A-6233 | - | GUUCUUCACACACCCCCAUU | 20 | 7826 |
| BCL11A-6234 | - | AAAGAUCCCUUCCUUAGCUU | 20 | 7827 |
| BCL11A-6235 | - | GAGAGGGUGGACUACGGCUU | 20 | 7828 |
| BCL11A-6236 | + | CCGUUCUCCGGGAUCAGGUU | 20 | 7829 |
| BCL11A-6237 | + | GAGUACACGUUCUCCGUGUU | 20 | 7830 |
| BCL11A-6238 | + | GCUGCCCAGCAGCAGCUUUU | 20 | 7831 |
| BCL11A-6239 | - | UCAAGAUGUGUGGCAGUUUU | 20 | 7832 |

Table 15D provides targeting domains for knocking out the BCL11A gene by dual targeting (e.g., dual single strand cleavages). In an embodiment, dual targeting (e.g., dual nicking) is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. Exemplary nickase pairs include a targeting domain from Group A and a second targeting domain from Group B, or include a targeting domain from Group C and a second targeting domain from Group D. It is contemplated herein that in an embodiment a targeting domain of Group A can be combined with any of the targeting domains of Group B; in an embodiment a targeting domain of Group C can be combined with any of the targeting domains of Group D. Exemplary gRNA pairs to be used with *S. pyogenes* Cas9 are shown in Table 15D, e.g., BCL11A-5355 or BCL11A-5380 can be combined with BCL11A-5321 or BCL11A-5416; or BCL11A-5333, BCL11A-5354, or BCL11A-5329 can be combined with BCL11A-5367 or BCL11A-5341.

TABLE 15D

| Group A | Group B |
|---|---|
| BCL11A-5355, BCL11A-5380 | BCL11A-5321, BCL11A-5416 |
| Group C | Group D |
| BCL11A-5333, BCL11A-5354, BCL11A-5329 | BCL11A-5367, BCL11A-5341 |

Table 16A provides exemplary targeting domains for knocking out the BCL11A gene selected according to the first tier parameters. The targeting domains bind within the first 500 bp of the coding sequence (e.g., within 500 bp downstream from the start codon) and have a high level of orthogonality, and the PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 16A

1st Tier

| gRNA Name | DNA Strand | Targeting Domain | Target Site Length | SEQ ID NO: |
|---|---|---|---|---|
| BCL11A-6240 | + | UGACCUGGAUGCCAACCUCCA | 21 | 7833 |
| BCL11A-6241 | + | GUGACCUGGAUGCCAACCUCCA | 22 | 7834 |
| BCL11A-6242 | + | CGUGACCUGGAUGCCAACCUCCA | 23 | 7835 |
| BCL11A-6243 | + | GCGUGACCUGGAUGCCAACCUCCA | 24 | 7836 |
| BCL11A-6244 | + | AUGCCAACCUCCACGGGA | 18 | 7837 |
| BCL11A-6245 | + | GAUGCCAACCUCCACGGGA | 19 | 7838 |
| BCL11A-6246 | + | GGAUGCCAACCUCCACGGGA | 20 | 7839 |
| BCL11A-6247 | + | UGGAUGCCAACCUCCACGGGA | 21 | 7840 |
| BCL11A-6248 | + | CUGGAUGCCAACCUCCACGGGA | 22 | 7841 |
| BCL11A-6249 | + | CCUGGAUGCCAACCUCCACGGGA | 23 | 7842 |
| BCL11A-6250 | + | ACCUGGAUGCCAACCUCCACGGGA | 24 | 7843 |
| BCL11A-6251 | + | GUCAUCCUCUGGCGUGAC | 18 | 7844 |
| BCL11A-6252 | + | CGUCAUCCUCUGGCGUGAC | 19 | 7845 |
| BCL11A-6253 | + | UCGUCAUCCUCUGGCGUGAC | 20 | 7846 |
| BCL11A-6254 | + | AUCGUCAUCCUCUGGCGUGAC | 21 | 7847 |
| BCL11A-6255 | + | AAUCGUCAUCCUCUGGCGUGAC | 22 | 7848 |
| BCL11A-6256 | + | CAAUCGUCAUCCUCUGGCGUGAC | 23 | 7849 |
| BCL11A-6257 | + | ACAAUCGUCAUCCUCUGGCGUGAC | 24 | 7850 |
| BCL11A-6258 | + | UUAUUGGGUUACUUACGC | 18 | 7851 |
| BCL11A-6259 | + | AUUAUUGGGUUACUUACGC | 19 | 7852 |
| BCL11A-6260 | + | UAUUAUUGGGUUACUUACGC | 20 | 7853 |
| BCL11A-6261 | + | CUAUUAUUGGGUUACUUACGC | 21 | 7854 |
| BCL11A-6262 | + | ACUAUUAUUGGGUUACUUACGC | 22 | 7855 |

TABLE 16A-continued

1st Tier

| gRNA Name | DNA Strand | Targeting Domain | Target Site Length | SEQ ID NO: |
|---|---|---|---|---|
| BCL11A-6263 | + | UACUAUUAUUGGGUUACUUACGC | 23 | 7856 |
| BCL11A-6264 | + | UUACUAUUAUUGGGUUACUUACGC | 24 | 7857 |
| BCL11A-6265 | + | UCCCGUUUGCUUAAGUGC | 18 | 7858 |
| BCL11A-6266 | + | UUCCCGUUUGCUUAAGUGC | 19 | 7859 |
| BCL11A-5352 | + | AUUCCCGUUUGCUUAAGUGC | 20 | 7860 |
| BCL11A-6267 | + | AAUUCCCGUUUGCUUAAGUGC | 21 | 7861 |
| BCL11A-6268 | + | GAAUUCCCGUUUGCUUAAGUGC | 22 | 7862 |
| BCL11A-6269 | + | AGAAUUCCCGUUUGCUUAAGUGC | 23 | 7863 |
| BCL11A-6270 | + | GAGAAUUCCCGUUUGCUUAAGUGC | 24 | 7864 |
| BCL11A-6271 | + | UUUGUGCUCGAUAAAAAU | 18 | 7865 |
| BCL11A-6272 | + | GUUUGUGCUCGAUAAAAAU | 19 | 7866 |
| BCL11A-6273 | + | CGUUUGUGCUCGAUAAAAAU | 20 | 7867 |
| BCL11A-6274 | + | CCGUUUGUGCUCGAUAAAAAU | 21 | 7868 |
| BCL11A-6275 | + | UCCGUUUGUGCUCGAUAAAAAU | 22 | 7869 |
| BCL11A-6276 | + | UUCCGUUUGUGCUCGAUAAAAAU | 23 | 7870 |
| BCL11A-6277 | + | UUUCCGUUUGUGCUCGAUAAAAAU | 24 | 7871 |
| BCL11A-6278 | + | UGCACUCAUCCCAGGCGU | 18 | 7872 |
| BCL11A-6279 | + | CUGCACUCAUCCCAGGCGU | 19 | 7873 |
| BCL11A-5510 | + | UCUGCACUCAUCCCAGGCGU | 20 | 7874 |
| BCL11A-6280 | + | UUCUGCACUCAUCCCAGGCGU | 21 | 7875 |
| BCL11A-6281 | + | AUUCUGCACUCAUCCCAGGCGU | 22 | 7876 |
| BCL11A-6282 | + | UAUUCUGCACUCAUCCCAGGCGU | 23 | 7877 |
| BCL11A-6283 | + | AUAUUCUGCACUCAUCCCAGGCGU | 24 | 7878 |
| BCL11A-6284 | + | GUCUGGUUCAUCAUCUGU | 18 | 7879 |
| BCL11A-6285 | + | GGUCUGGUUCAUCAUCUGU | 19 | 7880 |
| BCL11A-6286 | + | UGGUCUGGUUCAUCAUCUGU | 20 | 7881 |
| BCL11A-6287 | + | GUGGUCUGGUUCAUCAUCUGU | 21 | 7882 |
| BCL11A-6288 | + | CGUGGUCUGGUUCAUCAUCUGU | 22 | 7883 |
| BCL11A-6289 | + | CCGUGGUCUGGUUCAUCAUCUGU | 23 | 7884 |
| BCL11A-6290 | + | GCCGUGGUCUGGUUCAUCAUCUGU | 24 | 7885 |
| BCL11A-6291 | − | CCGUUGGGAGCUCCAGAA | 18 | 7886 |
| BCL11A-6292 | − | CCCGUUGGGAGCUCCAGAA | 19 | 7887 |
| BCL11A-5447 | − | GCCCGUUGGGAGCUCCAGAA | 20 | 7888 |
| BCL11A-6293 | − | GGCCCGUUGGGAGCUCCAGAA | 21 | 7889 |
| BCL11A-6294 | − | CGGCCCGUUGGGAGCUCCAGAA | 22 | 7890 |
| BCL11A-6295 | − | ACGGCCCGUUGGGAGCUCCAGAA | 23 | 7891 |
| BCL11A-6296 | − | CACGGCCCGUUGGGAGCUCCAGAA | 24 | 7892 |

TABLE 16A-continued

1st Tier

| gRNA Name | DNA Strand | Targeting Domain | Target Site Length | SEQ ID NO: |
|---|---|---|---|---|
| BCL11A-6297 | – | GGCAUCCAGGUCACGCCA | 18 | 7893 |
| BCL11A-6298 | – | UGGCAUCCAGGUCACGCCA | 19 | 7894 |
| BCL11A-6299 | – | UUGGCAUCCAGGUCACGCCA | 20 | 7895 |
| BCL11A-6300 | – | GUUGGCAUCCAGGUCACGCCA | 21 | 7896 |
| BCL11A-6301 | – | GGUUGGCAUCCAGGUCACGCCA | 22 | 7897 |
| BCL11A-6302 | – | AGGUUGGCAUCCAGGUCACGCCA | 23 | 7898 |
| BCL11A-6303 | – | GAGGUUGGCAUCCAGGUCACGCCA | 24 | 7899 |
| BCL11A-6304 | – | AACCCCAGCACUUAAGCAAAC | 21 | 7900 |
| BCL11A-6305 | – | AAACCCCAGCACUUAAGCAAAC | 22 | 7901 |
| BCL11A-6306 | – | CAAACCCCAGCACUUAAGCAAAC | 23 | 7902 |
| BCL11A-6307 | – | GCAAACCCCAGCACUUAAGCAAAC | 24 | 7903 |
| BCL11A-6308 | – | AGCUCUAAUCCCCACGCC | 18 | 7904 |
| BCL11A-6309 | – | GAGCUCUAAUCCCCACGCC | 19 | 7905 |
| BCL11A-5350 | – | GGAGCUCUAAUCCCCACGCC | 20 | 7906 |
| BCL11A-6310 | – | UGGAGCUCUAAUCCCCACGCC | 21 | 7907 |
| BCL11A-6311 | – | AUGGAGCUCUAAUCCCCACGCC | 22 | 7908 |
| BCL11A-6312 | – | CAUGGAGCUCUAAUCCCCACGCC | 23 | 7909 |
| BCL11A-6313 | – | ACAUGGAGCUCUAAUCCCCACGCC | 24 | 7910 |
| BCL11A-6314 | – | UUUAUCAACGUCAUCUAG | 18 | 7911 |
| BCL11A-6315 | – | GUUUAUCAACGUCAUCUAG | 19 | 7912 |
| BCL11A-5356 | – | UGUUUAUCAACGUCAUCUAG | 20 | 7913 |
| BCL11A-6316 | – | UUGUUUAUCAACGUCAUCUAG | 21 | 7914 |
| BCL11A-6317 | – | AUUGUUUAUCAACGUCAUCUAG | 22 | 7915 |
| BCL11A-6318 | – | GAUUGUUUAUCAACGUCAUCUAG | 23 | 7916 |
| BCL11A-6319 | – | CGAUUGUUUAUCAACGUCAUCUAG | 24 | 7917 |
| BCL11A-6320 | – | AGUGCAGAAUAUGCCCCG | 18 | 7918 |
| BCL11A-6321 | – | GAGUGCAGAAUAUGCCCCG | 19 | 7919 |
| BCL11A-6322 | – | UGAGUGCAGAAUAUGCCCCG | 20 | 7920 |
| BCL11A-6323 | – | AUGAGUGCAGAAUAUGCCCCG | 21 | 7921 |
| BCL11A-6324 | – | GAUGAGUGCAGAAUAUGCCCCG | 22 | 7922 |
| BCL11A-6325 | – | GGAUGAGUGCAGAAUAUGCCCCG | 23 | 7923 |
| BCL11A-6326 | – | GGGAUGAGUGCAGAAUAUGCCCCG | 24 | 7924 |
| BCL11A-6327 | – | CUAAUCCCCACGCCUGGG | 18 | 7925 |
| BCL11A-6328 | – | UCUAAUCCCCACGCCUGGG | 19 | 7926 |
| BCL11A-6329 | – | CUCUAAUCCCCACGCCUGGG | 20 | 7927 |
| BCL11A-6330 | – | GCUCUAAUCCCCACGCCUGGG | 21 | 7928 |
| BCL11A-6331 | – | AGCUCUAAUCCCCACGCCUGGG | 22 | 7929 |
| BCL11A-6332 | – | GAGCUCUAAUCCCCACGCCUGGG | 23 | 7930 |

TABLE 16A-continued

1st Tier

| gRNA Name | DNA Strand | Targeting Domain | Target Site Length | SEQ ID NO: |
|---|---|---|---|---|
| BCL11A-6333 | - | GGAGCUCUAAUCCCCACGCCUGGG | 24 | 7931 |
| BCL11A-6334 | - | CCACGCCUGGGAUGAGUG | 18 | 7932 |
| BCL11A-6335 | - | CCCACGCCUGGGAUGAGUG | 19 | 7933 |
| BCL11A-6336 | - | CCCCACGCCUGGGAUGAGUG | 20 | 7934 |
| BCL11A-6337 | - | UCCCCACGCCUGGGAUGAGUG | 21 | 7935 |
| BCL11A-6338 | - | AUCCCCACGCCUGGGAUGAGUG | 22 | 7936 |
| BCL11A-6339 | - | AAUCCCCACGCCUGGGAUGAGUG | 23 | 7937 |
| BCL11A-6340 | - | UAAUCCCCACGCCUGGGAUGAGUG | 24 | 7938 |
| BCL11A-6341 | - | CUCUGCUUAGAAAAAGCU | 18 | 7939 |
| BCL11A-6342 | - | CCUCUGCUUAGAAAAAGCU | 19 | 7940 |
| BCL11A-6343 | - | GCCUCUGCUUAGAAAAAGCU | 20 | 7941 |
| BCL11A-6344 | - | AGCCUCUGCUUAGAAAAAGCU | 21 | 7942 |
| BCL11A-6345 | - | CAGCCUCUGCUUAGAAAAAGCU | 22 | 7943 |
| BCL11A-6346 | - | GCAGCCUCUGCUUAGAAAAAGCU | 23 | 7944 |
| BCL11A-6347 | - | GGCAGCCUCUGCUUAGAAAAAGCU | 24 | 7945 |

Table 16B provides exemplary targeting domains for knocking out the BCL11A gene selected according to the second tier parameters. The targeting domains bind within the first 500 bp of the coding sequence (e.g., within 500 bp downstream from the start codon), and the PAM is NNGRRT. It is contemplated herein that in an embodiment the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

Table 16C provides exemplary targeting domains for knocking out the BCL11A gene selected according to the third tier parameters. The targeting domains bind within the first 500 bp of the coding sequence (e.g., within 500 bp downstream from the start codon), and the PAM is NNGRRV. It is contemplated herein that in an embodiment the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

TABLE 16B

2nd Tier

| gRNA Name | DNA Strand | Targeting Domain | Target Site Length | SEQ ID NO: |
|---|---|---|---|---|
| BCL11A-6348 | + | CCUGGAUGCCAACCUCCA | 18 | 7946 |
| BCL11A-6349 | + | ACCUGGAUGCCAACCUCCA | 19 | 7947 |
| BCL11A-5450 | + | GACCUGGAUGCCAACCUCCA | 20 | 7948 |
| BCL11A-6350 | - | CCCAGCACUUAAGCAAAC | 18 | 7949 |
| BCL11A-6351 | - | CCCCAGCACUUAAGCAAAC | 19 | 7950 |
| BCL11A-5458 | - | ACCCCAGCACUUAAGCAAAC | 20 | 7951 |

TABLE 16C

| 3rd Tier | | | | |
|---|---|---|---|---|
| gRNA Name | DNA Strand | Targeting Domain | Target Site Length | SEQ ID NO: |
| BCL11A-6352 | + | AAUAAGAAUGUCCCCCAA | 18 | 7952 |
| BCL11A-6353 | + | AAAUAAGAAUGUCCCCCAA | 19 | 7953 |
| BCL11A-5444 | + | AAAAUAAGAAUGUCCCCCAA | 20 | 7954 |
| BCL11A-6354 | + | AAAAAUAAGAAUGUCCCCCAA | 21 | 7955 |
| BCL11A-6355 | + | UAAAAAUAAGAAUGUCCCCCAA | 22 | 7956 |
| BCL11A-6356 | + | AUAAAAAUAAGAAUGUCCCCCAA | 23 | 7957 |
| BCL11A-6357 | + | GAUAAAAAUAAGAAUGUCCCCCAA | 24 | 7958 |
| BCL11A-6358 | + | UUCAUCUCGAUUGGUGAA | 18 | 7959 |
| BCL11A-6359 | + | UUUCAUCUCGAUUGGUGAA | 19 | 7960 |
| BCL11A-5344 | + | UUUUCAUCUCGAUUGGUGAA | 20 | 7961 |
| BCL11A-6360 | + | UUUUUCAUCUCGAUUGGUGAA | 21 | 7962 |
| BCL11A-6361 | + | UUUUUUCAUCUCGAUUGGUGAA | 22 | 7963 |
| BCL11A-6362 | + | CUUUUUUCAUCUCGAUUGGUGAA | 23 | 7964 |
| BCL11A-6363 | + | GCUUUUUUCAUCUCGAUUGGUGAA | 24 | 7965 |
| BCL11A-6364 | + | AAAUAAGAAUGUCCCCA | 18 | 7966 |
| BCL11A-6365 | + | AAAAUAAGAAUGUCCCCA | 19 | 7967 |
| BCL11A-6366 | + | AAAAAUAAGAAUGUCCCCA | 20 | 7968 |
| BCL11A-6367 | + | UAAAAAUAAGAAUGUCCCCA | 21 | 7969 |
| BCL11A-6368 | + | AUAAAAAUAAGAAUGUCCCCA | 22 | 7970 |
| BCL11A-6369 | + | GAUAAAAAUAAGAAUGUCCCCA | 23 | 7971 |
| BCL11A-6370 | + | CGAUAAAAAUAAGAAUGUCCCCA | 24 | 7972 |
| BCL11A-6371 | + | CCCCUUCUGGAGCUCCCA | 18 | 7973 |
| BCL11A-6372 | + | UCCCCUUCUGGAGCUCCCA | 19 | 7974 |
| BCL11A-6373 | + | AUCCCCUUCUGGAGCUCCCA | 20 | 7975 |
| BCL11A-6374 | + | GAUCCCCUUCUGGAGCUCCCA | 21 | 7976 |
| BCL11A-6375 | + | UGAUCCCCUUCUGGAGCUCCCA | 22 | 7977 |
| BCL11A-6376 | + | AUGAUCCCCUUCUGGAGCUCCCA | 23 | 7978 |
| BCL11A-6377 | + | CAUGAUCCCCUUCUGGAGCUCCCA | 24 | 7979 |
| BCL11A-6378 | + | UAGAGCUCCAUGUGCAGA | 18 | 7980 |
| BCL11A-6379 | + | UUAGAGCUCCAUGUGCAGA | 19 | 7981 |
| BCL11A-6380 | + | AUUAGAGCUCCAUGUGCAGA | 20 | 7982 |
| BCL11A-6381 | + | GAUUAGAGCUCCAUGUGCAGA | 21 | 7983 |
| BCL11A-6382 | + | GGAUUAGAGCUCCAUGUGCAGA | 22 | 7984 |
| BCL11A-6383 | + | GGGAUUAGAGCUCCAUGUGCAGA | 23 | 7985 |
| BCL11A-6384 | + | GGGGAUUAGAGCUCCAUGUGCAGA | 24 | 7986 |
| BCL11A-6385 | + | GCUCCAUGUGCAGAACGA | 18 | 7987 |
| BCL11A-6386 | + | AGCUCCAUGUGCAGAACGA | 19 | 7988 |
| BCL11A-5347 | + | GAGCUCCAUGUGCAGAACGA | 20 | 7989 |

TABLE 16C-continued

3rd Tier

| gRNA Name | DNA Strand | Targeting Domain | Target Site Length | SEQ ID NO: |
|---|---|---|---|---|
| BCL11A-6387 | + | AGAGCUCCAUGUGCAGAACGA | 21 | 7990 |
| BCL11A-6388 | + | UAGAGCUCCAUGUGCAGAACGA | 22 | 7991 |
| BCL11A-6389 | + | UUAGAGCUCCAUGUGCAGAACGA | 23 | 7992 |
| BCL11A-6390 | + | AUUAGAGCUCCAUGUGCAGAACGA | 24 | 7993 |
| BCL11A-6391 | + | UUUCAUCUCGAUUGGUGA | 18 | 7994 |
| BCL11A-6392 | + | UUUUCAUCUCGAUUGGUGA | 19 | 7995 |
| BCL11A-5456 | + | UUUUUCAUCUCGAUUGGUGA | 20 | 7996 |
| BCL11A-6393 | + | UUUUUUCAUCUCGAUUGGUGA | 21 | 7997 |
| BCL11A-6394 | + | CUUUUUUCAUCUCGAUUGGUGA | 22 | 7998 |
| BCL11A-6395 | + | GCUUUUUUCAUCUCGAUUGGUGA | 23 | 7999 |
| BCL11A-6396 | + | UGCUUUUUUCAUCUCGAUUGGUGA | 24 | 8000 |
| BCL11A-6397 | + | GCAGAAGUUUAUCUGUGA | 18 | 8001 |
| BCL11A-6398 | + | UGCAGAAGUUUAUCUGUGA | 19 | 8002 |
| BCL11A-6399 | + | GUGCAGAAGUUUAUCUGUGA | 20 | 8003 |
| BCL11A-6400 | + | AGUGCAGAAGUUUAUCUGUGA | 21 | 8004 |
| BCL11A-6401 | + | CAGUGCAGAAGUUUAUCUGUGA | 22 | 8005 |
| BCL11A-6402 | + | CCAGUGCAGAAGUUUAUCUGUGA | 23 | 8006 |
| BCL11A-6403 | + | UCCAGUGCAGAAGUUUAUCUGUGA | 24 | 8007 |
| BCL11A-6404 | + | GAGCUCCAUGUGCAGAAC | 18 | 8008 |
| BCL11A-6405 | + | AGAGCUCCAUGUGCAGAAC | 19 | 8009 |
| BCL11A-6406 | + | UAGAGCUCCAUGUGCAGAAC | 20 | 8010 |
| BCL11A-6407 | + | UUAGAGCUCCAUGUGCAGAAC | 21 | 8011 |
| BCL11A-6408 | + | AUUAGAGCUCCAUGUGCAGAAC | 22 | 8012 |
| BCL11A-6409 | + | GAUUAGAGCUCCAUGUGCAGAAC | 23 | 8013 |
| BCL11A-6410 | + | GGAUUAGAGCUCCAUGUGCAGAAC | 24 | 8014 |
| BCL11A-6411 | + | UAUUAUUGGGUUACUUAC | 18 | 8015 |
| BCL11A-6412 | + | CUAUUAUUGGGUUACUUAC | 19 | 8016 |
| BCL11A-6413 | + | ACUAUUAUUGGGUUACUUAC | 20 | 8017 |
| BCL11A-6414 | + | UACUAUUAUUGGGUUACUUAC | 21 | 8018 |
| BCL11A-6415 | + | UUACUAUUAUUGGGUUACUUAC | 22 | 8019 |
| BCL11A-6416 | + | AUUACUAUUAUUGGGUUACUUAC | 23 | 8020 |
| BCL11A-6417 | + | UAUUACUAUUAUUGGGUUACUUAC | 24 | 8021 |
| BCL11A-6418 | + | ACCUGGAUGCCAACCUCC | 18 | 8022 |
| BCL11A-6419 | + | GACCUGGAUGCCAACCUCC | 19 | 8023 |
| BCL11A-6420 | + | UGACCUGGAUGCCAACCUCC | 20 | 8024 |
| BCL11A-6421 | + | GUGACCUGGAUGCCAACCUCC | 21 | 8025 |
| BCL11A-6422 | + | CGUGACCUGGAUGCCAACCUCC | 22 | 8026 |

TABLE 16C-continued

3rd Tier

| gRNA Name | DNA Strand | Targeting Domain | Target Site Length | SEQ ID NO: |
|---|---|---|---|---|
| BCL11A-6423 | + | GCGUGACCUGGAUGCCAACCUCC | 23 | 8027 |
| BCL11A-6424 | + | GGCGUGACCUGGAUGCCAACCUCC | 24 | 8028 |
| BCL11A-6425 | + | UCUGCACUCAUCCCAGGC | 18 | 8029 |
| BCL11A-6426 | + | UUCUGCACUCAUCCCAGGC | 19 | 8030 |
| BCL11A-6427 | + | AUUCUGCACUCAUCCCAGGC | 20 | 8031 |
| BCL11A-6428 | + | UAUUCUGCACUCAUCCCAGGC | 21 | 8032 |
| BCL11A-6429 | + | AUAUUCUGCACUCAUCCCAGGC | 22 | 8033 |
| BCL11A-6430 | + | CAUAUUCUGCACUCAUCCCAGGC | 23 | 8034 |
| BCL11A-6431 | + | GCAUAUUCUGCACUCAUCCCAGGC | 24 | 8035 |
| BCL11A-6432 | + | GAGGUCAUGAUCCCCUUC | 18 | 8036 |
| BCL11A-6433 | + | GGAGGUCAUGAUCCCCUUC | 19 | 8037 |
| BCL11A-5471 | + | AGGAGGUCAUGAUCCCCUUC | 20 | 8038 |
| BCL11A-6434 | + | GAGGAGGUCAUGAUCCCCUUC | 21 | 8039 |
| BCL11A-6435 | + | UGAGGAGGUCAUGAUCCCCUUC | 22 | 8040 |
| BCL11A-6436 | + | GUGAGGAGGUCAUGAUCCCCUUC | 23 | 8041 |
| BCL11A-6437 | + | GGUGAGGAGGUCAUGAUCCCCUUC | 24 | 8042 |
| BCL11A-6438 | + | AUCUGUAAGAAUGGCUUC | 18 | 8043 |
| BCL11A-6439 | + | CAUCUGUAAGAAUGGCUUC | 19 | 8044 |
| BCL11A-6440 | + | UCAUCUGUAAGAAUGGCUUC | 20 | 8045 |
| BCL11A-6441 | + | AUCAUCUGUAAGAAUGGCUUC | 21 | 8046 |
| BCL11A-6442 | + | CAUCAUCUGUAAGAAUGGCUUC | 22 | 8047 |
| BCL11A-6443 | + | UCAUCAUCUGUAAGAAUGGCUUC | 23 | 8048 |
| BCL11A-6444 | + | UUCAUCAUCUGUAAGAAUGGCUUC | 24 | 8049 |
| BCL11A-6445 | + | UCAUCUCGAUUGGUGAAG | 18 | 8050 |
| BCL11A-6446 | + | UUCAUCUCGAUUGGUGAAG | 19 | 8051 |
| BCL11A-5355 | + | UUUCAUCUCGAUUGGUGAAG | 20 | 8052 |
| BCL11A-6447 | + | UUUUCAUCUCGAUUGGUGAAG | 21 | 8053 |
| BCL11A-6448 | + | UUUUUCAUCUCGAUUGGUGAAG | 22 | 8054 |
| BCL11A-6449 | + | UUUUUUCAUCUCGAUUGGUGAAG | 23 | 8055 |
| BCL11A-6450 | + | CUUUUUUCAUCUCGAUUGGUGAAG | 24 | 8056 |
| BCL11A-6451 | + | UCCACAGCUUUUUCUAAG | 18 | 8057 |
| BCL11A-6452 | + | AUCCACAGCUUUUUCUAAG | 19 | 8058 |
| BCL11A-6453 | + | UAUCCACAGCUUUUUCUAAG | 20 | 8059 |
| BCL11A-6454 | + | UUAUCCACAGCUUUUUCUAAG | 21 | 8060 |
| BCL11A-6455 | + | CUUAUCCACAGCUUUUUCUAAG | 22 | 8061 |
| BCL11A-6456 | + | GCUUAUCCACAGCUUUUUCUAAG | 23 | 8062 |
| BCL11A-6457 | + | GGCUUAUCCACAGCUUUUUCUAAG | 24 | 8063 |
| BCL11A-6458 | + | AUCUGGCACUGCCCACAG | 18 | 8064 |

TABLE 16C-continued

3rd Tier

| gRNA Name | DNA Strand | Targeting Domain | Target Site Length | SEQ ID NO: |
|---|---|---|---|---|
| BCL11A-6459 | + | CAUCUGGCACUGCCCACAG | 19 | 8065 |
| BCL11A-6460 | + | UCAUCUGGCACUGCCCACAG | 20 | 8066 |
| BCL11A-6461 | + | UUCAUCUGGCACUGCCCACAG | 21 | 8067 |
| BCL11A-6462 | + | GUUCAUCUGGCACUGCCCACAG | 22 | 8068 |
| BCL11A-6463 | + | AGUUCAUCUGGCACUGCCCACAG | 23 | 8069 |
| BCL11A-6464 | + | AAGUUCAUCUGGCACUGCCCACAG | 24 | 8070 |
| BCL11A-6465 | + | CUCCAUGUGCAGAACGAG | 18 | 8071 |
| BCL11A-6466 | + | GCUCCAUGUGCAGAACGAG | 19 | 8072 |
| BCL11A-5476 | + | AGCUCCAUGUGCAGAACGAG | 20 | 8073 |
| BCL11A-6467 | + | GAGCUCCAUGUGCAGAACGAG | 21 | 8074 |
| BCL11A-6468 | + | AGAGCUCCAUGUGCAGAACGAG | 22 | 8075 |
| BCL11A-6469 | + | UAGAGCUCCAUGUGCAGAACGAG | 23 | 8076 |
| BCL11A-6470 | + | UUAGAGCUCCAUGUGCAGAACGAG | 24 | 8077 |
| BCL11A-6471 | + | UGUGCAGAACGAGGGGAG | 18 | 8078 |
| BCL11A-6472 | + | AUGUGCAGAACGAGGGGAG | 19 | 8079 |
| BCL11A-6473 | + | CAUGUGCAGAACGAGGGGAG | 20 | 8080 |
| BCL11A-6474 | + | CCAUGUGCAGAACGAGGGGAG | 21 | 8081 |
| BCL11A-6475 | + | UCCAUGUGCAGAACGAGGGGAG | 22 | 8082 |
| BCL11A-6476 | + | CUCCAUGUGCAGAACGAGGGGAG | 23 | 8083 |
| BCL11A-6477 | + | GCUCCAUGUGCAGAACGAGGGGAG | 24 | 8084 |
| BCL11A-6478 | + | AGCUCCAUGUGCAGAACG | 18 | 8085 |
| BCL11A-6479 | + | GAGCUCCAUGUGCAGAACG | 19 | 8086 |
| BCL11A-5357 | + | AGAGCUCCAUGUGCAGAACG | 20 | 8087 |
| BCL11A-6480 | + | UAGAGCUCCAUGUGCAGAACG | 21 | 8088 |
| BCL11A-6481 | + | UUAGAGCUCCAUGUGCAGAACG | 22 | 8089 |
| BCL11A-6482 | + | AUUAGAGCUCCAUGUGCAGAACG | 23 | 8090 |
| BCL11A-6483 | + | GAUUAGAGCUCCAUGUGCAGAACG | 24 | 8091 |
| BCL11A-6484 | + | CUGCACUCAUCCCAGGCG | 18 | 8092 |
| BCL11A-6485 | + | UCUGCACUCAUCCCAGGCG | 19 | 8093 |
| BCL11A-5480 | + | UUCUGCACUCAUCCCAGGCG | 20 | 8094 |
| BCL11A-6486 | + | AUUCUGCACUCAUCCCAGGCG | 21 | 8095 |
| BCL11A-6487 | + | UAUUCUGCACUCAUCCCAGGCG | 22 | 8096 |
| BCL11A-6488 | + | AUAUUCUGCACUCAUCCCAGGCG | 23 | 8097 |
| BCL11A-6489 | + | CAUAUUCUGCACUCAUCCCAGGCG | 24 | 8098 |
| BCL11A-6490 | + | GGGUUUGCCUUGCUUGCG | 18 | 8099 |
| BCL11A-6491 | + | GGGGUUUGCCUUGCUUGCG | 19 | 8100 |
| BCL11A-6492 | + | UGGGGUUUGCCUUGCUUGCG | 20 | 8101 |

TABLE 16C-continued

3rd Tier

| gRNA Name | DNA Strand | Targeting Domain | Target Site Length | SEQ ID NO: |
|---|---|---|---|---|
| BCL11A-6493 | + | CUGGGGUUUGCCUUGCUUGCG | 21 | 8102 |
| BCL11A-6494 | + | GCUGGGGUUUGCCUUGCUUGCG | 22 | 8103 |
| BCL11A-6495 | + | UGCUGGGGUUUGCCUUGCUUGCG | 23 | 8104 |
| BCL11A-6496 | + | GUGCUGGGGUUUGCCUUGCUUGCG | 24 | 8105 |
| BCL11A-6497 | + | CCAUGUGCAGAACGAGGG | 18 | 8106 |
| BCL11A-6498 | + | UCCAUGUGCAGAACGAGGG | 19 | 8107 |
| BCL11A-6499 | + | CUCCAUGUGCAGAACGAGGG | 20 | 8108 |
| BCL11A-6500 | + | GCUCCAUGUGCAGAACGAGGG | 21 | 8109 |
| BCL11A-6501 | + | AGCUCCAUGUGCAGAACGAGGG | 22 | 8110 |
| BCL11A-6502 | + | GAGCUCCAUGUGCAGAACGAGGG | 23 | 8111 |
| BCL11A-6503 | + | AGAGCUCCAUGUGCAGAACGAGGG | 24 | 8112 |
| BCL11A-6504 | + | GACAUGGUGGGCUGCGGG | 18 | 8113 |
| BCL11A-6505 | + | AGACAUGGUGGGCUGCGGG | 19 | 8114 |
| BCL11A-6506 | + | GAGACAUGGUGGGCUGCGGG | 20 | 8115 |
| BCL11A-6507 | + | CGAGACAUGGUGGGCUGCGGG | 21 | 8116 |
| BCL11A-6508 | + | GCGAGACAUGGUGGGCUGCGGG | 22 | 8117 |
| BCL11A-6509 | + | GGCGAGACAUGGUGGGCUGCGGG | 23 | 8118 |
| BCL11A-6510 | + | CGGCGAGACAUGGUGGGCUGCGGG | 24 | 8119 |
| BCL11A-6511 | + | CAUGUGCAGAACGAGGGG | 18 | 8120 |
| BCL11A-6512 | + | CCAUGUGCAGAACGAGGGG | 19 | 8121 |
| BCL11A-5488 | + | UCCAUGUGCAGAACGAGGGG | 20 | 8122 |
| BCL11A-6513 | + | CUCCAUGUGCAGAACGAGGGG | 21 | 8123 |
| BCL11A-6514 | + | GCUCCAUGUGCAGAACGAGGGG | 22 | 8124 |
| BCL11A-6515 | + | AGCUCCAUGUGCAGAACGAGGGG | 23 | 8125 |
| BCL11A-6516 | + | GAGCUCCAUGUGCAGAACGAGGGG | 24 | 8126 |
| BCL11A-6517 | + | CAAGAGGCUCGGCUGUGG | 18 | 8127 |
| BCL11A-6518 | + | UCAAGAGGCUCGGCUGUGG | 19 | 8128 |
| BCL11A-6519 | + | UUCAAGAGGCUCGGCUGUGG | 20 | 8129 |
| BCL11A-6520 | + | CUUCAAGAGGCUCGGCUGUGG | 21 | 8130 |
| BCL11A-6521 | + | GCUUCAAGAGGCUCGGCUGUGG | 22 | 8131 |
| BCL11A-6522 | + | GGCUUCAAGAGGCUCGGCUGUGG | 23 | 8132 |
| BCL11A-6523 | + | UGGCUUCAAGAGGCUCGGCUGUGG | 24 | 8133 |
| BCL11A-6524 | + | UGCUUGCGGCGAGACAUG | 18 | 8134 |
| BCL11A-6525 | + | UUGCUUGCGGCGAGACAUG | 19 | 8135 |
| BCL11A-6526 | + | CUUGCUUGCGGCGAGACAUG | 20 | 8136 |
| BCL11A-6527 | + | CCUUGCUUGCGGCGAGACAUG | 21 | 8137 |
| BCL11A-6528 | + | GCCUUGCUUGCGGCGAGACAUG | 22 | 8138 |
| BCL11A-6529 | + | UGCCUUGCUUGCGGCGAGACAUG | 23 | 8139 |

TABLE 16C-continued

| 3rd Tier | | | | |
|---|---|---|---|---|
| gRNA Name | DNA Strand | Targeting Domain | Target Site Length | SEQ ID NO: |
| BCL11A-6530 | + | UUGCCUUGCUUGCGGCGAGACAUG | 24 | 8140 |
| BCL11A-6531 | + | CAACUUACAAAUACCCUG | 18 | 8141 |
| BCL11A-6532 | + | UCAACUUACAAAUACCCUG | 19 | 8142 |
| BCL11A-5494 | + | CUCAACUUACAAAUACCCUG | 20 | 8143 |
| BCL11A-6533 | + | GCUCAACUUACAAAUACCCUG | 21 | 8144 |
| BCL11A-6534 | + | GGCUCAACUUACAAAUACCCUG | 22 | 8145 |
| BCL11A-6535 | + | AGGCUCAACUUACAAAUACCCUG | 23 | 8146 |
| BCL11A-6536 | + | AAGGCUCAACUUACAAAUACCCUG | 24 | 8147 |
| BCL11A-6537 | + | GUUGUACAUGUGUAGCUG | 18 | 8148 |
| BCL11A-6538 | + | AGUUGUACAUGUGUAGCUG | 19 | 8149 |
| BCL11A-6539 | + | AAGUUGUACAUGUGUAGCUG | 20 | 8150 |
| BCL11A-6540 | + | CAAGUUGUACAUGUGUAGCUG | 21 | 8151 |
| BCL11A-6541 | + | GCAAGUUGUACAUGUGUAGCUG | 22 | 8152 |
| BCL11A-6542 | + | UGCAAGUUGUACAUGUGUAGCUG | 23 | 8153 |
| BCL11A-6543 | + | UUGCAAGUUGUACAUGUGUAGCUG | 24 | 8154 |
| BCL11A-6544 | + | GCGAGACAUGGUGGGCUG | 18 | 8155 |
| BCL11A-6545 | + | GGCGAGACAUGGUGGGCUG | 19 | 8156 |
| BCL11A-5361 | + | CGGCGAGACAUGGUGGGCUG | 20 | 8157 |
| BCL11A-6546 | + | GCGGCGAGACAUGGUGGGCUG | 21 | 8158 |
| BCL11A-6547 | + | UGCGGCGAGACAUGGUGGGCUG | 22 | 8159 |
| BCL11A-6548 | + | UUGCGGCGAGACAUGGUGGGCUG | 23 | 8160 |
| BCL11A-6549 | + | CUUGCGGCGAGACAUGGUGGGCUG | 24 | 8161 |
| BCL11A-6550 | + | UUCCCGUUUGCUUAAGUG | 18 | 8162 |
| BCL11A-6551 | + | AUUCCCGUUUGCUUAAGUG | 19 | 8163 |
| BCL11A-6552 | + | AAUUCCCGUUUGCUUAAGUG | 20 | 8164 |
| BCL11A-6553 | + | GAAUUCCCGUUUGCUUAAGUG | 21 | 8165 |
| BCL11A-6554 | + | AGAAUUCCCGUUUGCUUAAGUG | 22 | 8166 |
| BCL11A-6555 | + | GAGAAUUCCCGUUUGCUUAAGUG | 23 | 8167 |
| BCL11A-6556 | + | CGAGAAUUCCCGUUUGCUUAAGUG | 24 | 8168 |
| BCL11A-6557 | + | GGAGAGGCCCCUCCAGUG | 18 | 8169 |
| BCL11A-6558 | + | AGGAGAGGCCCCUCCAGUG | 19 | 8170 |
| BCL11A-6559 | + | GAGGAGAGGCCCCUCCAGUG | 20 | 8171 |
| BCL11A-6560 | + | GGAGGAGAGGCCCCUCCAGUG | 21 | 8172 |
| BCL11A-6561 | + | GGGAGGAGAGGCCCCUCCAGUG | 22 | 8173 |
| BCL11A-6562 | + | GGGGAGGAGAGGCCCCUCCAGUG | 23 | 8174 |
| BCL11A-6563 | + | AGGGGAGGAGAGGCCCCUCCAGUG | 24 | 8175 |
| BCL11A-6564 | + | UGGCACUGCCCACAGGUG | 18 | 8176 |

TABLE 16C-continued

3rd Tier

| gRNA Name | DNA Strand | Targeting Domain | Target Site Length | SEQ ID NO: |
|---|---|---|---|---|
| BCL11A-6565 | + | CUGGCACUGCCCACAGGUG | 19 | 8177 |
| BCL11A-5498 | + | UCUGGCACUGCCCACAGGUG | 20 | 8178 |
| BCL11A-6566 | + | AUCUGGCACUGCCCACAGGUG | 21 | 8179 |
| BCL11A-6567 | + | CAUCUGGCACUGCCCACAGGUG | 22 | 8180 |
| BCL11A-6568 | + | UCAUCUGGCACUGCCCACAGGUG | 23 | 8181 |
| BCL11A-6569 | + | UUCAUCUGGCACUGCCCACAGGUG | 24 | 8182 |
| BCL11A-6570 | + | UUUUCAUCUCGAUUGGUG | 18 | 8183 |
| BCL11A-6571 | + | UUUUUCAUCUCGAUUGGUG | 19 | 8184 |
| BCL11A-6572 | + | UUUUUUCAUCUCGAUUGGUG | 20 | 8185 |
| BCL11A-6573 | + | CUUUUUUCAUCUCGAUUGGUG | 21 | 8186 |
| BCL11A-6574 | + | GCUUUUUUCAUCUCGAUUGGUG | 22 | 8187 |
| BCL11A-6575 | + | UGCUUUUUUCAUCUCGAUUGGUG | 23 | 8188 |
| BCL11A-6576 | + | AUGCUUUUUUCAUCUCGAUUGGUG | 24 | 8189 |
| BCL11A-6577 | + | GGAUUAGAGCUCCAUGUG | 18 | 8190 |
| BCL11A-6578 | + | GGGAUUAGAGCUCCAUGUG | 19 | 8191 |
| BCL11A-6579 | + | GGGGAUUAGAGCUCCAUGUG | 20 | 8192 |
| BCL11A-6580 | + | UGGGGAUUAGAGCUCCAUGUG | 21 | 8193 |
| BCL11A-6581 | + | GUGGGGAUUAGAGCUCCAUGUG | 22 | 8194 |
| BCL11A-6582 | + | CGUGGGGAUUAGAGCUCCAUGUG | 23 | 8195 |
| BCL11A-6583 | + | GCGUGGGGAUUAGAGCUCCAUGUG | 24 | 8196 |
| BCL11A-6584 | + | CUUUUUUCAUCUCGAUUG | 18 | 8197 |
| BCL11A-6585 | + | GCUUUUUUCAUCUCGAUUG | 19 | 8198 |
| BCL11A-6586 | + | UGCUUUUUUCAUCUCGAUUG | 20 | 8199 |
| BCL11A-6587 | + | AUGCUUUUUUCAUCUCGAUUG | 21 | 8200 |
| BCL11A-6588 | + | GAUGCUUUUUUCAUCUCGAUUG | 22 | 8201 |
| BCL11A-6589 | + | GGAUGCUUUUUUCAUCUCGAUUG | 23 | 8202 |
| BCL11A-6590 | + | UGGAUGCUUUUUUCAUCUCGAUUG | 24 | 8203 |
| BCL11A-6591 | + | GAGGCUCGGCUGUGGUUG | 18 | 8204 |
| BCL11A-6592 | + | AGAGGCUCGGCUGUGGUUG | 19 | 8205 |
| BCL11A-6593 | + | AAGAGGCUCGGCUGUGGUUG | 20 | 8206 |
| BCL11A-6594 | + | CAAGAGGCUCGGCUGUGGUUG | 21 | 8207 |
| BCL11A-6595 | + | UCAAGAGGCUCGGCUGUGGUUG | 22 | 8208 |
| BCL11A-6596 | + | UUCAAGAGGCUCGGCUGUGGUUG | 23 | 8209 |
| BCL11A-6597 | + | CUUCAAGAGGCUCGGCUGUGGUUG | 24 | 8210 |
| BCL11A-6598 | + | AUAAGAAUGUCCCCAAU | 18 | 8211 |
| BCL11A-6599 | + | AAUAAGAAUGUCCCCAAU | 19 | 8212 |
| BCL11A-5502 | + | AAAUAAGAAUGUCCCCAAU | 20 | 8213 |
| BCL11A-6600 | + | AAAAUAAGAAUGUCCCCAAU | 21 | 8214 |

TABLE 16C-continued

3rd Tier

| gRNA Name | DNA Strand | Targeting Domain | Target Site Length | SEQ ID NO: |
|---|---|---|---|---|
| BCL11A-6601 | + | AAAAAUAAGAAUGUCCCCCAAU | 22 | 8215 |
| BCL11A-6602 | + | UAAAAAUAAGAAUGUCCCCCAAU | 23 | 8216 |
| BCL11A-6603 | + | AUAAAAAUAAGAAUGUCCCCCAAU | 24 | 8217 |
| BCL11A-6604 | + | CAUCCCAGGCGUGGGGAU | 18 | 8218 |
| BCL11A-6605 | + | UCAUCCCAGGCGUGGGGAU | 19 | 8219 |
| BCL11A-6606 | + | CUCAUCCCAGGCGUGGGGAU | 20 | 8220 |
| BCL11A-6607 | + | ACUCAUCCCAGGCGUGGGGAU | 21 | 8221 |
| BCL11A-6608 | + | CACUCAUCCCAGGCGUGGGGAU | 22 | 8222 |
| BCL11A-6609 | + | GCACUCAUCCCAGGCGUGGGGAU | 23 | 8223 |
| BCL11A-6610 | + | UGCACUCAUCCCAGGCGUGGGGAU | 24 | 8224 |
| BCL11A-6611 | + | UCAACUUACAAAUACCCU | 18 | 8225 |
| BCL11A-6612 | + | CUCAACUUACAAAUACCCU | 19 | 8226 |
| BCL11A-6613 | + | GCUCAACUUACAAAUACCCU | 20 | 8227 |
| BCL11A-6614 | + | GGCUCAACUUACAAAUACCCU | 21 | 8228 |
| BCL11A-6615 | + | AGGCUCAACUUACAAAUACCCU | 22 | 8229 |
| BCL11A-6616 | + | AAGGCUCAACUUACAAAUACCCU | 23 | 8230 |
| BCL11A-6617 | + | UAAGGCUCAACUUACAAAUACCCU | 24 | 8231 |
| BCL11A-6618 | + | GGCGAGACAUGGUGGGCU | 18 | 8232 |
| BCL11A-6619 | + | CGGCGAGACAUGGUGGGCU | 19 | 8233 |
| BCL11A-6620 | + | GCGGCGAGACAUGGUGGGCU | 20 | 8234 |
| BCL11A-6621 | + | UGCGGCGAGACAUGGUGGGCU | 21 | 8235 |
| BCL11A-6622 | + | UUGCGGCGAGACAUGGUGGGCU | 22 | 8236 |
| BCL11A-6623 | + | CUUGCGGCGAGACAUGGUGGGCU | 23 | 8237 |
| BCL11A-6624 | + | GCUUGCGGCGAGACAUGGUGGGCU | 24 | 8238 |
| BCL11A-6625 | + | CAGUGCAGAAGUUUAUCU | 18 | 8239 |
| BCL11A-6626 | + | CCAGUGCAGAAGUUUAUCU | 19 | 8240 |
| BCL11A-6627 | + | UCCAGUGCAGAAGUUUAUCU | 20 | 8241 |
| BCL11A-6628 | + | CUCCAGUGCAGAAGUUUAUCU | 21 | 8242 |
| BCL11A-6629 | + | CCUCCAGUGCAGAAGUUUAUCU | 22 | 8243 |
| BCL11A-6630 | + | CCCUCCAGUGCAGAAGUUUAUCU | 23 | 8244 |
| BCL11A-6631 | + | CCCCUCCAGUGCAGAAGUUUAUCU | 24 | 8245 |
| BCL11A-6632 | + | CUGGCACUGCCCACAGGU | 18 | 8246 |
| BCL11A-6633 | + | UCUGGCACUGCCCACAGGU | 19 | 8247 |
| BCL11A-6634 | + | AUCUGGCACUGCCCACAGGU | 20 | 8248 |
| BCL11A-6635 | + | CAUCUGGCACUGCCCACAGGU | 21 | 8249 |
| BCL11A-6636 | + | UCAUCUGGCACUGCCCACAGGU | 22 | 8250 |
| BCL11A-6637 | + | UUCAUCUGGCACUGCCCACAGGU | 23 | 8251 |

TABLE 16C-continued

3rd Tier

| gRNA Name | DNA Strand | Targeting Domain | Target Site Length | SEQ ID NO: |
|---|---|---|---|---|
| BCL11A-6638 | + | GUUCAUCUGGCACUGCCCACAGGU | 24 | 8252 |
| BCL11A-6639 | + | AAGAGGCUCGGCUGUGGU | 18 | 8253 |
| BCL11A-6640 | + | CAAGAGGCUCGGCUGUGGU | 19 | 8254 |
| BCL11A-5366 | + | UCAAGAGGCUCGGCUGUGGU | 20 | 8255 |
| BCL11A-6641 | + | UUCAAGAGGCUCGGCUGUGGU | 21 | 8256 |
| BCL11A-6642 | + | CUUCAAGAGGCUCGGCUGUGGU | 22 | 8257 |
| BCL11A-6643 | + | GCUUCAAGAGGCUCGGCUGUGGU | 23 | 8258 |
| BCL11A-6644 | + | GGCUUCAAGAGGCUCGGCUGUGGU | 24 | 8259 |
| BCL11A-6645 | + | CCUGCUAUGUGUUCCUGU | 18 | 8260 |
| BCL11A-6646 | + | ACCUGCUAUGUGUUCCUGU | 19 | 8261 |
| BCL11A-6647 | + | UACCUGCUAUGUGUUCCUGU | 20 | 8262 |
| BCL11A-6648 | + | UUACCUGCUAUGUGUUCCUGU | 21 | 8263 |
| BCL11A-6649 | + | UUUACCUGCUAUGUGUUCCUGU | 22 | 8264 |
| BCL11A-6650 | + | AUUUACCUGCUAUGUGUUCCUGU | 23 | 8265 |
| BCL11A-6651 | + | CAUUUACCUGCUAUGUGUUCCUGU | 24 | 8266 |
| BCL11A-6652 | + | GGAGGUCAUGAUCCCCUU | 18 | 8267 |
| BCL11A-6653 | + | AGGAGGUCAUGAUCCCCUU | 19 | 8268 |
| BCL11A-6654 | + | GAGGAGGUCAUGAUCCCCUU | 20 | 8269 |
| BCL11A-6655 | + | UGAGGAGGUCAUGAUCCCCUU | 21 | 8270 |
| BCL11A-6656 | + | GUGAGGAGGUCAUGAUCCCCUU | 22 | 8271 |
| BCL11A-6657 | + | GGUGAGGAGGUCAUGAUCCCCUU | 23 | 8272 |
| BCL11A-6658 | + | AGGUGAGGAGGUCAUGAUCCCCUU | 24 | 8273 |
| BCL11A-6659 | + | CUGCUAUGUGUUCCUGUU | 18 | 8274 |
| BCL11A-6660 | + | CCUGCUAUGUGUUCCUGUU | 19 | 8275 |
| BCL11A-5513 | + | ACCUGCUAUGUGUUCCUGUU | 20 | 8276 |
| BCL11A-6661 | + | UACCUGCUAUGUGUUCCUGUU | 21 | 8277 |
| BCL11A-6662 | + | UUACCUGCUAUGUGUUCCUGUU | 22 | 8278 |
| BCL11A-6663 | + | UUUACCUGCUAUGUGUUCCUGUU | 23 | 8279 |
| BCL11A-6664 | + | AUUUACCUGCUAUGUGUUCCUGUU | 24 | 8280 |
| BCL11A-6665 | – | AUUUUUAUCGAGCACAAA | 18 | 8281 |
| BCL11A-6666 | – | UAUUUUUAUCGAGCACAAA | 19 | 8282 |
| BCL11A-5342 | – | UUAUUUUUAUCGAGCACAAA | 20 | 8283 |
| BCL11A-6667 | – | CUUAUUUUUAUCGAGCACAAA | 21 | 8284 |
| BCL11A-6668 | – | UCUUAUUUUUAUCGAGCACAAA | 22 | 8285 |
| BCL11A-6669 | – | UUCUUAUUUUUAUCGAGCACAAA | 23 | 8286 |
| BCL11A-6670 | – | AUUCUUAUUUUUAUCGAGCACAAA | 24 | 8287 |
| BCL11A-6671 | – | AGAGGAAUUUGCCCCAAA | 18 | 8288 |
| BCL11A-6672 | – | UAGAGGAAUUUGCCCCAAA | 19 | 8289 |

TABLE 16C-continued

3rd Tier

| gRNA Name | DNA Strand | Targeting Domain | Target Site Length | SEQ ID NO: |
|---|---|---|---|---|
| BCL11A-6673 | − | CUAGAGGAAUUUGCCCCAAA | 20 | 8290 |
| BCL11A-6674 | − | UCUAGAGGAAUUUGCCCCAAA | 21 | 8291 |
| BCL11A-6675 | − | AUCUAGAGGAAUUUGCCCCAAA | 22 | 8292 |
| BCL11A-6676 | − | CAUCUAGAGGAAUUUGCCCCAAA | 23 | 8293 |
| BCL11A-6677 | − | UCAUCUAGAGGAAUUUGCCCCAAA | 24 | 8294 |
| BCL11A-6678 | − | CCCCAGCACUUAAGCAAA | 18 | 8295 |
| BCL11A-6679 | − | ACCCCAGCACUUAAGCAAA | 19 | 8296 |
| BCL11A-5443 | − | AACCCCAGCACUUAAGCAAA | 20 | 8297 |
| BCL11A-6680 | − | AAACCCCAGCACUUAAGCAAA | 21 | 8298 |
| BCL11A-6681 | − | CAAACCCCAGCACUUAAGCAAA | 22 | 8299 |
| BCL11A-6682 | − | GCAAACCCCAGCACUUAAGCAAA | 23 | 8300 |
| BCL11A-6683 | − | GGCAAACCCCAGCACUUAAGCAAA | 24 | 8301 |
| BCL11A-6684 | − | UAUUUUUAUCGAGCACAA | 18 | 8302 |
| BCL11A-6685 | − | UUAUUUUUAUCGAGCACAA | 19 | 8303 |
| BCL11A-6686 | − | CUUAUUUUUAUCGAGCACAA | 20 | 8304 |
| BCL11A-6687 | − | UCUUAUUUUUAUCGAGCACAA | 21 | 8305 |
| BCL11A-6688 | − | UUCUUAUUUUUAUCGAGCACAA | 22 | 8306 |
| BCL11A-6689 | − | AUUCUUAUUUUUAUCGAGCACAA | 23 | 8307 |
| BCL11A-6690 | − | CAUUCUUAUUUUUAUCGAGCACAA | 24 | 8308 |
| BCL11A-6691 | − | CACCUUCCCCUUCACCAA | 18 | 8309 |
| BCL11A-6692 | − | CCACCUUCCCCUUCACCAA | 19 | 8310 |
| BCL11A-6693 | − | GCCACCUUCCCCUUCACCAA | 20 | 8311 |
| BCL11A-6694 | − | AGCCACCUUCCCCUUCACCAA | 21 | 8312 |
| BCL11A-6695 | − | AAGCCACCUUCCCCUUCACCAA | 22 | 8313 |
| BCL11A-6696 | − | UAAGCCACCUUCCCCUUCACCAA | 23 | 8314 |
| BCL11A-6697 | − | AUAAGCCACCUUCCCCUUCACCAA | 24 | 8315 |
| BCL11A-6698 | − | ACCCCAGCACUUAAGCAA | 18 | 8316 |
| BCL11A-6699 | − | AACCCCAGCACUUAAGCAA | 19 | 8317 |
| BCL11A-6700 | − | AAACCCCAGCACUUAAGCAA | 20 | 8318 |
| BCL11A-6701 | − | CAAACCCCAGCACUUAAGCAA | 21 | 8319 |
| BCL11A-6702 | − | GCAAACCCCAGCACUUAAGCAA | 22 | 8320 |
| BCL11A-6703 | − | GGCAAACCCCAGCACUUAAGCAA | 23 | 8321 |
| BCL11A-6704 | − | AGGCAAACCCCAGCACUUAAGCAA | 24 | 8322 |
| BCL11A-6705 | − | GGAACACAUAGCAGGUAA | 18 | 8323 |
| BCL11A-6706 | − | AGGAACACAUAGCAGGUAA | 19 | 8324 |
| BCL11A-6707 | − | CAGGAACACAUAGCAGGUAA | 20 | 8325 |
| BCL11A-6708 | − | ACAGGAACACAUAGCAGGUAA | 21 | 8326 |

TABLE 16C-continued

3rd Tier

| gRNA Name | DNA Strand | Targeting Domain | Target Site Length | SEQ ID NO: |
|---|---|---|---|---|
| BCL11A-6709 | - | AACAGGAACACAUAGCAGGUAA | 22 | 8327 |
| BCL11A-6710 | - | AAACAGGAACACAUAGCAGGUAA | 23 | 8328 |
| BCL11A-6711 | - | CAAACAGGAACACAUAGCAGGUAA | 24 | 8329 |
| BCL11A-6712 | - | CUCCCCUCGUUCUGCACA | 18 | 8330 |
| BCL11A-6713 | - | CCUCCCCUCGUUCUGCACA | 19 | 8331 |
| BCL11A-5448 | - | UCCUCCCCUCGUUCUGCACA | 20 | 8332 |
| BCL11A-6714 | - | CUCCUCCCCUCGUUCUGCACA | 21 | 8333 |
| BCL11A-6715 | - | UCUCCUCCCCUCGUUCUGCACA | 22 | 8334 |
| BCL11A-6716 | - | CUCUCCUCCCCUCGUUCUGCACA | 23 | 8335 |
| BCL11A-6717 | - | CCUCUCCUCCCCUCGUUCUGCACA | 24 | 8336 |
| BCL11A-6718 | - | UGCCAGAUGAACUUCCCA | 18 | 8337 |
| BCL11A-6719 | - | GUGCCAGAUGAACUUCCCA | 19 | 8338 |
| BCL11A-6720 | - | AGUGCCAGAUGAACUUCCCA | 20 | 8339 |
| BCL11A-6721 | - | CAGUGCCAGAUGAACUUCCCA | 21 | 8340 |
| BCL11A-6722 | - | GCAGUGCCAGAUGAACUUCCCA | 22 | 8341 |
| BCL11A-6723 | - | GGCAGUGCCAGAUGAACUUCCCA | 23 | 8342 |
| BCL11A-6724 | - | GGGCAGUGCCAGAUGAACUUCCCA | 24 | 8343 |
| BCL11A-6725 | - | GCAGGUAAAUGAGAAGCA | 18 | 8344 |
| BCL11A-6726 | - | AGCAGGUAAAUGAGAAGCA | 19 | 8345 |
| BCL11A-5451 | - | UAGCAGGUAAAUGAGAAGCA | 20 | 8346 |
| BCL11A-6727 | - | AUAGCAGGUAAAUGAGAAGCA | 21 | 8347 |
| BCL11A-6728 | - | CAUAGCAGGUAAAUGAGAAGCA | 22 | 8348 |
| BCL11A-6729 | - | ACAUAGCAGGUAAAUGAGAAGCA | 23 | 8349 |
| BCL11A-6730 | - | CACAUAGCAGGUAAAUGAGAAGCA | 24 | 8350 |
| BCL11A-6731 | - | CACAGAUAAACUUCUGCA | 18 | 8351 |
| BCL11A-6732 | - | UCACAGAUAAACUUCUGCA | 19 | 8352 |
| BCL11A-6733 | - | UUCACAGAUAAACUUCUGCA | 20 | 8353 |
| BCL11A-6734 | - | UUUCACAGAUAAACUUCUGCA | 21 | 8354 |
| BCL11A-6735 | - | CUUUCACAGAUAAACUUCUGCA | 22 | 8355 |
| BCL11A-6736 | - | UCUUUCACAGAUAAACUUCUGCA | 23 | 8356 |
| BCL11A-6737 | - | UUCUUUCACAGAUAAACUUCUGCA | 24 | 8357 |
| BCL11A-6738 | - | CCCGUUGGGAGCUCCAGA | 18 | 8358 |
| BCL11A-6739 | - | GCCCGUUGGGAGCUCCAGA | 19 | 8359 |
| BCL11A-5453 | - | GGCCCGUUGGGAGCUCCAGA | 20 | 8360 |
| BCL11A-6740 | - | CGGCCCGUUGGGAGCUCCAGA | 21 | 8361 |
| BCL11A-6741 | - | ACGGCCCGUUGGGAGCUCCAGA | 22 | 8362 |
| BCL11A-6742 | - | CACGGCCCGUUGGGAGCUCCAGA | 23 | 8363 |
| BCL11A-6743 | - | CCACGGCCCGUUGGGAGCUCCAGA | 24 | 8364 |

TABLE 16C-continued

3rd Tier

| gRNA Name | DNA Strand | Targeting Domain | Target Site Length | SEQ ID NO: |
|---|---|---|---|---|
| BCL11A-6744 | - | GUUUAUCAACGUCAUCUA | 18 | 8365 |
| BCL11A-6745 | - | UGUUUAUCAACGUCAUCUA | 19 | 8366 |
| BCL11A-6746 | - | UUGUUUAUCAACGUCAUCUA | 20 | 8367 |
| BCL11A-6747 | - | AUUGUUUAUCAACGUCAUCUA | 21 | 8368 |
| BCL11A-6748 | - | GAUUGUUUAUCAACGUCAUCUA | 22 | 8369 |
| BCL11A-6749 | - | CGAUUGUUUAUCAACGUCAUCUA | 23 | 8370 |
| BCL11A-6750 | - | ACGAUUGUUUAUCAACGUCAUCUA | 24 | 8371 |
| BCL11A-6751 | - | GGGACAUUCUUAUUUUUA | 18 | 8372 |
| BCL11A-6752 | - | GGGGACAUUCUUAUUUUUA | 19 | 8373 |
| BCL11A-6753 | - | GGGGGACAUUCUUAUUUUUA | 20 | 8374 |
| BCL11A-6754 | - | UGGGGGACAUUCUUAUUUUUA | 21 | 8375 |
| BCL11A-6755 | - | UUGGGGGACAUUCUUAUUUUUA | 22 | 8376 |
| BCL11A-6756 | - | AUUGGGGGACAUUCUUAUUUUUA | 23 | 8377 |
| BCL11A-6757 | - | CAUUGGGGGACAUUCUUAUUUUUA | 24 | 8378 |
| BCL11A-6758 | - | GAGGAAUUUGCCCCAAAC | 18 | 8379 |
| BCL11A-6759 | - | AGAGGAAUUUGCCCCAAAC | 19 | 8380 |
| BCL11A-5457 | - | UAGAGGAAUUUGCCCCAAAC | 20 | 8381 |
| BCL11A-6760 | - | CUAGAGGAAUUUGCCCCAAAC | 21 | 8382 |
| BCL11A-6761 | - | UCUAGAGGAAUUUGCCCCAAAC | 22 | 8383 |
| BCL11A-6762 | - | AUCUAGAGGAAUUUGCCCCAAAC | 23 | 8384 |
| BCL11A-6763 | - | CAUCUAGAGGAAUUUGCCCCAAAC | 24 | 8385 |
| BCL11A-6764 | - | ACAGAUAAACUUCUGCAC | 18 | 8386 |
| BCL11A-6765 | - | CACAGAUAAACUUCUGCAC | 19 | 8387 |
| BCL11A-5348 | - | UCACAGAUAAACUUCUGCAC | 20 | 8388 |
| BCL11A-6766 | - | UUCACAGAUAAACUUCUGCAC | 21 | 8389 |
| BCL11A-6767 | - | UUUCACAGAUAAACUUCUGCAC | 22 | 8390 |
| BCL11A-6768 | - | CUUUCACAGAUAAACUUCUGCAC | 23 | 8391 |
| BCL11A-6769 | - | UCUUUCACAGAUAAACUUCUGCAC | 24 | 8392 |
| BCL11A-6770 | - | CCUCCCCUCGUUCUGCAC | 18 | 8393 |
| BCL11A-6771 | - | UCCUCCCCUCGUUCUGCAC | 19 | 8394 |
| BCL11A-6772 | - | CUCCUCCCCUCGUUCUGCAC | 20 | 8395 |
| BCL11A-6773 | - | UCUCCUCCCCUCGUUCUGCAC | 21 | 8396 |
| BCL11A-6774 | - | CUCUCCUCCCCUCGUUCUGCAC | 22 | 8397 |
| BCL11A-6775 | - | CCUCUCCUCCCCUCGUUCUGCAC | 23 | 8398 |
| BCL11A-6776 | - | GCCUCUCCUCCCCUCGUUCUGCAC | 24 | 8399 |
| BCL11A-6777 | - | AAAAAGCAUCCAAUCCC | 18 | 8400 |
| BCL11A-6778 | - | GAAAAAGCAUCCAAUCCC | 19 | 8401 |

TABLE 16C-continued

3rd Tier

| gRNA Name | DNA Strand | Targeting Domain | Target Site Length | SEQ ID NO: |
|---|---|---|---|---|
| BCL11A-6779 | - | UGAAAAAAGCAUCCAAUCCC | 20 | 8402 |
| BCL11A-6780 | - | AUGAAAAAAGCAUCCAAUCCC | 21 | 8403 |
| BCL11A-6781 | - | GAUGAAAAAAGCAUCCAAUCCC | 22 | 8404 |
| BCL11A-6782 | - | AGAUGAAAAAAGCAUCCAAUCCC | 23 | 8405 |
| BCL11A-6783 | - | GAGAUGAAAAAAGCAUCCAAUCCC | 24 | 8406 |
| BCL11A-6784 | - | AGCAGGUAAAUGAGAAGC | 18 | 8407 |
| BCL11A-6785 | - | UAGCAGGUAAAUGAGAAGC | 19 | 8408 |
| BCL11A-6786 | - | AUAGCAGGUAAAUGAGAAGC | 20 | 8409 |
| BCL11A-6787 | - | CAUAGCAGGUAAAUGAGAAGC | 21 | 8410 |
| BCL11A-6788 | - | ACAUAGCAGGUAAAUGAGAAGC | 22 | 8411 |
| BCL11A-6789 | - | CACAUAGCAGGUAAAUGAGAAGC | 23 | 8412 |
| BCL11A-6790 | - | ACACAUAGCAGGUAAAUGAGAAGC | 24 | 8413 |
| BCL11A-6791 | - | GAGCUCUAAUCCCCACGC | 18 | 8414 |
| BCL11A-6792 | - | GGAGCUCUAAUCCCCACGC | 19 | 8415 |
| BCL11A-6793 | - | UGGAGCUCUAAUCCCCACGC | 20 | 8416 |
| BCL11A-6794 | - | AUGGAGCUCUAAUCCCCACGC | 21 | 8417 |
| BCL11A-6795 | - | CAUGGAGCUCUAAUCCCCACGC | 22 | 8418 |
| BCL11A-6796 | - | ACAUGGAGCUCUAAUCCCCACGC | 23 | 8419 |
| BCL11A-6797 | - | CACAUGGAGCUCUAAUCCCCACGC | 24 | 8420 |
| BCL11A-6798 | - | UUGGCAUCCAGGUCACGC | 18 | 8421 |
| BCL11A-6799 | - | GUUGGCAUCCAGGUCACGC | 19 | 8422 |
| BCL11A-6800 | - | GGUUGGCAUCCAGGUCACGC | 20 | 8423 |
| BCL11A-6801 | - | AGGUUGGCAUCCAGGUCACGC | 21 | 8424 |
| BCL11A-6802 | - | GAGGUUGGCAUCCAGGUCACGC | 22 | 8425 |
| BCL11A-6803 | - | GGAGGUUGGCAUCCAGGUCACGC | 23 | 8426 |
| BCL11A-6804 | - | UGGAGGUUGGCAUCCAGGUCACGC | 24 | 8427 |
| BCL11A-6805 | - | UUGUUUAUCAACGUCAUC | 18 | 8428 |
| BCL11A-6806 | - | AUUGUUUAUCAACGUCAUC | 19 | 8429 |
| BCL11A-6807 | - | GAUUGUUUAUCAACGUCAUC | 20 | 8430 |
| BCL11A-6808 | - | CGAUUGUUUAUCAACGUCAUC | 21 | 8431 |
| BCL11A-6809 | - | ACGAUUGUUUAUCAACGUCAUC | 22 | 8432 |
| BCL11A-6810 | - | GACGAUUGUUUAUCAACGUCAUC | 23 | 8433 |
| BCL11A-6811 | - | UGACGAUUGUUUAUCAACGUCAUC | 24 | 8434 |
| BCL11A-6812 | - | CAACCACAGCCGAGCCUC | 18 | 8435 |
| BCL11A-6813 | - | CCAACCACAGCCGAGCCUC | 19 | 8436 |
| BCL11A-6814 | - | UCCAACCACAGCCGAGCCUC | 20 | 8437 |
| BCL11A-6815 | - | CUCCAACCACAGCCGAGCCUC | 21 | 8438 |
| BCL11A-6816 | - | UCUCCAACCACAGCCGAGCCUC | 22 | 8439 |

TABLE 16C-continued

| | | 3rd Tier | | |
|---|---|---|---|---|
| gRNA Name | DNA Strand | Targeting Domain | Target Site Length | SEQ ID NO: |
| BCL11A-6817 | - | UUCUCCAACCACAGCCGAGCCUC | 23 | 8440 |
| BCL11A-6818 | - | UUUCUCCAACCACAGCCGAGCCUC | 24 | 8441 |
| BCL11A-6819 | - | ACGGCCCGUUGGGAGCUC | 18 | 8442 |
| BCL11A-6820 | - | CACGGCCCGUUGGGAGCUC | 19 | 8443 |
| BCL11A-6821 | - | CCACGGCCCGUUGGGAGCUC | 20 | 8444 |
| BCL11A-6822 | - | ACCACGGCCCGUUGGGAGCUC | 21 | 8445 |
| BCL11A-6823 | - | GACCACGGCCCGUUGGGAGCUC | 22 | 8446 |
| BCL11A-6824 | - | AGACCACGGCCCGUUGGGAGCUC | 23 | 8447 |
| BCL11A-6825 | - | CAGACCACGGCCCGUUGGGAGCUC | 24 | 8448 |
| BCL11A-6826 | - | AUUAUUUGCAGGUAAAG | 18 | 8449 |
| BCL11A-6827 | - | UAUUAUUUGCAGGUAAAG | 19 | 8450 |
| BCL11A-6828 | - | GUAUUAUUUGCAGGUAAAG | 20 | 8451 |
| BCL11A-6829 | - | UGUAUUAUUUGCAGGUAAAG | 21 | 8452 |
| BCL11A-6830 | - | UUGUAUUAUUUGCAGGUAAAG | 22 | 8453 |
| BCL11A-6831 | - | GUUGUAUUAUUUGCAGGUAAAG | 23 | 8454 |
| BCL11A-6832 | - | UGUUGUAUUAUUUGCAGGUAAAG | 24 | 8455 |
| BCL11A-6833 | - | AGGUAAAUGAGAAGCAAG | 18 | 8456 |
| BCL11A-6834 | - | CAGGUAAAUGAGAAGCAAG | 19 | 8457 |
| BCL11A-6835 | - | GCAGGUAAAUGAGAAGCAAG | 20 | 8458 |
| BCL11A-6836 | - | AGCAGGUAAAUGAGAAGCAAG | 21 | 8459 |
| BCL11A-6837 | - | UAGCAGGUAAAUGAGAAGCAAG | 22 | 8460 |
| BCL11A-6838 | - | AUAGCAGGUAAAUGAGAAGCAAG | 23 | 8461 |
| BCL11A-6839 | - | CAUAGCAGGUAAAUGAGAAGCAAG | 24 | 8462 |
| BCL11A-6840 | - | CCGCAGGGUAUUUGUAAG | 18 | 8463 |
| BCL11A-6841 | - | CCCGCAGGGUAUUUGUAAG | 19 | 8464 |
| BCL11A-6842 | - | CCCCGCAGGGUAUUUGUAAG | 20 | 8465 |
| BCL11A-6843 | - | GCCCCGCAGGGUAUUUGUAAG | 21 | 8466 |
| BCL11A-6844 | - | UGCCCCGCAGGGUAUUUGUAAG | 22 | 8467 |
| BCL11A-6845 | - | AUGCCCCGCAGGGUAUUUGUAAG | 23 | 8468 |
| BCL11A-6846 | - | UAUGCCCCGCAGGGUAUUUGUAAG | 24 | 8469 |
| BCL11A-6847 | - | UUGUUUCUCCAACCACAG | 18 | 8470 |
| BCL11A-6848 | - | UUUGUUUCUCCAACCACAG | 19 | 8471 |
| BCL11A-6849 | - | UUUUGUUUCUCCAACCACAG | 20 | 8472 |
| BCL11A-6850 | - | CUUUUGUUUCUCCAACCACAG | 21 | 8473 |
| BCL11A-6851 | - | GCUUUUGUUUCUCCAACCACAG | 22 | 8474 |
| BCL11A-6852 | - | UGCUUUUGUUUCUCCAACCACAG | 23 | 8475 |
| BCL11A-6853 | - | GUGCUUUUGUUUCUCCAACCACAG | 24 | 8476 |

TABLE 16C-continued

3rd Tier

| gRNA Name | DNA Strand | Targeting Domain | Target Site Length | SEQ ID NO: |
|---|---|---|---|---|
| BCL11A-6854 | - | ACCUGUGGGCAGUGCCAG | 18 | 8477 |
| BCL11A-6855 | - | CACCUGUGGGCAGUGCCAG | 19 | 8478 |
| BCL11A-6856 | - | UCACCUGUGGGCAGUGCCAG | 20 | 8479 |
| BCL11A-6857 | - | CUCACCUGUGGGCAGUGCCAG | 21 | 8480 |
| BCL11A-6858 | - | CCUCACCUGUGGGCAGUGCCAG | 22 | 8481 |
| BCL11A-6859 | - | UCCUCACCUGUGGGCAGUGCCAG | 23 | 8482 |
| BCL11A-6860 | - | CUCCUCACCUGUGGGCAGUGCCAG | 24 | 8483 |
| BCL11A-6861 | - | GCCCGUUGGGAGCUCCAG | 18 | 8484 |
| BCL11A-6862 | - | GGCCCGUUGGGAGCUCCAG | 19 | 8485 |
| BCL11A-6863 | - | CGGCCCGUUGGGAGCUCCAG | 20 | 8486 |
| BCL11A-6864 | - | ACGGCCCGUUGGGAGCUCCAG | 21 | 8487 |
| BCL11A-6865 | - | CACGGCCCGUUGGGAGCUCCAG | 22 | 8488 |
| BCL11A-6866 | - | CCACGGCCCGUUGGGAGCUCCAG | 23 | 8489 |
| BCL11A-6867 | - | ACCACGGCCCGUUGGGAGCUCCAG | 24 | 8490 |
| BCL11A-6868 | - | UCCCCUUCACCAAUCGAG | 18 | 8491 |
| BCL11A-6869 | - | UUCCCCUUCACCAAUCGAG | 19 | 8492 |
| BCL11A-6870 | - | CUUCCCCUUCACCAAUCGAG | 20 | 8493 |
| BCL11A-6871 | - | CCUUCCCCUUCACCAAUCGAG | 21 | 8494 |
| BCL11A-6872 | - | ACCUUCCCCUUCACCAAUCGAG | 22 | 8495 |
| BCL11A-6873 | - | CACCUUCCCCUUCACCAAUCGAG | 23 | 8496 |
| BCL11A-6874 | - | CCACCUUCCCCUUCACCAAUCGAG | 24 | 8497 |
| BCL11A-6875 | - | GAACCAGACCACGGCCCG | 18 | 8498 |
| BCL11A-6876 | - | UGAACCAGACCACGGCCCG | 19 | 8499 |
| BCL11A-6877 | - | AUGAACCAGACCACGGCCCG | 20 | 8500 |
| BCL11A-6878 | - | GAUGAACCAGACCACGGCCCG | 21 | 8501 |
| BCL11A-6879 | - | UGAUGAACCAGACCACGGCCCG | 22 | 8502 |
| BCL11A-6880 | - | AUGAUGAACCAGACCACGGCCCG | 23 | 8503 |
| BCL11A-6881 | - | GAUGAUGAACCAGACCACGGCCCG | 24 | 8504 |
| BCL11A-6882 | - | AAAAGCAUCCAAUCCCG | 18 | 8505 |
| BCL11A-6883 | - | AAAAAGCAUCCAAUCCCG | 19 | 8506 |
| BCL11A-5358 | - | GAAAAAGCAUCCAAUCCCG | 20 | 8507 |
| BCL11A-6884 | - | UGAAAAAGCAUCCAAUCCCG | 21 | 8508 |
| BCL11A-6885 | - | AUGAAAAAGCAUCCAAUCCCG | 22 | 8509 |
| BCL11A-6886 | - | GAUGAAAAAGCAUCCAAUCCCG | 23 | 8510 |
| BCL11A-6887 | - | AGAUGAAAAAGCAUCCAAUCCCG | 24 | 8511 |
| BCL11A-6888 | - | GAUAAACUUCUGCACUGG | 18 | 8512 |
| BCL11A-6889 | - | AGAUAAACUUCUGCACUGG | 19 | 8513 |
| BCL11A-5360 | - | CAGAUAAACUUCUGCACUGG | 20 | 8514 |

TABLE 16C-continued

3rd Tier

| gRNA Name | DNA Strand | Targeting Domain | Target Site Length | SEQ ID NO: |
|---|---|---|---|---|
| BCL11A-6890 | - | ACAGAUAAACUUCUGCACUGG | 21 | 8515 |
| BCL11A-6891 | - | CACAGAUAAACUUCUGCACUGG | 22 | 8516 |
| BCL11A-6892 | - | UCACAGAUAAACUUCUGCACUGG | 23 | 8517 |
| BCL11A-6893 | - | UUCACAGAUAAACUUCUGCACUGG | 24 | 8518 |
| BCL11A-6894 | - | AAGCCAUUCUUACAGAUG | 18 | 8519 |
| BCL11A-6895 | - | GAAGCCAUUCUUACAGAUG | 19 | 8520 |
| BCL11A-6896 | - | UGAAGCCAUUCUUACAGAUG | 20 | 8521 |
| BCL11A-6897 | - | UUGAAGCCAUUCUUACAGAUG | 21 | 8522 |
| BCL11A-6898 | - | CUUGAAGCCAUUCUUACAGAUG | 22 | 8523 |
| BCL11A-6899 | - | UCUUGAAGCCAUUCUUACAGAUG | 23 | 8524 |
| BCL11A-6900 | - | CUCUUGAAGCCAUUCUUACAGAUG | 24 | 8525 |
| BCL11A-6901 | - | AGAUAAACUUCUGCACUG | 18 | 8526 |
| BCL11A-6902 | - | CAGAUAAACUUCUGCACUG | 19 | 8527 |
| BCL11A-6903 | - | ACAGAUAAACUUCUGCACUG | 20 | 8528 |
| BCL11A-6904 | - | CACAGAUAAACUUCUGCACUG | 21 | 8529 |
| BCL11A-6905 | - | UCACAGAUAAACUUCUGCACUG | 22 | 8530 |
| BCL11A-6906 | - | UUCACAGAUAAACUUCUGCACUG | 23 | 8531 |
| BCL11A-6907 | - | UUUCACAGAUAAACUUCUGCACUG | 24 | 8532 |
| BCL11A-6908 | - | CAGAUGAACUUCCCAUUG | 18 | 8533 |
| BCL11A-6909 | - | CCAGAUGAACUUCCCAUUG | 19 | 8534 |
| BCL11A-5499 | - | GCCAGAUGAACUUCCCAUUG | 20 | 8535 |
| BCL11A-6910 | - | UGCCAGAUGAACUUCCCAUUG | 21 | 8536 |
| BCL11A-6911 | - | GUGCCAGAUGAACUUCCCAUUG | 22 | 8537 |
| BCL11A-6912 | - | AGUGCCAGAUGAACUUCCCAUUG | 23 | 8538 |
| BCL11A-6913 | - | CAGUGCCAGAUGAACUUCCCAUUG | 24 | 8539 |
| BCL11A-6914 | - | AACACAUAGCAGGUAAAU | 18 | 8540 |
| BCL11A-6915 | - | GAACACAUAGCAGGUAAAU | 19 | 8541 |
| BCL11A-6916 | - | GGAACACAUAGCAGGUAAAU | 20 | 8542 |
| BCL11A-6917 | - | AGGAACACAUAGCAGGUAAAU | 21 | 8543 |
| BCL11A-6918 | - | CAGGAACACAUAGCAGGUAAAU | 22 | 8544 |
| BCL11A-6919 | - | ACAGGAACACAUAGCAGGUAAAU | 23 | 8545 |
| BCL11A-6920 | - | AACAGGAACACAUAGCAGGUAAAU | 24 | 8546 |
| BCL11A-6921 | - | GCCAGAUGAACUUCCCAU | 18 | 8547 |
| BCL11A-6922 | - | UGCCAGAUGAACUUCCCAU | 19 | 8548 |
| BCL11A-5503 | - | GUGCCAGAUGAACUUCCCAU | 20 | 8549 |
| BCL11A-6923 | - | AGUGCCAGAUGAACUUCCCAU | 21 | 8550 |
| BCL11A-6924 | - | CAGUGCCAGAUGAACUUCCCAU | 22 | 8551 |

TABLE 16C-continued

3rd Tier

| gRNA Name | DNA Strand | Targeting Domain | Target Site Length | SEQ ID NO: |
|---|---|---|---|---|
| BCL11A-6925 | - | GCAGUGCCAGAUGAACUUCCCAU | 23 | 8552 |
| BCL11A-6926 | - | GGCAGUGCCAGAUGAACUUCCCAU | 24 | 8553 |
| BCL11A-6927 | - | AUCAUGACCUCCUCACCU | 18 | 8554 |
| BCL11A-6928 | - | GAUCAUGACCUCCUCACCU | 19 | 8555 |
| BCL11A-6929 | - | GGAUCAUGACCUCCUCACCU | 20 | 8556 |
| BCL11A-6930 | - | GGGAUCAUGACCUCCUCACCU | 21 | 8557 |
| BCL11A-6931 | - | GGGGAUCAUGACCUCCUCACCU | 22 | 8558 |
| BCL11A-6932 | - | AGGGGAUCAUGACCUCCUCACCU | 23 | 8559 |
| BCL11A-6933 | - | AAGGGGAUCAUGACCUCCUCACCU | 24 | 8560 |
| BCL11A-6934 | - | GCAAUGGCAGCCUCUGCU | 18 | 8561 |
| BCL11A-6935 | - | UGCAAUGGCAGCCUCUGCU | 19 | 8562 |
| BCL11A-6936 | - | AUGCAAUGGCAGCCUCUGCU | 20 | 8563 |
| BCL11A-6937 | - | AAUGCAAUGGCAGCCUCUGCU | 21 | 8564 |
| BCL11A-6938 | - | CAAUGCAAUGGCAGCCUCUGCU | 22 | 8565 |
| BCL11A-6939 | - | ACAAUGCAAUGGCAGCCUCUGCU | 23 | 8566 |
| BCL11A-6940 | - | AACAAUGCAAUGGCAGCCUCUGCU | 24 | 8567 |
| BCL11A-6941 | - | AACCAGACCACGGCCCGU | 18 | 8568 |
| BCL11A-6942 | - | GAACCAGACCACGGCCCGU | 19 | 8569 |
| BCL11A-5363 | - | UGAACCAGACCACGGCCCGU | 20 | 8570 |
| BCL11A-6943 | - | AUGAACCAGACCACGGCCCGU | 21 | 8571 |
| BCL11A-6944 | - | GAUGAACCAGACCACGGCCCGU | 22 | 8572 |
| BCL11A-6945 | - | UGAUGAACCAGACCACGGCCCGU | 23 | 8573 |
| BCL11A-6946 | - | AUGAUGAACCAGACCACGGCCCGU | 24 | 8574 |
| BCL11A-6947 | - | CCAGAUGAACUUCCCAUU | 18 | 8575 |
| BCL11A-6948 | - | GCCAGAUGAACUUCCCAUU | 19 | 8576 |
| BCL11A-5511 | - | UGCCAGAUGAACUUCCCAUU | 20 | 8577 |
| BCL11A-6949 | - | GUGCCAGAUGAACUUCCCAUU | 21 | 8578 |
| BCL11A-6950 | - | AGUGCCAGAUGAACUUCCCAUU | 22 | 8579 |
| BCL11A-6951 | - | CAGUGCCAGAUGAACUUCCCAUU | 23 | 8580 |
| BCL11A-6952 | - | GCAGUGCCAGAUGAACUUCCCAUU | 24 | 8581 |
| BCL11A-6953 | - | ACCAGACCACGGCCCGUU | 18 | 8582 |
| BCL11A-6954 | - | AACCAGACCACGGCCCGUU | 19 | 8583 |
| BCL11A-5512 | - | GAACCAGACCACGGCCCGUU | 20 | 8584 |
| BCL11A-6955 | - | UGAACCAGACCACGGCCCGUU | 21 | 8585 |
| BCL11A-6956 | - | AUGAACCAGACCACGGCCCGUU | 22 | 8586 |
| BCL11A-6957 | - | GAUGAACCAGACCACGGCCCGUU | 23 | 8587 |
| BCL11A-6958 | - | UGAUGAACCAGACCACGGCCCGUU | 24 | 8588 |

Table 16D provides exemplary targeting domains for knocking out the BCL11A gene selected according to the fourth tier parameters. The targeting domains fall in the coding sequence of the gene, downstream of the first 500 bp of coding sequence (e.g., anywhere from +500 (relative to the start codon) to the stop codon of the gene), and the PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 16D

4th Tier

| gRNA Name | DNA Strand | Targeting Domain | Target Site Length | SEQ ID NO: |
|---|---|---|---|---|
| BCL11A-6959 | + | GUAUUCUUAGCAGGUUAA | 18 | 8589 |
| BCL11A-6960 | + | GGUAUUCUUAGCAGGUUAA | 19 | 8590 |
| BCL11A-5890 | + | UGGUAUUCUUAGCAGGUUAA | 20 | 8591 |
| BCL11A-6961 | + | CUGGUAUUCUUAGCAGGUUAA | 21 | 8592 |
| BCL11A-6962 | + | CCUGGUAUUCUUAGCAGGUUAA | 22 | 8593 |
| BCL11A-6963 | + | UCCUGGUAUUCUUAGCAGGUUAA | 23 | 8594 |
| BCL11A-6964 | + | AUCCUGGUAUUCUUAGCAGGUUAA | 24 | 8595 |
| BCL11A-6965 | + | CGGGAGGCUCCAUAGCCA | 18 | 8596 |
| BCL11A-6966 | + | GCGGGAGGCUCCAUAGCCA | 19 | 8597 |
| BCL11A-6967 | + | GGCGGGAGGCUCCAUAGCCA | 20 | 8598 |
| BCL11A-6968 | + | UGGCGGGAGGCUCCAUAGCCA | 21 | 8599 |
| BCL11A-6969 | + | AUGGCGGGAGGCUCCAUAGCCA | 22 | 8600 |
| BCL11A-6970 | + | CAUGGCGGGAGGCUCCAUAGCCA | 23 | 8601 |
| BCL11A-6971 | + | CCAUGGCGGGAGGCUCCAUAGCCA | 24 | 8602 |
| BCL11A-6972 | + | GGUCCGACUCGCCGGCCA | 18 | 8603 |
| BCL11A-6973 | + | CGGUCCGACUCGCCGGCCA | 19 | 8604 |
| BCL11A-6974 | + | GCGGUCCGACUCGCCGGCCA | 20 | 8605 |
| BCL11A-6975 | + | UGCGGUCCGACUCGCCGGCCA | 21 | 8606 |
| BCL11A-6976 | + | AUGCGGUCCGACUCGCCGGCCA | 22 | 8607 |
| BCL11A-6977 | + | UAUGCGGUCCGACUCGCCGGCCA | 23 | 8608 |
| BCL11A-6978 | + | CUAUGCGGUCCGACUCGCCGGCCA | 24 | 8609 |
| BCL11A-6979 | + | AGUCUCCGAAGCUAAGGA | 18 | 8610 |
| BCL11A-6980 | + | GAGUCUCCGAAGCUAAGGA | 19 | 8611 |
| BCL11A-5923 | + | GGAGUCUCCGAAGCUAAGGA | 20 | 8612 |
| BCL11A-6981 | + | UGGAGUCUCCGAAGCUAAGGA | 21 | 8613 |
| BCL11A-6982 | + | CUGGAGUCUCCGAAGCUAAGGA | 22 | 8614 |
| BCL11A-6983 | + | UCUGGAGUCUCCGAAGCUAAGGA | 23 | 8615 |
| BCL11A-6984 | + | GUCUGGAGUCUCCGAAGCUAAGGA | 24 | 8616 |
| BCL11A-6985 | + | GGACUAAACAGGGGGGA | 18 | 8617 |
| BCL11A-6986 | + | UGGACUAAACAGGGGGGA | 19 | 8618 |
| BCL11A-6987 | + | GUGGACUAAACAGGGGGGA | 20 | 8619 |
| BCL11A-6988 | + | GGUGGACUAAACAGGGGGGA | 21 | 8620 |
| BCL11A-6989 | + | UGGUGGACUAAACAGGGGGGA | 22 | 8621 |
| BCL11A-6990 | + | GUGGUGGACUAAACAGGGGGGA | 23 | 8622 |

TABLE 16D-continued

4th Tier

| gRNA Name | DNA Strand | Targeting Domain | Target Site Length | SEQ ID NO: |
|---|---|---|---|---|
| BCL11A-6991 | + | GGUGGUGGACUAAACAGGGGGGA | 24 | 8623 |
| BCL11A-6992 | + | UUCUGCACCUAGUCCUGA | 18 | 8624 |
| BCL11A-6993 | + | AUUCUGCACCUAGUCCUGA | 19 | 8625 |
| BCL11A-5937 | + | CAUUCUGCACCUAGUCCUGA | 20 | 8626 |
| BCL11A-6994 | + | ACAUUCUGCACCUAGUCCUGA | 21 | 8627 |
| BCL11A-6995 | + | GACAUUCUGCACCUAGUCCUGA | 22 | 8628 |
| BCL11A-6996 | + | GGACAUUCUGCACCUAGUCCUGA | 23 | 8629 |
| BCL11A-6997 | + | AGGACAUUCUGCACCUAGUCCUGA | 24 | 8630 |
| BCL11A-6998 | + | GCACCCUGUCAAAGGCAC | 18 | 8631 |
| BCL11A-6999 | + | AGCACCCUGUCAAAGGCAC | 19 | 8632 |
| BCL11A-7000 | + | CAGCACCCUGUCAAAGGCAC | 20 | 8633 |
| BCL11A-7001 | + | GCAGCACCCUGUCAAAGGCAC | 21 | 8634 |
| BCL11A-7002 | + | CGCAGCACCCUGUCAAAGGCAC | 22 | 8635 |
| BCL11A-7003 | + | CCGCAGCACCCUGUCAAAGGCAC | 23 | 8636 |
| BCL11A-7004 | + | ACCGCAGCACCCUGUCAAAGGCAC | 24 | 8637 |
| BCL11A-7005 | + | UAAGUAGAUUCUUAAUCC | 18 | 8638 |
| BCL11A-7006 | + | CUAAGUAGAUUCUUAAUCC | 19 | 8639 |
| BCL11A-7007 | + | UCUAAGUAGAUUCUUAAUCC | 20 | 8640 |
| BCL11A-7008 | + | UUCUAAGUAGAUUCUUAAUCC | 21 | 8641 |
| BCL11A-7009 | + | UUUCUAAGUAGAUUCUUAAUCC | 22 | 8642 |
| BCL11A-7010 | + | CUUUCUAAGUAGAUUCUUAAUCC | 23 | 8643 |
| BCL11A-7011 | + | GCUUUCUAAGUAGAUUCUUAAUCC | 24 | 8644 |
| BCL11A-7012 | + | GGCGGCUUGCUACCUGGC | 18 | 8645 |
| BCL11A-7013 | + | GGGCGGCUUGCUACCUGGC | 19 | 8646 |
| BCL11A-6036 | + | AGGGCGGCUUGCUACCUGGC | 20 | 8647 |
| BCL11A-7014 | + | AAGGGCGGCUUGCUACCUGGC | 21 | 8648 |
| BCL11A-7015 | + | GAAGGGCGGCUUGCUACCUGGC | 22 | 8649 |
| BCL11A-7016 | + | GGAAGGGCGGCUUGCUACCUGGC | 23 | 8650 |
| BCL11A-7017 | + | AGGAAGGGCGGCUUGCUACCUGGC | 24 | 8651 |
| BCL11A-7018 | + | GCGCUUCAGCUUGCUGGC | 18 | 8652 |
| BCL11A-7019 | + | GGCGCUUCAGCUUGCUGGC | 19 | 8653 |
| BCL11A-7020 | + | UGGCGCUUCAGCUUGCUGGC | 20 | 8654 |
| BCL11A-7021 | + | GUGGCGCUUCAGCUUGCUGGC | 21 | 8655 |
| BCL11A-7022 | + | UGUGGCGCUUCAGCUUGCUGGC | 22 | 8656 |
| BCL11A-7023 | + | AUGUGGCGCUUCAGCUUGCUGGC | 23 | 8657 |
| BCL11A-7024 | + | CAUGUGGCGCUUCAGCUUGCUGGC | 24 | 8658 |
| BCL11A-7025 | + | CUCCUCGUCCCCGUUCUC | 18 | 8659 |

TABLE 16D-continued

4th Tier

| gRNA Name | DNA Strand | Targeting Domain | Target Site Length | SEQ ID NO: |
|---|---|---|---|---|
| BCL11A-7026 | + | CCUCCUCGUCCCCGUUCUC | 19 | 8660 |
| BCL11A-6050 | + | UCCUCCUCGUCCCCGUUCUC | 20 | 8661 |
| BCL11A-7027 | + | UUCCUCCUCGUCCCCGUUCUC | 21 | 8662 |
| BCL11A-7028 | + | CUUCCUCCUCGUCCCCGUUCUC | 22 | 8663 |
| BCL11A-7029 | + | UCUUCCUCCUCGUCCCCGUUCUC | 23 | 8664 |
| BCL11A-7030 | + | CUCUUCCUCCUCGUCCCCGUUCUC | 24 | 8665 |
| BCL11A-7031 | + | AGGCAAAAGGCGAUUGUC | 18 | 8666 |
| BCL11A-7032 | + | GAGGCAAAAGGCGAUUGUC | 19 | 8667 |
| BCL11A-6054 | + | GGAGGCAAAAGGCGAUUGUC | 20 | 8668 |
| BCL11A-7033 | + | AGGAGGCAAAAGGCGAUUGUC | 21 | 8669 |
| BCL11A-7034 | + | GAGGAGGCAAAAGGCGAUUGUC | 22 | 8670 |
| BCL11A-7035 | + | CGAGGAGGCAAAAGGCGAUUGUC | 23 | 8671 |
| BCL11A-7036 | + | ACGAGGAGGCAAAAGGCGAUUGUC | 24 | 8672 |
| BCL11A-7037 | + | AGCUCUCUGGGUACUACG | 18 | 8673 |
| BCL11A-7038 | + | GAGCUCUCUGGGUACUACG | 19 | 8674 |
| BCL11A-7039 | + | UGAGCUCUCUGGGUACUACG | 20 | 8675 |
| BCL11A-7040 | + | UUGAGCUCUCUGGGUACUACG | 21 | 8676 |
| BCL11A-7041 | + | CUUGAGCUCUCUGGGUACUACG | 22 | 8677 |
| BCL11A-7042 | + | UCUUGAGCUCUCUGGGUACUACG | 23 | 8678 |
| BCL11A-7043 | + | AUCUUGAGCUCUCUGGGUACUACG | 24 | 8679 |
| BCL11A-7044 | + | UGAAGGGAUACCAACCCG | 18 | 8680 |
| BCL11A-7045 | + | CUGAAGGGAUACCAACCCG | 19 | 8681 |
| BCL11A-6084 | + | CCUGAAGGGAUACCAACCCG | 20 | 8682 |
| BCL11A-7046 | + | UCCUGAAGGGAUACCAACCCG | 21 | 8683 |
| BCL11A-7047 | + | GUCCUGAAGGGAUACCAACCCG | 22 | 8684 |
| BCL11A-7048 | + | AGUCCUGAAGGGAUACCAACCCG | 23 | 8685 |
| BCL11A-7049 | + | UAGUCCUGAAGGGAUACCAACCCG | 24 | 8686 |
| BCL11A-7050 | + | GCAAACUCCCGUUCUCCG | 18 | 8687 |
| BCL11A-7051 | + | CGCAAACUCCCGUUCUCCG | 19 | 8688 |
| BCL11A-6094 | + | GCGCAAACUCCCGUUCUCCG | 20 | 8689 |
| BCL11A-7052 | + | AGCGCAAACUCCCGUUCUCCG | 21 | 8690 |
| BCL11A-7053 | + | AAGCGCAAACUCCCGUUCUCCG | 22 | 8691 |
| BCL11A-7054 | + | GAAGCGCAAACUCCCGUUCUCCG | 23 | 8692 |
| BCL11A-7055 | + | AGAAGCGCAAACUCCCGUUCUCCG | 24 | 8693 |
| BCL11A-7056 | + | GGCUGGGAGGGAGGAGGG | 18 | 8694 |
| BCL11A-7057 | + | GGGCUGGGAGGGAGGAGGG | 19 | 8695 |
| BCL11A-7058 | + | GGGGCUGGGAGGGAGGAGGG | 20 | 8696 |
| BCL11A-7059 | + | GGGGGCUGGGAGGGAGGAGGG | 21 | 8697 |

TABLE 16D-continued

4th Tier

| gRNA Name | DNA Strand | Targeting Domain | Target Site Length | SEQ ID NO: |
|---|---|---|---|---|
| BCL11A-7060 | + | CGGGGGCUGGGAGGGAGGAGGG | 22 | 8698 |
| BCL11A-7061 | + | CCGGGGGCUGGGAGGGAGGAGGG | 23 | 8699 |
| BCL11A-7062 | + | ACCGGGGGCUGGGAGGGAGGAGGG | 24 | 8700 |
| BCL11A-7063 | + | UGGUGGACUAAACAGGGG | 18 | 8701 |
| BCL11A-7064 | + | GUGGUGGACUAAACAGGGG | 19 | 8702 |
| BCL11A-6139 | + | GGUGGUGGACUAAACAGGGG | 20 | 8703 |
| BCL11A-7065 | + | CGGUGGUGGACUAAACAGGGG | 21 | 8704 |
| BCL11A-7066 | + | UCGGUGGUGGACUAAACAGGGG | 22 | 8705 |
| BCL11A-7067 | + | CUCGGUGGUGGACUAAACAGGGG | 23 | 8706 |
| BCL11A-7068 | + | UCUCGGUGGUGGACUAAACAGGGG | 24 | 8707 |
| BCL11A-7069 | + | AAGAGAAACCAUGCACUG | 18 | 8708 |
| BCL11A-7070 | + | CAAGAGAAACCAUGCACUG | 19 | 8709 |
| BCL11A-7071 | + | GCAAGAGAAACCAUGCACUG | 20 | 8710 |
| BCL11A-7072 | + | UGCAAGAGAAACCAUGCACUG | 21 | 8711 |
| BCL11A-7073 | + | UUGCAAGAGAAACCAUGCACUG | 22 | 8712 |
| BCL11A-7074 | + | GUUGCAAGAGAAACCAUGCACUG | 23 | 8713 |
| BCL11A-7075 | + | UGUUGCAAGAGAAACCAUGCACUG | 24 | 8714 |
| BCL11A-7076 | + | GUCAAAGGCACUCGGGUG | 18 | 8715 |
| BCL11A-7077 | + | UGUCAAAGGCACUCGGGUG | 19 | 8716 |
| BCL11A-7078 | + | CUGUCAAAGGCACUCGGGUG | 20 | 8717 |
| BCL11A-7079 | + | CCUGUCAAAGGCACUCGGGUG | 21 | 8718 |
| BCL11A-7080 | + | CCCUGUCAAAGGCACUCGGGUG | 22 | 8719 |
| BCL11A-7081 | + | ACCCUGUCAAAGGCACUCGGGUG | 23 | 8720 |
| BCL11A-7082 | + | CACCCUGUCAAAGGCACUCGGGUG | 24 | 8721 |
| BCL11A-7083 | + | CCCACCAAGUCGCUGGUG | 18 | 8722 |
| BCL11A-7084 | + | GCCCACCAAGUCGCUGGUG | 19 | 8723 |
| BCL11A-7085 | + | UGCCCACCAAGUCGCUGGUG | 20 | 8724 |
| BCL11A-7086 | + | CUGCCCACCAAGUCGCUGGUG | 21 | 8725 |
| BCL11A-7087 | + | GCUGCCCACCAAGUCGCUGGUG | 22 | 8726 |
| BCL11A-7088 | + | CGCUGCCCACCAAGUCGCUGGUG | 23 | 8727 |
| BCL11A-7089 | + | GCGCUGCCCACCAAGUCGCUGGUG | 24 | 8728 |
| BCL11A-7090 | + | GGGGUUAUUGUCUGCAAU | 18 | 8729 |
| BCL11A-7091 | + | AGGGGUUAUUGUCUGCAAU | 19 | 8730 |
| BCL11A-7092 | + | AAGGGGUUAUUGUCUGCAAU | 20 | 8731 |
| BCL11A-7093 | + | AAAGGGGUUAUUGUCUGCAAU | 21 | 8732 |
| BCL11A-7094 | + | UAAAGGGGUUAUUGUCUGCAAU | 22 | 8733 |
| BCL11A-7095 | + | UUAAAGGGGUUAUUGUCUGCAAU | 23 | 8734 |

TABLE 16D-continued

4th Tier

| gRNA Name | DNA Strand | Targeting Domain | Target Site Length | SEQ ID NO: |
|---|---|---|---|---|
| BCL11A-7096 | + | GUUAAGGGGUUAUUGUCUGCAAU | 24 | 8735 |
| BCL11A-7097 | + | CUGGGUACUACGCCGAAU | 18 | 8736 |
| BCL11A-7098 | + | UCUGGGUACUACGCCGAAU | 19 | 8737 |
| BCL11A-6182 | + | CUCUGGGUACUACGCCGAAU | 20 | 8738 |
| BCL11A-7099 | + | UCUCUGGGUACUACGCCGAAU | 21 | 8739 |
| BCL11A-7100 | + | CUCUCUGGGUACUACGCCGAAU | 22 | 8740 |
| BCL11A-7101 | + | GCUCUCUGGGUACUACGCCGAAU | 23 | 8741 |
| BCL11A-7102 | + | AGCUCUCUGGGUACUACGCCGAAU | 24 | 8742 |
| BCL11A-7103 | + | CGUAGCCGGCGAGCCACU | 18 | 8743 |
| BCL11A-7104 | + | GCGUAGCCGGCGAGCCACU | 19 | 8744 |
| BCL11A-7105 | + | CGCGUAGCCGGCGAGCCACU | 20 | 8745 |
| BCL11A-7106 | + | CCGCGUAGCCGGCGAGCCACU | 21 | 8746 |
| BCL11A-7107 | + | GCCGCGUAGCCGGCGAGCCACU | 22 | 8747 |
| BCL11A-7108 | + | GGCCGCGUAGCCGGCGAGCCACU | 23 | 8748 |
| BCL11A-7109 | + | AGGCCGCGUAGCCGGCGAGCCACU | 24 | 8749 |
| BCL11A-7110 | + | CCACACAUCUUGAGCUCU | 18 | 8750 |
| BCL11A-7111 | + | GCCACACAUCUUGAGCUCU | 19 | 8751 |
| BCL11A-7112 | + | UGCCACACAUCUUGAGCUCU | 20 | 8752 |
| BCL11A-7113 | + | CUGCCACACAUCUUGAGCUCU | 21 | 8753 |
| BCL11A-7114 | + | ACUGCCACACAUCUUGAGCUCU | 22 | 8754 |
| BCL11A-7115 | + | AACUGCCACACAUCUUGAGCUCU | 23 | 8755 |
| BCL11A-7116 | + | AAACUGCCACACAUCUUGAGCUCU | 24 | 8756 |
| BCL11A-7117 | + | CGUUCUCCGGGAUCAGGU | 18 | 8757 |
| BCL11A-7118 | + | CCGUUCUCCGGGAUCAGGU | 19 | 8758 |
| BCL11A-6223 | + | CCCGUUCUCCGGGAUCAGGU | 20 | 8759 |
| BCL11A-7119 | + | CCCCGUUCUCCGGGAUCAGGU | 21 | 8760 |
| BCL11A-7120 | + | UCCCCGUUCUCCGGGAUCAGGU | 22 | 8761 |
| BCL11A-7121 | + | GUCCCCGUUCUCCGGGAUCAGGU | 23 | 8762 |
| BCL11A-7122 | + | CGUCCCCGUUCUCCGGGAUCAGGU | 24 | 8763 |
| BCL11A-7123 | + | CCAGGCGCUCUAUGCGGU | 18 | 8764 |
| BCL11A-7124 | + | CCCAGGCGCUCUAUGCGGU | 19 | 8765 |
| BCL11A-6226 | + | CCCCAGGCGCUCUAUGCGGU | 20 | 8766 |
| BCL11A-7125 | + | CCCCCAGGCGCUCUAUGCGGU | 21 | 8767 |
| BCL11A-7126 | + | GCCCCCAGGCGCUCUAUGCGGU | 22 | 8768 |
| BCL11A-7127 | + | CGCCCCCAGGCGCUCUAUGCGGU | 23 | 8769 |
| BCL11A-7128 | + | CCGCCCCCAGGCGCUCUAUGCGGU | 24 | 8770 |
| BCL11A-7129 | - | UUCCCAGCCACCUCUCCA | 18 | 8771 |
| BCL11A-7130 | - | CUUCCCAGCCACCUCUCCA | 19 | 8772 |

TABLE 16D-continued

4th Tier

| gRNA Name | DNA Strand | Targeting Domain | Target Site Length | SEQ ID NO: |
|---|---|---|---|---|
| BCL11A-5903 | - | CCUUCCCAGCCACCUCUCCA | 20 | 8773 |
| BCL11A-7131 | - | UCCUUCCCAGCCACCUCUCCA | 21 | 8774 |
| BCL11A-7132 | - | GUCCUUCCCAGCCACCUCUCCA | 22 | 8775 |
| BCL11A-7133 | - | UGUCCUUCCCAGCCACCUCUCCA | 23 | 8776 |
| BCL11A-7134 | - | AUGUCCUUCCCAGCCACCUCUCCA | 24 | 8777 |
| BCL11A-7135 | - | AGCGCAUCAAGCUCGAGA | 18 | 8778 |
| BCL11A-7136 | - | AAGCGCAUCAAGCUCGAGA | 19 | 8779 |
| BCL11A-5919 | - | UAAGCGCAUCAAGCUCGAGA | 20 | 8780 |
| BCL11A-7137 | - | CUAAGCGCAUCAAGCUCGAGA | 21 | 8781 |
| BCL11A-7138 | - | UCUAAGCGCAUCAAGCUCGAGA | 22 | 8782 |
| BCL11A-7139 | - | CUCUAAGCGCAUCAAGCUCGAGA | 23 | 8783 |
| BCL11A-7140 | - | UCUCUAAGCGCAUCAAGCUCGAGA | 24 | 8784 |
| BCL11A-7141 | - | GGAGCUGACGGAGAGCGA | 18 | 8785 |
| BCL11A-7142 | - | AGGAGCUGACGGAGAGCGA | 19 | 8786 |
| BCL11A-7143 | - | GAGGAGCUGACGGAGAGCGA | 20 | 8787 |
| BCL11A-7144 | - | GGAGGAGCUGACGGAGAGCGA | 21 | 8788 |
| BCL11A-7145 | - | AGGAGGAGCUGACGGAGAGCGA | 22 | 8789 |
| BCL11A-7146 | - | GAGGAGGAGCUGACGGAGAGCGA | 23 | 8790 |
| BCL11A-7147 | - | GGAGGAGGAGCUGACGGAGAGCGA | 24 | 8791 |
| BCL11A-7148 | - | UCACCCGAGUGCCUUUGA | 18 | 8792 |
| BCL11A-7149 | - | AUCACCCGAGUGCCUUUGA | 19 | 8793 |
| BCL11A-7150 | - | CAUCACCCGAGUGCCUUUGA | 20 | 8794 |
| BCL11A-7151 | - | CCAUCACCCGAGUGCCUUUGA | 21 | 8795 |
| BCL11A-7152 | - | CCCAUCACCCGAGUGCCUUUGA | 22 | 8796 |
| BCL11A-7153 | - | ACCCAUCACCCGAGUGCCUUUGA | 23 | 8797 |
| BCL11A-7154 | - | CACCCAUCACCCGAGUGCCUUUGA | 24 | 8798 |
| BCL11A-7155 | - | GAGCACUCCUCGGAGAAC | 18 | 8799 |
| BCL11A-7156 | - | GGAGCACUCCUCGGAGAAC | 19 | 8800 |
| BCL11A-5949 | - | CGGAGCACUCCUCGGAGAAC | 20 | 8801 |
| BCL11A-7157 | - | UCGGAGCACUCCUCGGAGAAC | 21 | 8802 |
| BCL11A-7158 | - | GUCGGAGCACUCCUCGGAGAAC | 22 | 8803 |
| BCL11A-7159 | - | CGUCGGAGCACUCCUCGGAGAAC | 23 | 8804 |
| BCL11A-7160 | - | UCGUCGGAGCACUCCUCGGAGAAC | 24 | 8805 |
| BCL11A-7161 | - | GCCCUGGCCACCCAUCAC | 18 | 8806 |
| BCL11A-7162 | - | GGCCCUGGCCACCCAUCAC | 19 | 8807 |
| BCL11A-7163 | - | UGGCCCUGGCCACCCAUCAC | 20 | 8808 |
| BCL11A-7164 | - | AUGGCCCUGGCCACCCAUCAC | 21 | 8809 |

TABLE 16D-continued

4th Tier

| gRNA Name | DNA Strand | Targeting Domain | Target Site Length | SEQ ID NO: |
|---|---|---|---|---|
| BCL11A-7165 | - | GAUGGCCCUGGCCACCCAUCAC | 22 | 8810 |
| BCL11A-7166 | - | AGAUGGCCCUGGCCACCCAUCAC | 23 | 8811 |
| BCL11A-7167 | - | GAGAUGGCCCUGGCCACCCAUCAC | 24 | 8812 |
| BCL11A-7168 | - | UUAACCUGCUAAGAAUAC | 18 | 8813 |
| BCL11A-7169 | - | UUUAACCUGCUAAGAAUAC | 19 | 8814 |
| BCL11A-7170 | - | CUUUAACCUGCUAAGAAUAC | 20 | 8815 |
| BCL11A-7171 | - | CCUUUAACCUGCUAAGAAUAC | 21 | 8816 |
| BCL11A-7172 | - | CCCUUUAACCUGCUAAGAAUAC | 22 | 8817 |
| BCL11A-7173 | - | CCCCUUUAACCUGCUAAGAAUAC | 23 | 8818 |
| BCL11A-7174 | - | ACCCCUUUAACCUGCUAAGAAUAC | 24 | 8819 |
| BCL11A-7175 | - | CGGAAGUCCCUGACCCC | 18 | 8820 |
| BCL11A-7176 | - | ACGGAAGUCCCCUGACCCC | 19 | 8821 |
| BCL11A-7177 | - | CACGGAAGUCCCCUGACCCC | 20 | 8822 |
| BCL11A-7178 | - | ACACGGAAGUCCCCUGACCCC | 21 | 8823 |
| BCL11A-7179 | - | AACACGGAAGUCCCCUGACCCC | 22 | 8824 |
| BCL11A-7180 | - | GAACACGGAAGUCCCCUGACCCC | 23 | 8825 |
| BCL11A-7181 | - | CGAACACGGAAGUCCCCUGACCCC | 24 | 8826 |
| BCL11A-7182 | - | AGAAAAUUUGAAGCCCCC | 18 | 8827 |
| BCL11A-7183 | - | GAGAAAAUUUGAAGCCCCC | 19 | 8828 |
| BCL11A-5969 | - | UGAGAAAAUUUGAAGCCCCC | 20 | 8829 |
| BCL11A-7184 | - | CUGAGAAAAUUUGAAGCCCCC | 21 | 8830 |
| BCL11A-7185 | - | UCUGAGAAAAUUUGAAGCCCCC | 22 | 8831 |
| BCL11A-7186 | - | UUCUGAGAAAAUUUGAAGCCCCC | 23 | 8832 |
| BCL11A-7187 | - | GUUCUGAGAAAAUUUGAAGCCCCC | 24 | 8833 |
| BCL11A-7188 | - | GCUAUGGAGCCUCCCGCC | 18 | 8834 |
| BCL11A-7189 | - | GGCUAUGGAGCCUCCCGCC | 19 | 8835 |
| BCL11A-7190 | - | UGGCUAUGGAGCCUCCCGCC | 20 | 8836 |
| BCL11A-7191 | - | AUGGCUAUGGAGCCUCCCGCC | 21 | 8837 |
| BCL11A-7192 | - | AAUGGCUAUGGAGCCUCCCGCC | 22 | 8838 |
| BCL11A-7193 | - | CAAUGGCUAUGGAGCCUCCCGCC | 23 | 8839 |
| BCL11A-7194 | - | CCAAUGGCUAUGGAGCCUCCCGCC | 24 | 8840 |
| BCL11A-7195 | - | AACACGCACAGAACACUC | 18 | 8841 |
| BCL11A-7196 | - | CAACACGCACAGAACACUC | 19 | 8842 |
| BCL11A-7197 | - | GCAACACGCACAGAACACUC | 20 | 8843 |
| BCL11A-7198 | - | UGCAACACGCACAGAACACUC | 21 | 8844 |
| BCL11A-7199 | - | UUGCAACACGCACAGAACACUC | 22 | 8845 |
| BCL11A-7200 | - | CUUGCAACACGCACAGAACACUC | 23 | 8846 |
| BCL11A-7201 | - | UCUUGCAACACGCACAGAACACUC | 24 | 8847 |

TABLE 16D-continued

| | 4th Tier | | | |
|---|---|---|---|---|
| gRNA Name | DNA Strand | Targeting Domain | Target Site Length | SEQ ID NO: |
| BCL11A-7202 | − | ACGAAGACUCGGUGGCCG | 18 | 8848 |
| BCL11A-7203 | − | GACGAAGACUCGGUGGCCG | 19 | 8849 |
| BCL11A-7204 | − | CGACGAAGACUCGGUGGCCG | 20 | 8850 |
| BCL11A-7205 | − | GCGACGAAGACUCGGUGGCCG | 21 | 8851 |
| BCL11A-7206 | − | UGCGACGAAGACUCGGUGGCCG | 22 | 8852 |
| BCL11A-7207 | − | UUGCGACGAAGACUCGGUGGCCG | 23 | 8853 |
| BCL11A-7208 | − | CUUGCGACGAAGACUCGGUGGCCG | 24 | 8854 |
| BCL11A-7209 | − | GCCCGGGGAGCUGGACGG | 18 | 8855 |
| BCL11A-7210 | − | CGCCCGGGGAGCUGGACGG | 19 | 8856 |
| BCL11A-6121 | − | CCGCCCGGGGAGCUGGACGG | 20 | 8857 |
| BCL11A-7211 | − | ACCGCCCGGGGAGCUGGACGG | 21 | 8858 |
| BCL11A-7212 | − | CACCGCCCGGGGAGCUGGACGG | 22 | 8859 |
| BCL11A-7213 | − | ACACCGCCCGGGGAGCUGGACGG | 23 | 8860 |
| BCL11A-7214 | − | CACACCGCCCGGGGAGCUGGACGG | 24 | 8861 |
| BCL11A-7215 | − | GCCGCGGCUGCUCCCCGG | 18 | 8862 |
| BCL11A-7216 | − | GGCCGCGGCUGCUCCCCGG | 19 | 8863 |
| BCL11A-7217 | − | UGGCCGCGGCUGCUCCCCGG | 20 | 8864 |
| BCL11A-7218 | − | AUGGCCGCGGCUGCUCCCCGG | 21 | 8865 |
| BCL11A-7219 | − | AAUGGCCGCGGCUGCUCCCCGG | 22 | 8866 |
| BCL11A-7220 | − | UAAUGGCCGCGGCUGCUCCCCGG | 23 | 8867 |
| BCL11A-7221 | − | UUAAUGGCCGCGGCUGCUCCCCGG | 24 | 8868 |
| BCL11A-7222 | − | UUUGACAGGGUGCUGCGG | 18 | 8869 |
| BCL11A-7223 | − | CUUUGACAGGGUGCUGCGG | 19 | 8870 |
| BCL11A-7224 | − | CCUUUGACAGGGUGCUGCGG | 20 | 8871 |
| BCL11A-7225 | − | GCCUUUGACAGGGUGCUGCGG | 21 | 8872 |
| BCL11A-7226 | − | UGCCUUUGACAGGGUGCUGCGG | 22 | 8873 |
| BCL11A-7227 | − | GUGCCUUUGACAGGGUGCUGCGG | 23 | 8874 |
| BCL11A-7228 | − | AGUGCCUUUGACAGGGUGCUGCGG | 24 | 8875 |
| BCL11A-7229 | − | AUUUGAAGCCCCCAGGGG | 18 | 8876 |
| BCL11A-7230 | − | AAUUUGAAGCCCCCAGGGG | 19 | 8877 |
| BCL11A-6140 | − | AAAUUUGAAGCCCCCAGGGG | 20 | 8878 |
| BCL11A-7231 | − | AAAAUUUGAAGCCCCCAGGGG | 21 | 8879 |
| BCL11A-7232 | − | GAAAAUUUGAAGCCCCCAGGGG | 22 | 8880 |
| BCL11A-7233 | − | AGAAAAUUUGAAGCCCCCAGGGG | 23 | 8881 |
| BCL11A-7234 | − | GAGAAAAUUUGAAGCCCCCAGGGG | 24 | 8882 |
| BCL11A-7235 | − | UCCCUUCAGGACUAGGUG | 18 | 8883 |
| BCL11A-7236 | − | AUCCCUUCAGGACUAGGUG | 19 | 8884 |

TABLE 16D-continued

4th Tier

| gRNA Name | DNA Strand | Targeting Domain | Target Site Length | SEQ ID NO: |
|---|---|---|---|---|
| BCL11A-7237 | - | UAUCCCUUCAGGACUAGGUG | 20 | 8885 |
| BCL11A-7238 | - | GUAUCCCUUCAGGACUAGGUG | 21 | 8886 |
| BCL11A-7239 | - | GGUAUCCCUUCAGGACUAGGUG | 22 | 8887 |
| BCL11A-7240 | - | UGGUAUCCCUUCAGGACUAGGUG | 23 | 8888 |
| BCL11A-7241 | - | UUGGUAUCCCUUCAGGACUAGGUG | 24 | 8889 |
| BCL11A-7242 | - | CGGUCAAGUCCAAGUCAU | 18 | 8890 |
| BCL11A-7243 | - | CCGGUCAAGUCCAAGUCAU | 19 | 8891 |
| BCL11A-7244 | - | CCCGGUCAAGUCCAAGUCAU | 20 | 8892 |
| BCL11A-7245 | - | CCCCGGUCAAGUCCAAGUCAU | 21 | 8893 |
| BCL11A-7246 | - | CCCCCGGUCAAGUCCAAGUCAU | 22 | 8894 |
| BCL11A-7247 | - | GCCCCCGGUCAAGUCCAAGUCAU | 23 | 8895 |
| BCL11A-7248 | - | AGCCCCCGGUCAAGUCCAAGUCAU | 24 | 8896 |
| BCL11A-7249 | - | UAACCCCUUUAACCUGCU | 18 | 8897 |
| BCL11A-7250 | - | AUAACCCCUUUAACCUGCU | 19 | 8898 |
| BCL11A-7251 | - | AAUAACCCCUUUAACCUGCU | 20 | 8899 |
| BCL11A-7252 | - | CAAUAACCCCUUUAACCUGCU | 21 | 8900 |
| BCL11A-7253 | - | ACAAUAACCCCUUUAACCUGCU | 22 | 8901 |
| BCL11A-7254 | - | GACAAUAACCCCUUUAACCUGCU | 23 | 8902 |
| BCL11A-7255 | - | AGACAAUAACCCCUUUAACCUGCU | 24 | 8903 |
| BCL11A-7256 | - | ACAGAACACUCAUGGAUU | 18 | 8904 |
| BCL11A-7257 | - | CACAGAACACUCAUGGAUU | 19 | 8905 |
| BCL11A-7258 | - | GCACAGAACACUCAUGGAUU | 20 | 8906 |
| BCL11A-7259 | - | CGCACAGAACACUCAUGGAUU | 21 | 8907 |
| BCL11A-7260 | - | ACGCACAGAACACUCAUGGAUU | 22 | 8908 |
| BCL11A-7261 | - | CACGCACAGAACACUCAUGGAUU | 23 | 8909 |
| BCL11A-7262 | - | ACACGCACAGAACACUCAUGGAUU | 24 | 8910 |
| BCL11A-7263 | - | GCAGACGCAGCGACACUU | 18 | 8911 |
| BCL11A-7264 | - | GGCAGACGCAGCGACACUU | 19 | 8912 |
| BCL11A-7265 | - | GGGCAGACGCAGCGACACUU | 20 | 8913 |
| BCL11A-7266 | - | AGGGCAGACGCAGCGACACUU | 21 | 8914 |
| BCL11A-7267 | - | GAGGGCAGACGCAGCGACACUU | 22 | 8915 |
| BCL11A-7268 | - | AGAGGGCAGACGCAGCGACACUU | 23 | 8916 |
| BCL11A-7269 | - | AAGAGGGCAGACGCAGCGACACUU | 24 | 8917 |
| BCL11A-7270 | - | CAAGAUGUGUGGCAGUUU | 18 | 8918 |
| BCL11A-7271 | - | UCAAGAUGUGUGGCAGUUU | 19 | 8919 |
| BCL11A-7272 | - | CUCAAGAUGUGUGGCAGUUU | 20 | 8920 |
| BCL11A-7273 | - | GCUCAAGAUGUGUGGCAGUUU | 21 | 8921 |
| BCL11A-7274 | - | AGCUCAAGAUGUGUGGCAGUUU | 22 | 8922 |

TABLE 16D-continued

| | | 4th Tier | | |
|---|---|---|---|---|
| gRNA Name | DNA Strand | Targeting Domain | Target Site Length | SEQ ID NO: |
| BCL11A-7275 | - | GAGCUCAAGAUGUGUGGCAGUUU | 23 | 8923 |
| BCL11A-7276 | - | AGAGCUCAAGAUGUGUGGCAGUUU | 24 | 8924 |

Table 16E provides exemplary targeting domains for knocking out the BCL11A gene selected according to the fifth tier parameters. The targeting domains fall in the coding sequence of the gene, downstream of the first 500 bp of coding sequence (e.g., anywhere from +500 (relative to the start codon) to the stop codon of the gene), and the PAM is NNGRRV. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 16E

| | | 5th Tier | | |
|---|---|---|---|---|
| gRNA Name | DNA Strand | Targeting Domain | Target Site Length | SEQ ID NO: |
| BCL11A-7277 | + | UCUCGGUGGUGGACUAAA | 18 | 8925 |
| BCL11A-7278 | + | GUCUCGGUGGUGGACUAAA | 19 | 8926 |
| BCL11A-7279 | + | UGUCUCGGUGGUGGACUAAA | 20 | 8927 |
| BCL11A-7280 | + | AUGUCUCGGUGGUGGACUAAA | 21 | 8928 |
| BCL11A-7281 | + | GAUGUCUCGGUGGUGGACUAAA | 22 | 8929 |
| BCL11A-7282 | + | UGAUGUCUCGGUGGUGGACUAAA | 23 | 8930 |
| BCL11A-7283 | + | GUGAUGUCUCGGUGGUGGACUAAA | 24 | 8931 |
| BCL11A-7284 | + | GUUCUGUGCGUGUUGCAA | 18 | 8932 |
| BCL11A-7285 | + | UGUUCUGUGCGUGUUGCAA | 19 | 8933 |
| BCL11A-7286 | + | GUGUUCUGUGCGUGUUGCAA | 20 | 8934 |
| BCL11A-7287 | + | AGUGUUCUGUGCGUGUUGCAA | 21 | 8935 |
| BCL11A-7288 | + | GAGUGUUCUGUGCGUGUUGCAA | 22 | 8936 |
| BCL11A-7289 | + | UGAGUGUUCUGUGCGUGUUGCAA | 23 | 8937 |
| BCL11A-7290 | + | AUGAGUGUUCUGUGCGUGUUGCAA | 24 | 8938 |
| BCL11A-7291 | + | UCUGGGUACUACGCCGAA | 18 | 8939 |
| BCL11A-7292 | + | CUCUGGGUACUACGCCGAA | 19 | 8940 |
| BCL11A-5883 | + | UCUCUGGGUACUACGCCGAA | 20 | 8941 |
| BCL11A-7293 | + | CUCUCUGGGUACUACGCCGAA | 21 | 8942 |
| BCL11A-7294 | + | GCUCUCUGGGUACUACGCCGAA | 22 | 8943 |
| BCL11A-7295 | + | AGCUCUCUGGGUACUACGCCGAA | 23 | 8944 |
| BCL11A-7296 | + | GAGCUCUCUGGGUACUACGCCGAA | 24 | 8945 |
| BCL11A-7297 | + | UCGGUGGUGGACUAAACA | 18 | 8946 |
| BCL11A-7298 | + | CUCGGUGGUGGACUAAACA | 19 | 8947 |
| BCL11A-5892 | + | UCUCGGUGGUGGACUAAACA | 20 | 8948 |
| BCL11A-7299 | + | GUCUCGGUGGUGGACUAAACA | 21 | 8949 |
| BCL11A-7300 | + | UGUCUCGGUGGUGGACUAAACA | 22 | 8950 |

TABLE 16E-continued

5th Tier

| gRNA Name | DNA Strand | Targeting Domain | Target Site Length | SEQ ID NO: |
|---|---|---|---|---|
| BCL11A-7301 | + | AUGUCUCGGUGGUGGACUAAACA | 23 | 8951 |
| BCL11A-7342 | + | UGAUGCGCUUAGAGAAGGGGCUCA | 24 | 8994 |
| BCL11A-7343 | + | CGUCGGACUUGACCGUCA | 18 | 8995 |
| BCL11A-7344 | + | UCGUCGGACUUGACCGUCA | 19 | 8996 |
| BCL11A-5912 | + | GUCGUCGGACUUGACCGUCA | 20 | 8997 |
| BCL11A-7345 | + | CGUCGUCGGACUUGACCGUCA | 21 | 8998 |
| BCL11A-7346 | + | CCGUCGUCGGACUUGACCGUCA | 22 | 8999 |
| BCL11A-7347 | + | ACCGUCGUCGGACUUGACCGUCA | 23 | 9000 |
| BCL11A-7348 | + | GACCGUCGUCGGACUUGACCGUCA | 24 | 9001 |
| BCL11A-7349 | + | UACCAACCCGCGGGGUCA | 18 | 9002 |
| BCL11A-7350 | + | AUACCAACCCGCGGGGUCA | 19 | 9003 |
| BCL11A-5913 | + | GAUACCAACCCGCGGGGUCA | 20 | 9004 |
| BCL11A-7351 | + | GGAUACCAACCCGCGGGGUCA | 21 | 9005 |
| BCL11A-7352 | + | GGGAUACCAACCCGCGGGGUCA | 22 | 9006 |
| BCL11A-7353 | + | AGGGAUACCAACCCGCGGGGUCA | 23 | 9007 |
| BCL11A-7354 | + | AAGGGAUACCAACCCGCGGGGUCA | 24 | 9008 |
| BCL11A-7355 | + | GCUUGAUGCGCUUAGAGA | 18 | 9009 |
| BCL11A-7356 | + | AGCUUGAUGCGCUUAGAGA | 19 | 9010 |
| BCL11A-5917 | + | GAGCUUGAUGCGCUUAGAGA | 20 | 9011 |
| BCL11A-7357 | + | CGAGCUUGAUGCGCUUAGAGA | 21 | 9012 |
| BCL11A-7358 | + | UCGAGCUUGAUGCGCUUAGAGA | 22 | 9013 |
| BCL11A-7359 | + | CUCGAGCUUGAUGCGCUUAGAGA | 23 | 9014 |
| BCL11A-7360 | + | UCUCGAGCUUGAUGCGCUUAGAGA | 24 | 9015 |
| BCL11A-7361 | + | CUAGAAAGAGGUUGGAGA | 18 | 9016 |
| BCL11A-7362 | + | CCUAGAAAGAGGUUGGAGA | 19 | 9017 |
| BCL11A-7363 | + | ACCUAGAAAGAGGUUGGAGA | 20 | 9018 |
| BCL11A-7364 | + | AACCUAGAAAGAGGUUGGAGA | 21 | 9019 |
| BCL11A-7365 | + | GAACCUAGAAAGAGGUUGGAGA | 22 | 9020 |
| BCL11A-7366 | + | AGAACCUAGAAAGAGGUUGGAGA | 23 | 9021 |
| BCL11A-7367 | + | AAGAACCUAGAAAGAGGUUGGAGA | 24 | 9022 |
| BCL11A-7368 | + | GUGUGUGAAGAACCUAGA | 18 | 9023 |
| BCL11A-7369 | + | GGUGUGUGAAGAACCUAGA | 19 | 9024 |
| BCL11A-7370 | + | GGGUGUGUGAAGAACCUAGA | 20 | 9025 |
| BCL11A-7371 | + | GGGGUGUGUGAAGAACCUAGA | 21 | 9026 |
| BCL11A-7372 | + | GGGGGUGUGUGAAGAACCUAGA | 22 | 9027 |
| BCL11A-7373 | + | UGGGGGUGUGUGAAGAACCUAGA | 23 | 9028 |
| BCL11A-7374 | + | AUGGGGGUGUGUGAAGAACCUAGA | 24 | 9029 |
| BCL11A-7375 | + | CUCUGGGUACUACGCCGA | 18 | 9030 |

TABLE 16E-continued

5th Tier

| gRNA Name | DNA Strand | Targeting Domain | Target Site Length | SEQ ID NO: |
|---|---|---|---|---|
| BCL11A-7376 | + | UCUCUGGGUACUACGCCGA | 19 | 9031 |
| BCL11A-7377 | + | CUCUCUGGGUACUACGCCGA | 20 | 9032 |
| BCL11A-7378 | + | GCUCUCUGGGUACUACGCCGA | 21 | 9033 |
| BCL11A-7379 | + | AGCUCUCUGGGUACUACGCCGA | 22 | 9034 |
| BCL11A-7380 | + | GAGCUCUCUGGGUACUACGCCGA | 23 | 9035 |
| BCL11A-7381 | + | UGAGCUCUCUGGGUACUACGCCGA | 24 | 9036 |
| BCL11A-7382 | + | GAGGUUGGAGACAGAGGA | 18 | 9037 |
| BCL11A-7383 | + | AGAGGUUGGAGACAGAGGA | 19 | 9038 |
| BCL11A-5925 | + | AAGAGGUUGGAGACAGAGGA | 20 | 9039 |
| BCL11A-7384 | + | AAAGAGGUUGGAGACAGAGGA | 21 | 9040 |
| BCL11A-7385 | + | GAAAGAGGUUGGAGACAGAGGA | 22 | 9041 |
| BCL11A-7386 | + | AGAAAGAGGUUGGAGACAGAGGA | 23 | 9042 |
| BCL11A-7387 | + | UAGAAAGAGGUUGGAGACAGAGGA | 24 | 9043 |
| BCL11A-7388 | + | GGGGCGGAUUGCAGAGGA | 18 | 9044 |
| BCL11A-7389 | + | AGGGGCGGAUUGCAGAGGA | 19 | 9045 |
| BCL11A-5926 | + | GAGGGGCGGAUUGCAGAGGA | 20 | 9046 |
| BCL11A-7390 | + | GGAGGGGCGGAUUGCAGAGGA | 21 | 9047 |
| BCL11A-7391 | + | AGGAGGGGCGGAUUGCAGAGGA | 22 | 9048 |
| BCL11A-7392 | + | GAGGAGGGGCGGAUUGCAGAGGA | 23 | 9049 |
| BCL11A-7393 | + | GGAGGAGGGGCGGAUUGCAGAGGA | 24 | 9050 |
| BCL11A-7394 | + | CGGAUUGCAGAGGAGGGA | 18 | 9051 |
| BCL11A-7395 | + | GCGGAUUGCAGAGGAGGGA | 19 | 9052 |
| BCL11A-5930 | + | GGCGGAUUGCAGAGGAGGGA | 20 | 9053 |
| BCL11A-7396 | + | GGGCGGAUUGCAGAGGAGGGA | 21 | 9054 |
| BCL11A-7397 | + | GGGGCGGAUUGCAGAGGAGGGA | 22 | 9055 |
| BCL11A-7398 | + | AGGGGCGGAUUGCAGAGGAGGGA | 23 | 9056 |
| BCL11A-7399 | + | GAGGGGCGGAUUGCAGAGGAGGGA | 24 | 9057 |
| BCL11A-7400 | + | CUUGACCGGGGCUGGGA | 18 | 9058 |
| BCL11A-7401 | + | ACUUGACCGGGGCUGGGA | 19 | 9059 |
| BCL11A-5931 | + | GACUUGACCGGGGCUGGGA | 20 | 9060 |
| BCL11A-7402 | + | GGACUUGACCGGGGCUGGGA | 21 | 9061 |
| BCL11A-7403 | + | UGGACUUGACCGGGGCUGGGA | 22 | 9062 |
| BCL11A-7404 | + | UUGGACUUGACCGGGGCUGGGA | 23 | 9063 |
| BCL11A-7405 | + | CUUGGACUUGACCGGGGCUGGGA | 24 | 9064 |
| BCL11A-7406 | + | CGCAUGACUUGGACUUGA | 18 | 9065 |
| BCL11A-7407 | + | UCGCAUGACUUGGACUUGA | 19 | 9066 |
| BCL11A-7408 | + | CUCGCAUGACUUGGACUUGA | 20 | 9067 |

TABLE 16E-continued

5th Tier

| gRNA Name | DNA Strand | Targeting Domain | Target Site Length | SEQ ID NO: |
|---|---|---|---|---|
| BCL11A-7409 | + | ACUCGCAUGACUUGGACUUGA | 21 | 9068 |
| BCL11A-7410 | + | AACUCGCAUGACUUGGACUUGA | 22 | 9069 |
| BCL11A-7411 | + | GAACUCGCAUGACUUGGACUUGA | 23 | 9070 |
| BCL11A-7412 | + | AGAACUCGCAUGACUUGGACUUGA | 24 | 9071 |
| BCL11A-7413 | + | GGGCCCGGACCACUAAUA | 18 | 9072 |
| BCL11A-7414 | + | CGGGCCCGGACCACUAAUA | 19 | 9073 |
| BCL11A-5940 | + | CCGGGCCCGGACCACUAAUA | 20 | 9074 |
| BCL11A-7415 | + | CCCGGGCCCGGACCACUAAUA | 21 | 9075 |
| BCL11A-7416 | + | GCCCGGGCCCGGACCACUAAUA | 22 | 9076 |
| BCL11A-7417 | + | UGCCCGGGCCCGGACCACUAAUA | 23 | 9077 |
| BCL11A-7418 | + | CUGCCCGGGCCCGGACCACUAAUA | 24 | 9078 |
| BCL11A-7419 | + | AGCUCUCUAAGUCUCCUA | 18 | 9079 |
| BCL11A-7420 | + | CAGCUCUCUAAGUCUCCUA | 19 | 9080 |
| BCL11A-7421 | + | CCAGCUCUCUAAGUCUCCUA | 20 | 9081 |
| BCL11A-7422 | + | GCCAGCUCUCUAAGUCUCCUA | 21 | 9082 |
| BCL11A-7423 | + | UGCCAGCUCUCUAAGUCUCCUA | 22 | 9083 |
| BCL11A-7424 | + | CUGCCAGCUCUCUAAGUCUCCUA | 23 | 9084 |
| BCL11A-7425 | + | CCUGCCAGCUCUCUAAGUCUCCUA | 24 | 9085 |
| BCL11A-7426 | + | CUGGAGUCUCCGAAGCUA | 18 | 9086 |
| BCL11A-7427 | + | UCUGGAGUCUCCGAAGCUA | 19 | 9087 |
| BCL11A-5943 | + | GUCUGGAGUCUCCGAAGCUA | 20 | 9088 |
| BCL11A-7428 | + | UGUCUGGAGUCUCCGAAGCUA | 21 | 9089 |
| BCL11A-7429 | + | UUGUCUGGAGUCUCCGAAGCUA | 22 | 9090 |
| BCL11A-7430 | + | AUUGUCUGGAGUCUCCGAAGCUA | 23 | 9091 |
| BCL11A-7431 | + | GAUUGUCUGGAGUCUCCGAAGCUA | 24 | 9092 |
| BCL11A-7432 | + | UCGAGCUUGAUGCGCUUA | 18 | 9093 |
| BCL11A-7433 | + | CUCGAGCUUGAUGCGCUUA | 19 | 9094 |
| BCL11A-7434 | + | UCUCGAGCUUGAUGCGCUUA | 20 | 9095 |
| BCL11A-7435 | + | UUCUCGAGCUUGAUGCGCUUA | 21 | 9096 |
| BCL11A-7436 | + | CUUCUCGAGCUUGAUGCGCUUA | 22 | 9097 |
| BCL11A-7437 | + | CCUUCUCGAGCUUGAUGCGCUUA | 23 | 9098 |
| BCL11A-7438 | + | UCCUUCUCGAGCUUGAUGCGCUUA | 24 | 9099 |
| BCL11A-7439 | + | GGUAUUCUUAGCAGGUUA | 18 | 9100 |
| BCL11A-7440 | + | UGGUAUUCUUAGCAGGUUA | 19 | 9101 |
| BCL11A-7441 | + | CUGGUAUUCUUAGCAGGUUA | 20 | 9102 |
| BCL11A-7442 | + | CCUGGUAUUCUUAGCAGGUUA | 21 | 9103 |
| BCL11A-7443 | + | UCCUGGUAUUCUUAGCAGGUUA | 22 | 9104 |
| BCL11A-7444 | + | AUCCUGGUAUUCUUAGCAGGUUA | 23 | 9105 |

TABLE 16E-continued

5th Tier

| gRNA Name | DNA Strand | Targeting Domain | Target Site Length | SEQ ID NO: |
|---|---|---|---|---|
| BCL11A-7445 | + | GAUCCUGGUAUUCUUAGCAGGUUA | 24 | 9106 |
| BCL11A-7446 | + | CUCGGUGGUGGACUAAAC | 18 | 9107 |
| BCL11A-7447 | + | UCUCGGUGGUGGACUAAAC | 19 | 9108 |
| BCL11A-5947 | + | GUCUCGGUGGUGGACUAAAC | 20 | 9109 |
| BCL11A-7448 | + | UGUCUCGGUGGUGGACUAAAC | 21 | 9110 |
| BCL11A-7449 | + | AUGUCUCGGUGGUGGACUAAAC | 22 | 9111 |
| BCL11A-7450 | + | GAUGUCUCGGUGGUGGACUAAAC | 23 | 9112 |
| BCL11A-7451 | + | UGAUGUCUCGGUGGUGGACUAAAC | 24 | 9113 |
| BCL11A-7452 | + | UCCGAGGAGUGCUCCGAC | 18 | 9114 |
| BCL11A-7453 | + | CUCCGAGGAGUGCUCCGAC | 19 | 9115 |
| BCL11A-7454 | + | UCUCCGAGGAGUGCUCCGAC | 20 | 9116 |
| BCL11A-7455 | + | UUCUCCGAGGAGUGCUCCGAC | 21 | 9117 |
| BCL11A-7456 | + | GUUCUCCGAGGAGUGCUCCGAC | 22 | 9118 |
| BCL11A-7457 | + | CGUUCUCCGAGGAGUGCUCCGAC | 23 | 9119 |
| BCL11A-7458 | + | CCGUUCUCCGAGGAGUGCUCCGAC | 24 | 9120 |
| BCL11A-7459 | + | AACUUGGCCACCACGGAC | 18 | 9121 |
| BCL11A-7460 | + | GAACUUGGCCACCACGGAC | 19 | 9122 |
| BCL11A-7461 | + | UGAACUUGGCCACCACGGAC | 20 | 9123 |
| BCL11A-7462 | + | UUGAACUUGGCCACCACGGAC | 21 | 9124 |
| BCL11A-7463 | + | CUUGAACUUGGCCACCACGGAC | 22 | 9125 |
| BCL11A-7464 | + | UCUUGAACUUGGCCACCACGGAC | 23 | 9126 |
| BCL11A-7465 | + | CUCUUGAACUUGGCCACCACGGAC | 24 | 9127 |
| BCL11A-7466 | + | CCGCAGAACUCGCAUGAC | 18 | 9128 |
| BCL11A-7467 | + | GCCGCAGAACUCGCAUGAC | 19 | 9129 |
| BCL11A-7468 | + | UGCCGCAGAACUCGCAUGAC | 20 | 9130 |
| BCL11A-7469 | + | UUGCCGCAGAACUCGCAUGAC | 21 | 9131 |
| BCL11A-7470 | + | CUUGCCGCAGAACUCGCAUGAC | 22 | 9132 |
| BCL11A-7471 | + | UCUUGCCGCAGAACUCGCAUGAC | 23 | 9133 |
| BCL11A-7472 | + | GUCUUGCCGCAGAACUCGCAUGAC | 24 | 9134 |
| BCL11A-7473 | + | GCAUGACUUGGACUUGAC | 18 | 9135 |
| BCL11A-7474 | + | CGCAUGACUUGGACUUGAC | 19 | 9136 |
| BCL11A-5957 | + | UCGCAUGACUUGGACUUGAC | 20 | 9137 |
| BCL11A-7475 | + | CUCGCAUGACUUGGACUUGAC | 21 | 9138 |
| BCL11A-7476 | + | ACUCGCAUGACUUGGACUUGAC | 22 | 9139 |
| BCL11A-7477 | + | AACUCGCAUGACUUGGACUUGAC | 23 | 9140 |
| BCL11A-7478 | + | GAACUCGCAUGACUUGGACUUGAC | 24 | 9141 |
| BCL11A-7479 | + | GGGGGUGUGUGAAGAACC | 18 | 9142 |

TABLE 16E-continued

5th Tier

| gRNA Name | DNA Strand | Targeting Domain | Target Site Length | SEQ ID NO: |
|---|---|---|---|---|
| BCL11A-7480 | + | UGGGGGUGUGUGAAGAACC | 19 | 9143 |
| BCL11A-7481 | + | AUGGGGGUGUGUGAAGAACC | 20 | 9144 |
| BCL11A-7482 | + | AAUGGGGGUGUGUGAAGAACC | 21 | 9145 |
| BCL11A-7483 | + | GAAUGGGGGUGUGUGAAGAACC | 22 | 9146 |
| BCL11A-7484 | + | CGAAUGGGGGUGUGUGAAGAACC | 23 | 9147 |
| BCL11A-7485 | + | CCGAAUGGGGGUGUGUGAAGAACC | 24 | 9148 |
| BCL11A-7486 | + | CUCUUGAACUUGGCCACC | 18 | 9149 |
| BCL11A-7487 | + | GCUCUUGAACUUGGCCACC | 19 | 9150 |
| BCL11A-7488 | + | CGCUCUUGAACUUGGCCACC | 20 | 9151 |
| BCL11A-7489 | + | UCGCUCUUGAACUUGGCCACC | 21 | 9152 |
| BCL11A-7490 | + | CUCGCUCUUGAACUUGGCCACC | 22 | 9153 |
| BCL11A-7491 | + | UCUCGCUCUUGAACUUGGCCACC | 23 | 9154 |
| BCL11A-7492 | + | UUCUCGCUCUUGAACUUGGCCACC | 24 | 9155 |
| BCL11A-7493 | + | CAUGACUUGGACUUGACC | 18 | 9156 |
| BCL11A-7494 | + | GCAUGACUUGGACUUGACC | 19 | 9157 |
| BCL11A-5965 | + | CGCAUGACUUGGACUUGACC | 20 | 9158 |
| BCL11A-7495 | + | UCGCAUGACUUGGACUUGACC | 21 | 9159 |
| BCL11A-7496 | + | CUCGCAUGACUUGGACUUGACC | 22 | 9160 |
| BCL11A-7497 | + | ACUCGCAUGACUUGGACUUGACC | 23 | 9161 |
| BCL11A-7498 | + | AACUCGCAUGACUUGGACUUGACC | 24 | 9162 |
| BCL11A-7499 | + | CUGAAGGGAUACCAACCC | 18 | 9163 |
| BCL11A-7500 | + | CCUGAAGGGAUACCAACCC | 19 | 9164 |
| BCL11A-7501 | + | UCCUGAAGGGAUACCAACCC | 20 | 9165 |
| BCL11A-7502 | + | GUCCUGAAGGGAUACCAACCC | 21 | 9166 |
| BCL11A-7503 | + | AGUCCUGAAGGGAUACCAACCC | 22 | 9167 |
| BCL11A-7504 | + | UAGUCCUGAAGGGAUACCAACCC | 23 | 9168 |
| BCL11A-7505 | + | CUAGUCCUGAAGGGAUACCAACCC | 24 | 9169 |
| BCL11A-7506 | + | CGCCCACGACCGCGCCCC | 18 | 9170 |
| BCL11A-7507 | + | ACGCCCACGACCGCGCCCC | 19 | 9171 |
| BCL11A-3830 | + | CACGCCCACGACCGCGCCCC | 20 | 9172 |
| BCL11A-7508 | + | CCACGCCCACGACCGCGCCCC | 21 | 9173 |
| BCL11A-7509 | + | CCCACGCCCACGACCGCGCCCC | 22 | 9174 |
| BCL11A-7510 | + | GCCCACGCCCACGACCGCGCCCC | 23 | 9175 |
| BCL11A-7511 | + | CGCCCACGCCCACGACCGCGCCCC | 24 | 9176 |
| BCL11A-7512 | + | GCUUUUUGGACAGGCCCC | 18 | 9177 |
| BCL11A-7513 | + | AGCUUUUUGGACAGGCCCC | 19 | 9178 |
| BCL11A-7514 | + | CAGCUUUUUGGACAGGCCCC | 20 | 9179 |
| BCL11A-7515 | + | GCAGCUUUUUGGACAGGCCCC | 21 | 9180 |

TABLE 16E-continued

5th Tier

| gRNA Name | DNA Strand | Targeting Domain | Target Site Length | SEQ ID NO: |
|---|---|---|---|---|
| BCL11A-7516 | + | AGCAGCUUUUUGGACAGGCCCC | 22 | 9181 |
| BCL11A-7517 | + | CAGCAGCUUUUUGGACAGGCCCC | 23 | 9182 |
| BCL11A-7518 | + | GCAGCAGCUUUUUGGACAGGCCCC | 24 | 9183 |
| BCL11A-7519 | + | CCCGAGGCCGACUCGCCC | 18 | 9184 |
| BCL11A-7520 | + | CCCCGAGGCCGACUCGCCC | 19 | 9185 |
| BCL11A-5977 | + | CCCCCGAGGCCGACUCGCCC | 20 | 9186 |
| BCL11A-7521 | + | CCCCCCGAGGCCGACUCGCCC | 21 | 9187 |
| BCL11A-7522 | + | GCCCCCCGAGGCCGACUCGCCC | 22 | 9188 |
| BCL11A-7523 | + | GGCCCCCCGAGGCCGACUCGCCC | 23 | 9189 |
| BCL11A-7524 | + | AGGCCCCCCGAGGCCGACUCGCCC | 24 | 9190 |
| BCL11A-7525 | + | GUCUGCAAUAUGAAUCCC | 18 | 9191 |
| BCL11A-7526 | + | UGUCUGCAAUAUGAAUCCC | 19 | 9192 |
| BCL11A-7527 | + | UUGUCUGCAAUAUGAAUCCC | 20 | 9193 |
| BCL11A-7528 | + | AUUGUCUGCAAUAUGAAUCCC | 21 | 9194 |
| BCL11A-7529 | + | UAUUGUCUGCAAUAUGAAUCCC | 22 | 9195 |
| BCL11A-7530 | + | UUAUUGUCUGCAAUAUGAAUCCC | 23 | 9196 |
| BCL11A-7531 | + | GUUAUUGUCUGCAAUAUGAAUCCC | 24 | 9197 |
| BCL11A-7532 | + | UUCCCGUGCCGCUGCGCC | 18 | 9198 |
| BCL11A-7533 | + | CUUCCCGUGCCGCUGCGCC | 19 | 9199 |
| BCL11A-7534 | + | ACUUCCCGUGCCGCUGCGCC | 20 | 9200 |
| BCL11A-7535 | + | CACUUCCCGUGCCGCUGCGCC | 21 | 9201 |
| BCL11A-7536 | + | CCACUUCCCGUGCCGCUGCGCC | 22 | 9202 |
| BCL11A-7537 | + | UCCACUUCCCGUGCCGCUGCGCC | 23 | 9203 |
| BCL11A-7538 | + | CUCCACUUCCCGUGCCGCUGCGCC | 24 | 9204 |
| BCL11A-7539 | + | CCCCGAGGCCGACUCGCC | 18 | 9205 |
| BCL11A-7540 | + | CCCCCGAGGCCGACUCGCC | 19 | 9206 |
| BCL11A-5989 | + | CCCCCCGAGGCCGACUCGCC | 20 | 9207 |
| BCL11A-7541 | + | GCCCCCCGAGGCCGACUCGCC | 21 | 9208 |
| BCL11A-7542 | + | GGCCCCCCGAGGCCGACUCGCC | 22 | 9209 |
| BCL11A-7543 | + | AGGCCCCCCGAGGCCGACUCGCC | 23 | 9210 |
| BCL11A-7544 | + | CAGGCCCCCCGAGGCCGACUCGCC | 24 | 9211 |
| BCL11A-7545 | + | GCGCUUAUGCUUCUCGCC | 18 | 9212 |
| BCL11A-7546 | + | CGCGCUUAUGCUUCUCGCC | 19 | 9213 |
| BCL11A-7547 | + | CCGCGCUUAUGCUUCUCGCC | 20 | 9214 |
| BCL11A-7548 | + | GCCGCGCUUAUGCUUCUCGCC | 21 | 9215 |
| BCL11A-7549 | + | GGCCGCGCUUAUGCUUCUCGCC | 22 | 9216 |
| BCL11A-7550 | + | UGGCCGCGCUUAUGCUUCUCGCC | 23 | 9217 |

TABLE 16E-continued

5th Tier

| gRNA Name | DNA Strand | Targeting Domain | Target Site Length | SEQ ID NO: |
|---|---|---|---|---|
| BCL11A-7551 | + | GUGGCCGCGCUUAUGCUUCUCGCC | 24 | 9218 |
| BCL11A-7552 | + | GGGAGGGGGGCGUCGCC | 18 | 9219 |
| BCL11A-7553 | + | AGGGAGGGGGGCGUCGCC | 19 | 9220 |
| BCL11A-5990 | + | GAGGGAGGGGGGCGUCGCC | 20 | 9221 |
| BCL11A-7554 | + | GGAGGGAGGGGGGCGUCGCC | 21 | 9222 |
| BCL11A-7555 | + | AGGAGGGAGGGGGGCGUCGCC | 22 | 9223 |
| BCL11A-7556 | + | GAGGAGGGAGGGGGGCGUCGCC | 23 | 9224 |
| BCL11A-7557 | + | AGAGGAGGGAGGGGGGCGUCGCC | 24 | 9225 |
| BCL11A-7558 | + | CAUAGGGCUGGGCCGGCC | 18 | 9226 |
| BCL11A-7559 | + | GCAUAGGGCUGGGCCGGCC | 19 | 9227 |
| BCL11A-5991 | + | UGCAUAGGGCUGGGCCGGCC | 20 | 9228 |
| BCL11A-7560 | + | UUGCAUAGGGCUGGGCCGGCC | 21 | 9229 |
| BCL11A-7561 | + | UUUGCAUAGGGCUGGGCCGGCC | 22 | 9230 |
| BCL11A-7562 | + | CUUUGCAUAGGGCUGGGCCGGCC | 23 | 9231 |
| BCL11A-7563 | + | CCUUUGCAUAGGGCUGGGCCGGCC | 24 | 9232 |
| BCL11A-7564 | + | GUGUUGGGCAUCGCGGCC | 18 | 9233 |
| BCL11A-7565 | + | CGUGUUGGGCAUCGCGGCC | 19 | 9234 |
| BCL11A-5993 | + | CCGUGUUGGGCAUCGCGGCC | 20 | 9235 |
| BCL11A-7566 | + | UCCGUGUUGGGCAUCGCGGCC | 21 | 9236 |
| BCL11A-7567 | + | CUCCGUGUUGGGCAUCGCGGCC | 22 | 9237 |
| BCL11A-7568 | + | UCUCCGUGUUGGGCAUCGCGGCC | 23 | 9238 |
| BCL11A-7569 | + | UUCUCCGUGUUGGGCAUCGCGGCC | 24 | 9239 |
| BCL11A-7570 | + | AGGGAUCUUUGAGCUGCC | 18 | 9240 |
| BCL11A-7571 | + | AAGGGAUCUUUGAGCUGCC | 19 | 9241 |
| BCL11A-6000 | + | GAAGGGAUCUUUGAGCUGCC | 20 | 9242 |
| BCL11A-7572 | + | GGAAGGGAUCUUUGAGCUGCC | 21 | 9243 |
| BCL11A-7573 | + | AGGAAGGGAUCUUUGAGCUGCC | 22 | 9244 |
| BCL11A-7574 | + | AAGGAAGGGAUCUUUGAGCUGCC | 23 | 9245 |
| BCL11A-7575 | + | UAAGGAAGGGAUCUUUGAGCUGCC | 24 | 9246 |
| BCL11A-7576 | + | AUCCCUCCGUCCAGCUCC | 18 | 9247 |
| BCL11A-7577 | + | GAUCCCUCCGUCCAGCUCC | 19 | 9248 |
| BCL11A-7578 | + | AGAUCCCUCCGUCCAGCUCC | 20 | 9249 |
| BCL11A-7579 | + | GAGAUCCCUCCGUCCAGCUCC | 21 | 9250 |
| BCL11A-7580 | + | CGAGAUCCCUCCGUCCAGCUCC | 22 | 9251 |
| BCL11A-7581 | + | CCGAGAUCCCUCCGUCCAGCUCC | 23 | 9252 |
| BCL11A-7582 | + | CCCGAGAUCCCUCCGUCCAGCUCC | 24 | 9253 |
| BCL11A-7583 | + | CCAGCUCUCUAAGUCCC | 18 | 9254 |
| BCL11A-7584 | + | GCCAGCUCUCUAAGUCUCC | 19 | 9255 |

TABLE 16E-continued

5th Tier

| gRNA Name | DNA Strand | Targeting Domain | Target Site Length | SEQ ID NO: |
|---|---|---|---|---|
| BCL11A-7585 | + | UGCCAGCUCUCUAAGUCUCC | 20 | 9256 |
| BCL11A-7586 | + | CUGCCAGCUCUCUAAGUCUCC | 21 | 9257 |
| BCL11A-7587 | + | CCUGCCAGCUCUCUAAGUCUCC | 22 | 9258 |
| BCL11A-7588 | + | CCCUGCCAGCUCUCUAAGUCUCC | 23 | 9259 |
| BCL11A-7589 | + | UCCCUGCCAGCUCUCUAAGUCUCC | 24 | 9260 |
| BCL11A-7590 | + | CGCAAACUCCCGUUCUCC | 18 | 9261 |
| BCL11A-7591 | + | GCGCAAACUCCCGUUCUCC | 19 | 9262 |
| BCL11A-7592 | + | AGCGCAAACUCCCGUUCUCC | 20 | 9263 |
| BCL11A-7593 | + | AAGCGCAAACUCCCGUUCUCC | 21 | 9264 |
| BCL11A-7594 | + | GAAGCGCAAACUCCCGUUCUCC | 22 | 9265 |
| BCL11A-7595 | + | AGAAGCGCAAACUCCCGUUCUCC | 23 | 9266 |
| BCL11A-7596 | + | GAGAAGCGCAAACUCCCGUUCUCC | 24 | 9267 |
| BCL11A-7597 | + | UCGCUGGUGCCGGGUUCC | 18 | 9268 |
| BCL11A-7598 | + | GUCGCUGGUGCCGGGUUCC | 19 | 9269 |
| BCL11A-6011 | + | AGUCGCUGGUGCCGGGUUCC | 20 | 9270 |
| BCL11A-7599 | + | AAGUCGCUGGUGCCGGGUUCC | 21 | 9271 |
| BCL11A-7600 | + | CAAGUCGCUGGUGCCGGGUUCC | 22 | 9272 |
| BCL11A-7601 | + | CCAAGUCGCUGGUGCCGGGUUCC | 23 | 9273 |
| BCL11A-7602 | + | ACCAAGUCGCUGGUGCCGGGUUCC | 24 | 9274 |
| BCL11A-7603 | + | GCCGCCUCCAGGCUCAGC | 18 | 9275 |
| BCL11A-7604 | + | CGCCGCCUCCAGGCUCAGC | 19 | 9276 |
| BCL11A-7605 | + | GCGCCGCCUCCAGGCUCAGC | 20 | 9277 |
| BCL11A-7606 | + | CGCGCCGCCUCCAGGCUCAGC | 21 | 9278 |
| BCL11A-7607 | + | GCGCGCCGCCUCCAGGCUCAGC | 22 | 9279 |
| BCL11A-7608 | + | GGCGCGCCGCCUCCAGGCUCAGC | 23 | 9280 |
| BCL11A-7609 | + | UGGCGCGCCGCCUCCAGGCUCAGC | 24 | 9281 |
| BCL11A-7610 | + | AGAAGGGGCUCAGCGAGC | 18 | 9282 |
| BCL11A-7611 | + | GAGAAGGGGCUCAGCGAGC | 19 | 9283 |
| BCL11A-6013 | + | AGAGAAGGGGCUCAGCGAGC | 20 | 9284 |
| BCL11A-7612 | + | UAGAGAAGGGGCUCAGCGAGC | 21 | 9285 |
| BCL11A-7613 | + | UUAGAGAAGGGGCUCAGCGAGC | 22 | 9286 |
| BCL11A-7614 | + | CUUAGAGAAGGGGCUCAGCGAGC | 23 | 9287 |
| BCL11A-7615 | + | GCUUAGAGAAGGGGCUCAGCGAGC | 24 | 9288 |
| BCL11A-7616 | + | CCCCCGAGGCCGACUCGC | 18 | 9289 |
| BCL11A-7617 | + | CCCCCCGAGGCCGACUCGC | 19 | 9290 |
| BCL11A-7618 | + | GCCCCCCGAGGCCGACUCGC | 20 | 9291 |
| BCL11A-7619 | + | GGCCCCCCGAGGCCGACUCGC | 21 | 9292 |

TABLE 16E-continued

5th Tier

| gRNA Name | DNA Strand | Targeting Domain | Target Site Length | SEQ ID NO: |
|---|---|---|---|---|
| BCL11A-7620 | + | AGGCCCCCCGAGGCCGACUCGC | 22 | 9293 |
| BCL11A-7621 | + | CAGGCCCCCCGAGGCCGACUCGC | 23 | 9294 |
| BCL11A-7622 | + | ACAGGCCCCCCGAGGCCGACUCGC | 24 | 9295 |
| BCL11A-7623 | + | AGGGAGGGGGGGCGUCGC | 18 | 9296 |
| BCL11A-7624 | + | GAGGGAGGGGGGGCGUCGC | 19 | 9297 |
| BCL11A-7625 | + | GGAGGGAGGGGGGGCGUCGC | 20 | 9298 |
| BCL11A-7626 | + | AGGAGGGAGGGGGGGCGUCGC | 21 | 9299 |
| BCL11A-7627 | + | GAGGAGGGAGGGGGGGCGUCGC | 22 | 9300 |
| BCL11A-7628 | + | AGAGGAGGGAGGGGGGGCGUCGC | 23 | 9301 |
| BCL11A-7629 | + | CAGAGGAGGGAGGGGGGGCGUCGC | 24 | 9302 |
| BCL11A-7630 | + | AGCGCCCUUCUGCCAGGC | 18 | 9303 |
| BCL11A-7631 | + | AAGCGCCCUUCUGCCAGGC | 19 | 9304 |
| BCL11A-6027 | + | AAAGCGCCCUUCUGCCAGGC | 20 | 9305 |
| BCL11A-7632 | + | GAAAGCGCCCUUCUGCCAGGC | 21 | 9306 |
| BCL11A-7633 | + | GGAAAGCGCCCUUCUGCCAGGC | 22 | 9307 |
| BCL11A-7634 | + | UGGAAAGCGCCCUUCUGCCAGGC | 23 | 9308 |
| BCL11A-7635 | + | GUGGAAAGCGCCCUUCUGCCAGGC | 24 | 9309 |
| BCL11A-7636 | + | GCAUAGGGCUGGGCCGGC | 18 | 9310 |
| BCL11A-7637 | + | UGCAUAGGGCUGGGCCGGC | 19 | 9311 |
| BCL11A-7638 | + | UUGCAUAGGGCUGGGCCGGC | 20 | 9312 |
| BCL11A-7639 | + | UUUGCAUAGGGCUGGGCCGGC | 21 | 9313 |
| BCL11A-7640 | + | CUUUGCAUAGGGCUGGGCCGGC | 22 | 9314 |
| BCL11A-7641 | + | CCUUUGCAUAGGGCUGGGCCGGC | 23 | 9315 |
| BCL11A-7642 | + | ACCUUUGCAUAGGGCUGGGCCGGC | 24 | 9316 |
| BCL11A-7643 | + | CGUGUUGGGCAUCGCGGC | 18 | 9317 |
| BCL11A-7644 | + | CCGUGUUGGGCAUCGCGGC | 19 | 9318 |
| BCL11A-6028 | + | UCCGUGUUGGGCAUCGCGGC | 20 | 9319 |
| BCL11A-7645 | + | CUCCGUGUUGGGCAUCGCGGC | 21 | 9320 |
| BCL11A-7646 | + | UCUCCGUGUUGGGCAUCGCGGC | 22 | 9321 |
| BCL11A-7647 | + | UUCUCCGUGUUGGGCAUCGCGGC | 23 | 9322 |
| BCL11A-7648 | + | GUUCUCCGUGUUGGGCAUCGCGGC | 24 | 9323 |
| BCL11A-7649 | + | AGCUGGGCCUGCCCGGGC | 18 | 9324 |
| BCL11A-7650 | + | GAGCUGGGCCUGCCCGGGC | 19 | 9325 |
| BCL11A-7651 | + | UGAGCUGGGCCUGCCCGGGC | 20 | 9326 |
| BCL11A-7652 | + | UUGAGCUGGGCCUGCCCGGGC | 21 | 9327 |
| BCL11A-7653 | + | UUUGAGCUGGGCCUGCCCGGGC | 22 | 9328 |
| BCL11A-7654 | + | UUUUGAGCUGGGCCUGCCCGGGC | 23 | 9329 |
| BCL11A-7655 | + | CUUUUGAGCUGGGCCUGCCCGGGC | 24 | 9330 |

TABLE 16E-continued

5th Tier

| gRNA Name | DNA Strand | Targeting Domain | Target Site Length | SEQ ID NO: |
|---|---|---|---|---|
| BCL11A-7656 | + | UUGGACUUGACCGGGGC | 18 | 9331 |
| BCL11A-7657 | + | CUUGGACUUGACCGGGGC | 19 | 9332 |
| BCL11A-6032 | + | ACUUGGACUUGACCGGGGC | 20 | 9333 |
| BCL11A-7658 | + | GACUUGGACUUGACCGGGGC | 21 | 9334 |
| BCL11A-7659 | + | UGACUUGGACUUGACCGGGGC | 22 | 9335 |
| BCL11A-7660 | + | AUGACUUGGACUUGACCGGGGC | 23 | 9336 |
| BCL11A-7661 | + | CAUGACUUGGACUUGACCGGGGC | 24 | 9337 |
| BCL11A-7662 | + | CCUAGAGAAAUCCAUGGC | 18 | 9338 |
| BCL11A-7663 | + | UCCUAGAGAAAUCCAUGGC | 19 | 9339 |
| BCL11A-6035 | + | CUCCUAGAGAAAUCCAUGGC | 20 | 9340 |
| BCL11A-7664 | + | UCUCCUAGAGAAAUCCAUGGC | 21 | 9341 |
| BCL11A-7665 | + | GUCUCCUAGAGAAAUCCAUGGC | 22 | 9342 |
| BCL11A-7666 | + | AGUCUCCUAGAGAAAUCCAUGGC | 23 | 9343 |
| BCL11A-7667 | + | AAGUCUCCUAGAGAAAUCCAUGGC | 24 | 9344 |
| BCL11A-7668 | + | AUCCCAUGGAGAGGUGGC | 18 | 9345 |
| BCL11A-7669 | + | AAUCCCAUGGAGAGGUGGC | 19 | 9346 |
| BCL11A-6038 | + | GAAUCCCAUGGAGAGGUGGC | 20 | 9347 |
| BCL11A-7670 | + | UGAAUCCCAUGGAGAGGUGGC | 21 | 9348 |
| BCL11A-7671 | + | AUGAAUCCCAUGGAGAGGUGGC | 22 | 9349 |
| BCL11A-7672 | + | UAUGAAUCCCAUGGAGAGGUGGC | 23 | 9350 |
| BCL11A-7673 | + | AUAUGAAUCCCAUGGAGAGGUGGC | 24 | 9351 |
| BCL11A-7674 | + | ACUCGGGUGAUGGGUGGC | 18 | 9352 |
| BCL11A-7675 | + | CACUCGGGUGAUGGGUGGC | 19 | 9353 |
| BCL11A-7676 | + | GCACUCGGGUGAUGGGUGGC | 20 | 9354 |
| BCL11A-7677 | + | GGCACUCGGGUGAUGGGUGGC | 21 | 9355 |
| BCL11A-7678 | + | AGGCACUCGGGUGAUGGGUGGC | 22 | 9356 |
| BCL11A-7679 | + | AAGGCACUCGGGUGAUGGGUGGC | 23 | 9357 |
| BCL11A-7680 | + | AAAGGCACUCGGGUGAUGGGUGGC | 24 | 9358 |
| BCL11A-7681 | + | CUUUUGAGCUGGGCCUGC | 18 | 9359 |
| BCL11A-7682 | + | UCUUUUGAGCUGGGCCUGC | 19 | 9360 |
| BCL11A-7683 | + | CUCUUUUGAGCUGGGCCUGC | 20 | 9361 |
| BCL11A-7684 | + | CCUCUUUUGAGCUGGGCCUGC | 21 | 9362 |
| BCL11A-7685 | + | CCCUCUUUUGAGCUGGGCCUGC | 22 | 9363 |
| BCL11A-7686 | + | GCCCUCUUUUGAGCUGGGCCUGC | 23 | 9364 |
| BCL11A-7687 | + | UGCCCUCUUUUGAGCUGGGCCUGC | 24 | 9365 |
| BCL11A-7688 | + | AAGGGAUCUUUGAGCUGC | 18 | 9366 |
| BCL11A-7689 | + | GAAGGGAUCUUUGAGCUGC | 19 | 9367 |

TABLE 16E-continued

5th Tier

| gRNA Name | DNA Strand | Targeting Domain | Target Site Length | SEQ ID NO: |
|---|---|---|---|---|
| BCL11A-7690 | + | GGAAGGGAUCUUUGAGCUGC | 20 | 9368 |
| BCL11A-7691 | + | AGGAAGGGAUCUUUGAGCUGC | 21 | 9369 |
| BCL11A-7692 | + | AAGGAAGGGAUCUUUGAGCUGC | 22 | 9370 |
| BCL11A-7693 | + | UAAGGAAGGGAUCUUUGAGCUGC | 23 | 9371 |
| BCL11A-7694 | + | CUAAGGAAGGGAUCUUUGAGCUGC | 24 | 9372 |
| BCL11A-7695 | + | GCCUCGCUGAAGUGCUGC | 18 | 9373 |
| BCL11A-7696 | + | GGCCUCGCUGAAGUGCUGC | 19 | 9374 |
| BCL11A-7697 | + | AGGCCUCGCUGAAGUGCUGC | 20 | 9375 |
| BCL11A-7698 | + | AAGGCCUCGCUGAAGUGCUGC | 21 | 9376 |
| BCL11A-7699 | + | GAAGGCCUCGCUGAAGUGCUGC | 22 | 9377 |
| BCL11A-7700 | + | GGAAGGCCUCGCUGAAGUGCUGC | 23 | 9378 |
| BCL11A-7701 | + | UGGAAGGCCUCGCUGAAGUGCUGC | 24 | 9379 |
| BCL11A-7702 | + | GUGUUCUGUGCGUGUUGC | 18 | 9380 |
| BCL11A-7703 | + | AGUGUUCUGUGCGUGUUGC | 19 | 9381 |
| BCL11A-7704 | + | GAGUGUUCUGUGCGUGUUGC | 20 | 9382 |
| BCL11A-7705 | + | UGAGUGUUCUGUGCGUGUUGC | 21 | 9383 |
| BCL11A-7706 | + | AUGAGUGUUCUGUGCGUGUUGC | 22 | 9384 |
| BCL11A-7707 | + | CAUGAGUGUUCUGUGCGUGUUGC | 23 | 9385 |
| BCL11A-7708 | + | CCAUGAGUGUUCUGUGCGUGUUGC | 24 | 9386 |
| BCL11A-7709 | + | CGAAAACUGCCACACAUC | 18 | 9387 |
| BCL11A-7710 | + | CCGAAAACUGCCACACAUC | 19 | 9388 |
| BCL11A-7711 | + | UCCGAAAACUGCCACACAUC | 20 | 9389 |
| BCL11A-7712 | + | AUCCGAAAACUGCCACACAUC | 21 | 9390 |
| BCL11A-7713 | + | CAUCCGAAAACUGCCACACAUC | 22 | 9391 |
| BCL11A-7714 | + | CCAUCCGAAAACUGCCACACAUC | 23 | 9392 |
| BCL11A-7715 | + | UCCAUCCGAAAACUGCCACACAUC | 24 | 9393 |
| BCL11A-7716 | + | UUGGGGUCGUUCUCGCUC | 18 | 9394 |
| BCL11A-7717 | + | GUUGGGGUCGUUCUCGCUC | 19 | 9395 |
| BCL11A-7718 | + | GGUUGGGGUCGUUCUCGCUC | 20 | 9396 |
| BCL11A-7719 | + | AGGUUGGGGUCGUUCUCGCUC | 21 | 9397 |
| BCL11A-7720 | + | CAGGUUGGGGUCGUUCUCGCUC | 22 | 9398 |
| BCL11A-7721 | + | UCAGGUUGGGGUCGUUCUCGCUC | 23 | 9399 |
| BCL11A-7722 | + | AUCAGGUUGGGGUCGUUCUCGCUC | 24 | 9400 |
| BCL11A-7723 | + | CUCAGAACUUAAGGGCUC | 18 | 9401 |
| BCL11A-7724 | + | UCUCAGAACUUAAGGGCUC | 19 | 9402 |
| BCL11A-7725 | + | UUCUCAGAACUUAAGGGCUC | 20 | 9403 |
| BCL11A-7726 | + | UUUCUCAGAACUUAAGGGCUC | 21 | 9404 |
| BCL11A-7727 | + | UUUUCUCAGAACUUAAGGGCUC | 22 | 9405 |

TABLE 16E-continued

5th Tier

| gRNA Name | DNA Strand | Targeting Domain | Target Site Length | SEQ ID NO: |
|---|---|---|---|---|
| BCL11A-7728 | + | AUUUUCUCAGAACUUAAGGGCUC | 23 | 9406 |
| BCL11A-7729 | + | AAUUUUCUCAGAACUUAAGGGCUC | 24 | 9407 |
| BCL11A-7730 | + | GACAUUCUGCACCUAGUC | 18 | 9408 |
| BCL11A-7731 | + | GGACAUUCUGCACCUAGUC | 19 | 9409 |
| BCL11A-7732 | + | AGGACAUUCUGCACCUAGUC | 20 | 9410 |
| BCL11A-7733 | + | AAGGACAUUCUGCACCUAGUC | 21 | 9411 |
| BCL11A-7734 | + | GAAGGACAUUCUGCACCUAGUC | 22 | 9412 |
| BCL11A-7735 | + | GGAAGGACAUUCUGCACCUAGUC | 23 | 9413 |
| BCL11A-7736 | + | GGGAAGGACAUUCUGCACCUAGUC | 24 | 9414 |
| BCL11A-7737 | + | UCGUCGGACUUGACCGUC | 18 | 9415 |
| BCL11A-7738 | + | GUCGUCGGACUUGACCGUC | 19 | 9416 |
| BCL11A-7739 | + | CGUCGUCGGACUUGACCGUC | 20 | 9417 |
| BCL11A-7740 | + | CCGUCGUCGGACUUGACCGUC | 21 | 9418 |
| BCL11A-7741 | + | ACCGUCGUCGGACUUGACCGUC | 22 | 9419 |
| BCL11A-7742 | + | GACCGUCGUCGGACUUGACCGUC | 23 | 9420 |
| BCL11A-7743 | + | AGACCGUCGUCGGACUUGACCGUC | 24 | 9421 |
| BCL11A-7744 | + | AUACCAACCCGCGGGUC | 18 | 9422 |
| BCL11A-7745 | + | GAUACCAACCCGCGGGUC | 19 | 9423 |
| BCL11A-6052 | + | GGAUACCAACCCGCGGGUC | 20 | 9424 |
| BCL11A-7746 | + | GGGAUACCAACCCGCGGGUC | 21 | 9425 |
| BCL11A-7747 | + | AGGGAUACCAACCCGCGGGUC | 22 | 9426 |
| BCL11A-7748 | + | AAGGGAUACCAACCCGCGGGUC | 23 | 9427 |
| BCL11A-7749 | + | GAAGGGAUACCAACCCGCGGGUC | 24 | 9428 |
| BCL11A-7750 | + | GGCAGGUCGAACUCCUUC | 18 | 9429 |
| BCL11A-7751 | + | GGGCAGGUCGAACUCCUUC | 19 | 9430 |
| BCL11A-7752 | + | GGGGCAGGUCGAACUCCUUC | 20 | 9431 |
| BCL11A-7753 | + | GGGGGCAGGUCGAACUCCUUC | 21 | 9432 |
| BCL11A-7754 | + | CGGGGGCAGGUCGAACUCCUUC | 22 | 9433 |
| BCL11A-7755 | + | CCGGGGGCAGGUCGAACUCCUUC | 23 | 9434 |
| BCL11A-7756 | + | GCCGGGGGCAGGUCGAACUCCUUC | 24 | 9435 |
| BCL11A-7757 | + | GUCGCUGGUGCCGGGUUC | 18 | 9436 |
| BCL11A-7758 | + | AGUCGCUGGUGCCGGGUUC | 19 | 9437 |
| BCL11A-6058 | + | AAGUCGCUGGUGCCGGGUUC | 20 | 9438 |
| BCL11A-7759 | + | CAAGUCGCUGGUGCCGGGUUC | 21 | 9439 |
| BCL11A-7760 | + | CCAAGUCGCUGGUGCCGGGUUC | 22 | 9440 |
| BCL11A-7761 | + | ACCAAGUCGCUGGUGCCGGGUUC | 23 | 9441 |
| BCL11A-7762 | + | CACCAAGUCGCUGGUGCCGGGUUC | 24 | 9442 |

TABLE 16E-continued

5th Tier

| gRNA Name | DNA Strand | Targeting Domain | Target Site Length | SEQ ID NO: |
|---|---|---|---|---|
| BCL11A-7763 | + | CGGUGGUGGACUAAACAG | 18 | 9443 |
| BCL11A-7764 | + | UCGGUGGUGGACUAAACAG | 19 | 9444 |
| BCL11A-6063 | + | CUCGGUGGUGGACUAAACAG | 20 | 9445 |
| BCL11A-7765 | + | UCUCGGUGGUGGACUAAACAG | 21 | 9446 |
| BCL11A-7766 | + | GUCUCGGUGGUGGACUAAACAG | 22 | 9447 |
| BCL11A-7767 | + | UGUCUCGGUGGUGGACUAAACAG | 23 | 9448 |
| BCL11A-7768 | + | AUGUCUCGGUGGUGGACUAAACAG | 24 | 9449 |
| BCL11A-7769 | + | GAAAGAGGUUGGAGACAG | 18 | 9450 |
| BCL11A-7770 | + | AGAAAGAGGUUGGAGACAG | 19 | 9451 |
| BCL11A-6064 | + | UAGAAAGAGGUUGGAGACAG | 20 | 9452 |
| BCL11A-7771 | + | CUAGAAAGAGGUUGGAGACAG | 21 | 9453 |
| BCL11A-7772 | + | CCUAGAAAGAGGUUGGAGACAG | 22 | 9454 |
| BCL11A-7773 | + | ACCUAGAAAGAGGUUGGAGACAG | 23 | 9455 |
| BCL11A-7774 | + | AACCUAGAAAGAGGUUGGAGACAG | 24 | 9456 |
| BCL11A-7775 | + | AGGAGGGGCGGAUUGCAG | 18 | 9457 |
| BCL11A-7776 | + | GAGGAGGGGCGGAUUGCAG | 19 | 9458 |
| BCL11A-6069 | + | GGAGGAGGGGCGGAUUGCAG | 20 | 9459 |
| BCL11A-7777 | + | GGGAGGAGGGGCGGAUUGCAG | 21 | 9460 |
| BCL11A-7778 | + | AGGGAGGAGGGGCGGAUUGCAG | 22 | 9461 |
| BCL11A-7779 | + | GAGGGAGGAGGGGCGGAUUGCAG | 23 | 9462 |
| BCL11A-7780 | + | GGAGGGAGGAGGGGCGGAUUGCAG | 24 | 9463 |
| BCL11A-7781 | + | AAGAGGUUGGAGACAGAG | 18 | 9464 |
| BCL11A-7782 | + | AAAGAGGUUGGAGACAGAG | 19 | 9465 |
| BCL11A-7783 | + | GAAAGAGGUUGGAGACAGAG | 20 | 9466 |
| BCL11A-7784 | + | AGAAAGAGGUUGGAGACAGAG | 21 | 9467 |
| BCL11A-7785 | + | UAGAAAGAGGUUGGAGACAGAG | 22 | 9468 |
| BCL11A-7786 | + | CUAGAAAGAGGUUGGAGACAGAG | 23 | 9469 |
| BCL11A-7787 | + | CCUAGAAAGAGGUUGGAGACAGAG | 24 | 9470 |
| BCL11A-7788 | + | GAGGGGCGGAUUGCAGAG | 18 | 9471 |
| BCL11A-7789 | + | GGAGGGGCGGAUUGCAGAG | 19 | 9472 |
| BCL11A-7790 | + | AGGAGGGGCGGAUUGCAGAG | 20 | 9473 |
| BCL11A-7791 | + | GAGGAGGGGCGGAUUGCAGAG | 21 | 9474 |
| BCL11A-7792 | + | GGAGGAGGGGCGGAUUGCAGAG | 22 | 9475 |
| BCL11A-7793 | + | GGGAGGAGGGGCGGAUUGCAGAG | 23 | 9476 |
| BCL11A-7794 | + | AGGGAGGAGGGGCGGAUUGCAGAG | 24 | 9477 |
| BCL11A-7795 | + | AGCUUGAUGCGCUUAGAG | 18 | 9478 |
| BCL11A-7796 | + | GAGCUUGAUGCGCUUAGAG | 19 | 9479 |
| BCL11A-7797 | + | CGAGCUUGAUGCGCUUAGAG | 20 | 9480 |

TABLE 16E-continued

5th Tier

| gRNA Name | DNA Strand | Targeting Domain | Target Site Length | SEQ ID NO: |
|---|---|---|---|---|
| BCL11A-7798 | + | UCGAGCUUGAUGCGCUUAGAG | 21 | 9481 |
| BCL11A-7799 | + | CUCGAGCUUGAUGCGCUUAGAG | 22 | 9482 |
| BCL11A-7800 | + | UCUCGAGCUUGAUGCGCUUAGAG | 23 | 9483 |
| BCL11A-7801 | + | UUCUCGAGCUUGAUGCGCUUAGAG | 24 | 9484 |
| BCL11A-7802 | + | GAGAAGGGGCUCAGCGAG | 18 | 9485 |
| BCL11A-7803 | + | AGAGAAGGGGCUCAGCGAG | 19 | 9486 |
| BCL11A-7804 | + | UAGAGAAGGGGCUCAGCGAG | 20 | 9487 |
| BCL11A-7805 | + | UUAGAGAAGGGGCUCAGCGAG | 21 | 9488 |
| BCL11A-7806 | + | CUUAGAGAAGGGGCUCAGCGAG | 22 | 9489 |
| BCL11A-7807 | + | GCUUAGAGAAGGGGCUCAGCGAG | 23 | 9490 |
| BCL11A-7808 | + | CGCUUAGAGAAGGGGCUCAGCGAG | 24 | 9491 |
| BCL11A-7809 | + | GGAUUGCAGAGGAGGGAG | 18 | 9492 |
| BCL11A-7810 | + | CGGAUUGCAGAGGAGGGAG | 19 | 9493 |
| BCL11A-6075 | + | GCGGAUUGCAGAGGAGGGAG | 20 | 9494 |
| BCL11A-7811 | + | GGCGGAUUGCAGAGGAGGGAG | 21 | 9495 |
| BCL11A-7812 | + | GGGCGGAUUGCAGAGGAGGGAG | 22 | 9496 |
| BCL11A-7813 | + | GGGGCGGAUUGCAGAGGAGGGAG | 23 | 9497 |
| BCL11A-7814 | + | AGGGGCGGAUUGCAGAGGAGGGAG | 24 | 9498 |
| BCL11A-7815 | + | CCGGGGGCUGGGAGGGAG | 18 | 9499 |
| BCL11A-7816 | + | ACCGGGGGCUGGGAGGGAG | 19 | 9500 |
| BCL11A-7817 | + | GACCGGGGGCUGGGAGGGAG | 20 | 9501 |
| BCL11A-7818 | + | UGACCGGGGGCUGGGAGGGAG | 21 | 9502 |
| BCL11A-7819 | + | UUGACCGGGGGCUGGGAGGGAG | 22 | 9503 |
| BCL11A-7820 | + | CUUGACCGGGGGCUGGGAGGGAG | 23 | 9504 |
| BCL11A-7821 | + | ACUUGACCGGGGGCUGGGAGGGAG | 24 | 9505 |
| BCL11A-7822 | + | CUGAAGUGCUGCAUGGAG | 18 | 9506 |
| BCL11A-7823 | + | GCUGAAGUGCUGCAUGGAG | 19 | 9507 |
| BCL11A-7824 | + | CGCUGAAGUGCUGCAUGGAG | 20 | 9508 |
| BCL11A-7825 | + | UCGCUGAAGUGCUGCAUGGAG | 21 | 9509 |
| BCL11A-7826 | + | CUCGCUGAAGUGCUGCAUGGAG | 22 | 9510 |
| BCL11A-7827 | + | CCUCGCUGAAGUGCUGCAUGGAG | 23 | 9511 |
| BCL11A-7828 | + | GCCUCGCUGAAGUGCUGCAUGGAG | 24 | 9512 |
| BCL11A-7829 | + | CGUCUGCCCUCUUUUGAG | 18 | 9513 |
| BCL11A-7830 | + | GCGUCUGCCCUCUUUUGAG | 19 | 9514 |
| BCL11A-7831 | + | UGCGUCUGCCCUCUUUUGAG | 20 | 9515 |
| BCL11A-7832 | + | CUGCGUCUGCCCUCUUUUGAG | 21 | 9516 |
| BCL11A-7833 | + | GCUGCGUCUGCCCUCUUUUGAG | 22 | 9517 |

TABLE 16E-continued

5th Tier

| gRNA Name | DNA Strand | Targeting Domain | Target Site Length | SEQ ID NO: |
|---|---|---|---|---|
| BCL11A-7834 | + | CGCUGCGUCUGCCCUCUUUUGAG | 23 | 9518 |
| BCL11A-7835 | + | UCGCUGCGUCUGCCCUCUUUUGAG | 24 | 9519 |
| BCL11A-7836 | + | CCGAGGAGUGCUCCGACG | 18 | 9520 |
| BCL11A-7837 | + | UCCGAGGAGUGCUCCGACG | 19 | 9521 |
| BCL11A-6080 | + | CUCCGAGGAGUGCUCCGACG | 20 | 9522 |
| BCL11A-7838 | + | UCUCCGAGGAGUGCUCCGACG | 21 | 9523 |
| BCL11A-7839 | + | UUCUCCGAGGAGUGCUCCGACG | 22 | 9524 |
| BCL11A-7840 | + | GUUCUCCGAGGAGUGCUCCGACG | 23 | 9525 |
| BCL11A-7841 | + | CGUUCUCCGAGGAGUGCUCCGACG | 24 | 9526 |
| BCL11A-7842 | + | ACCAUGCCCUGCAUGACG | 18 | 9527 |
| BCL11A-7843 | + | CACCAUGCCCUGCAUGACG | 19 | 9528 |
| BCL11A-7844 | + | GCACCAUGCCCUGCAUGACG | 20 | 9529 |
| BCL11A-7845 | + | AGCACCAUGCCCUGCAUGACG | 21 | 9530 |
| BCL11A-7846 | + | GAGCACCAUGCCCUGCAUGACG | 22 | 9531 |
| BCL11A-7847 | + | UGAGCACCAUGCCCUGCAUGACG | 23 | 9532 |
| BCL11A-7848 | + | CUGAGCACCAUGCCCUGCAUGACG | 24 | 9533 |
| BCL11A-7849 | + | CCGAGGCCGACUCGCCCG | 18 | 9534 |
| BCL11A-7850 | + | CCCGAGGCCGACUCGCCCG | 19 | 9535 |
| BCL11A-6088 | + | CCCCGAGGCCGACUCGCCCG | 20 | 9536 |
| BCL11A-7851 | + | CCCCCGAGGCCGACUCGCCCG | 21 | 9537 |
| BCL11A-7852 | + | CCCCCCGAGGCCGACUCGCCCG | 22 | 9538 |
| BCL11A-7853 | + | GCCCCCCGAGGCCGACUCGCCCG | 23 | 9539 |
| BCL11A-7854 | + | GGCCCCCCGAGGCCGACUCGCCCG | 24 | 9540 |
| BCL11A-7855 | + | CUGGAGGCCGCGUAGCCG | 18 | 9541 |
| BCL11A-7856 | + | CCUGGAGGCCGCGUAGCCG | 19 | 9542 |
| BCL11A-7857 | + | GCCUGGAGGCCGCGUAGCCG | 20 | 9543 |
| BCL11A-7858 | + | UGCCUGGAGGCCGCGUAGCCG | 21 | 9544 |
| BCL11A-7859 | + | CUGCCUGGAGGCCGCGUAGCCG | 22 | 9545 |
| BCL11A-7860 | + | GCUGCCUGGAGGCCGCGUAGCCG | 23 | 9546 |
| BCL11A-7861 | + | AGCUGCCUGGAGGCCGCGUAGCCG | 24 | 9547 |
| BCL11A-7862 | + | AAUUUGAACGUCUUGCCG | 18 | 9548 |
| BCL11A-7863 | + | AAAUUUGAACGUCUUGCCG | 19 | 9549 |
| BCL11A-7864 | + | GAAAUUUGAACGUCUUGCCG | 20 | 9550 |
| BCL11A-7865 | + | UGAAAUUUGAACGUCUUGCCG | 21 | 9551 |
| BCL11A-7866 | + | CUGAAAUUUGAACGUCUUGCCG | 22 | 9552 |
| BCL11A-7867 | + | UCUGAAAUUUGAACGUCUUGCCG | 23 | 9553 |
| BCL11A-7868 | + | CUCUGAAAUUUGAACGUCUUGCCG | 24 | 9554 |
| BCL11A-7869 | + | UCUCCGAGGAGUGCUCCG | 18 | 9555 |

TABLE 16E-continued

| | 5th Tier | | | |
|---|---|---|---|---|
| gRNA Name | DNA Strand | Targeting Domain | Target Site Length | SEQ ID NO: |
| BCL11A-7870 | + | UUCUCCGAGGAGUGCUCCG | 19 | 9556 |
| BCL11A-7871 | + | GUUCUCCGAGGAGUGCUCCG | 20 | 9557 |
| BCL11A-7872 | + | CGUUCUCCGAGGAGUGCUCCG | 21 | 9558 |
| BCL11A-7873 | + | CCGUUCUCCGAGGAGUGCUCCG | 22 | 9559 |
| BCL11A-7874 | + | CCCGUUCUCCGAGGAGUGCUCCG | 23 | 9560 |
| BCL11A-7875 | + | UCCCGUUCUCCGAGGAGUGCUCCG | 24 | 9561 |
| BCL11A-7876 | + | CGCUGGUGCCGGGUUCCG | 18 | 9562 |
| BCL11A-7877 | + | UCGCUGGUGCCGGGUUCCG | 19 | 9563 |
| BCL11A-6096 | + | GUCGCUGGUGCCGGGUUCCG | 20 | 9564 |
| BCL11A-7878 | + | AGUCGCUGGUGCCGGGUUCCG | 21 | 9565 |
| BCL11A-7879 | + | AAGUCGCUGGUGCCGGGUUCCG | 22 | 9566 |
| BCL11A-7880 | + | CAAGUCGCUGGUGCCGGGUUCCG | 23 | 9567 |
| BCL11A-7881 | + | CCAAGUCGCUGGUGCCGGGUUCCG | 24 | 9568 |
| BCL11A-7882 | + | GCCGGCCUGGGGACAGCG | 18 | 9569 |
| BCL11A-7883 | + | GGCCGGCCUGGGGACAGCG | 19 | 9570 |
| BCL11A-7884 | + | GGGCCGGCCUGGGGACAGCG | 20 | 9571 |
| BCL11A-7885 | + | UGGGCCGGCCUGGGGACAGCG | 21 | 9572 |
| BCL11A-7886 | + | CUGGGCCGGCCUGGGGACAGCG | 22 | 9573 |
| BCL11A-7887 | + | GCUGGGCCGGCCUGGGGACAGCG | 23 | 9574 |
| BCL11A-7888 | + | GGCUGGGCCGGCCUGGGGACAGCG | 24 | 9575 |
| BCL11A-7889 | + | GGUUCCGGGGAGCUGGCG | 18 | 9576 |
| BCL11A-7890 | + | GGGUUCCGGGGAGCUGGCG | 19 | 9577 |
| BCL11A-7891 | + | CGGGUUCCGGGGAGCUGGCG | 20 | 9578 |
| BCL11A-7892 | + | CCGGGUUCCGGGGAGCUGGCG | 21 | 9579 |
| BCL11A-7893 | + | GCCGGGUUCCGGGGAGCUGGCG | 22 | 9580 |
| BCL11A-7894 | + | UGCCGGGUUCCGGGGAGCUGGCG | 23 | 9581 |
| BCL11A-7895 | + | GUGCCGGGUUCCGGGGAGCUGGCG | 24 | 9582 |
| BCL11A-7896 | + | CCCCAGGCGCUCUAUGCG | 18 | 9583 |
| BCL11A-7897 | + | CCCCCAGGCGCUCUAUGCG | 19 | 9584 |
| BCL11A-7898 | + | GCCCCCAGGCGCUCUAUGCG | 20 | 9585 |
| BCL11A-7899 | + | CGCCCCCAGGCGCUCUAUGCG | 21 | 9586 |
| BCL11A-7900 | + | CCGCCCCCAGGCGCUCUAUGCG | 22 | 9587 |
| BCL11A-7901 | + | UCCGCCCCCAGGCGCUCUAUGCG | 23 | 9588 |
| BCL11A-7902 | + | UUCCGCCCCCAGGCGCUCUAUGCG | 24 | 9589 |
| BCL11A-7903 | + | ACCUGGUGGAAGGCCUCG | 18 | 9590 |
| BCL11A-7904 | + | GACCUGGUGGAAGGCCUCG | 19 | 9591 |
| BCL11A-7905 | + | GGACCUGGUGGAAGGCCUCG | 20 | 9592 |

TABLE 16E-continued

5th Tier

| gRNA Name | DNA Strand | Targeting Domain | Target Site Length | SEQ ID NO: |
|---|---|---|---|---|
| BCL11A-7906 | + | AGGACCUGGUGGAAGGCCUCG | 21 | 9593 |
| BCL11A-7907 | + | CAGGACCUGGUGGAAGGCCUCG | 22 | 9594 |
| BCL11A-7908 | + | CCAGGACCUGGUGGAAGGCCUCG | 23 | 9595 |
| BCL11A-7909 | + | CCCAGGACCUGGUGGAAGGCCUCG | 24 | 9596 |
| BCL11A-7910 | + | GCGGUGGAGAGACCGUCG | 18 | 9597 |
| BCL11A-7911 | + | GGCGGUGGAGAGACCGUCG | 19 | 9598 |
| BCL11A-7912 | + | UGGCGGUGGAGAGACCGUCG | 20 | 9599 |
| BCL11A-7913 | + | CUGGCGGUGGAGAGACCGUCG | 21 | 9600 |
| BCL11A-7914 | + | GCUGGCGGUGGAGAGACCGUCG | 22 | 9601 |
| BCL11A-7915 | + | AGCUGGCGGUGGAGAGACCGUCG | 23 | 9602 |
| BCL11A-7916 | + | GAGCUGGCGGUGGAGAGACCGUCG | 24 | 9603 |
| BCL11A-7917 | + | GAGUCUCCGAAGCUAAGG | 18 | 9604 |
| BCL11A-7918 | + | GGAGUCUCCGAAGCUAAGG | 19 | 9605 |
| BCL11A-7919 | + | UGGAGUCUCCGAAGCUAAGG | 20 | 9606 |
| BCL11A-7920 | + | CUGGAGUCUCCGAAGCUAAGG | 21 | 9607 |
| BCL11A-7921 | + | UCUGGAGUCUCCGAAGCUAAGG | 22 | 9608 |
| BCL11A-7922 | + | GUCUGGAGUCUCCGAAGCUAAGG | 23 | 9609 |
| BCL11A-7923 | + | UGUCUGGAGUCUCCGAAGCUAAGG | 24 | 9610 |
| BCL11A-7924 | + | GGUGGUGGACUAAACAGG | 18 | 9611 |
| BCL11A-7925 | + | CGGUGGUGGACUAAACAGG | 19 | 9612 |
| BCL11A-6111 | + | UCGGUGGUGGACUAAACAGG | 20 | 9613 |
| BCL11A-7926 | + | CUCGGUGGUGGACUAAACAGG | 21 | 9614 |
| BCL11A-7927 | + | UCUCGGUGGUGGACUAAACAGG | 22 | 9615 |
| BCL11A-7928 | + | GUCUCGGUGGUGGACUAAACAGG | 23 | 9616 |
| BCL11A-7929 | + | UGUCUCGGUGGUGGACUAAACAGG | 24 | 9617 |
| BCL11A-7930 | + | AGGGGGGGCGUCGCCAGG | 18 | 9618 |
| BCL11A-7931 | + | GAGGGGGGGCGUCGCCAGG | 19 | 9619 |
| BCL11A-7932 | + | GGAGGGGGGGCGUCGCCAGG | 20 | 9620 |
| BCL11A-7933 | + | GGGAGGGGGGGCGUCGCCAGG | 21 | 9621 |
| BCL11A-7934 | + | AGGGAGGGGGGGCGUCGCCAGG | 22 | 9622 |
| BCL11A-7935 | + | GAGGGAGGGGGGGCGUCGCCAGG | 23 | 9623 |
| BCL11A-7936 | + | GGAGGGAGGGGGGGCGUCGCCAGG | 24 | 9624 |
| BCL11A-7937 | + | AAGCGCCCUUCUGCCAGG | 18 | 9625 |
| BCL11A-7938 | + | AAAGCGCCCUUCUGCCAGG | 19 | 9626 |
| BCL11A-7939 | + | GAAAGCGCCCUUCUGCCAGG | 20 | 9627 |
| BCL11A-7940 | + | GGAAAGCGCCCUUCUGCCAGG | 21 | 9628 |
| BCL11A-7941 | + | UGGAAAGCGCCCUUCUGCCAGG | 22 | 9629 |
| BCL11A-7942 | + | GUGGAAAGCGCCCUUCUGCCAGG | 23 | 9630 |

TABLE 16E-continued

5th Tier

| gRNA Name | DNA Strand | Targeting Domain | Target Site Length | SEQ ID NO: |
|---|---|---|---|---|
| BCL11A-7943 | + | GGUGGAAAGCGCCCUUCUGCCAGG | 24 | 9631 |
| BCL11A-7944 | + | AUCGCGGCCGGGGGCAGG | 18 | 9632 |
| BCL11A-7945 | + | CAUCGCGGCCGGGGGCAGG | 19 | 9633 |
| BCL11A-7946 | + | GCAUCGCGGCCGGGGGCAGG | 20 | 9634 |
| BCL11A-7947 | + | GGCAUCGCGGCCGGGGGCAGG | 21 | 9635 |
| BCL11A-7948 | + | GGGCAUCGCGGCCGGGGGCAGG | 22 | 9636 |
| BCL11A-7949 | + | UGGGCAUCGCGGCCGGGGGCAGG | 23 | 9637 |
| BCL11A-7950 | + | UUGGGCAUCGCGGCCGGGGGCAGG | 24 | 9638 |
| BCL11A-7951 | + | CCGUUCUCCGGGAUCAGG | 18 | 9639 |
| BCL11A-7952 | + | CCCGUUCUCCGGGAUCAGG | 19 | 9640 |
| BCL11A-7953 | + | CCCCGUUCUCCGGGAUCAGG | 20 | 9641 |
| BCL11A-7954 | + | UCCCCGUUCUCCGGGAUCAGG | 21 | 9642 |
| BCL11A-7955 | + | GUCCCCGUUCUCCGGGAUCAGG | 22 | 9643 |
| BCL11A-7956 | + | CGUCCCCGUUCUCCGGGAUCAGG | 23 | 9644 |
| BCL11A-7957 | + | UCGUCCCCGUUCUCCGGGAUCAGG | 24 | 9645 |
| BCL11A-7958 | + | GAAGAACCUAGAAAGAGG | 18 | 9646 |
| BCL11A-7959 | + | UGAAGAACCUAGAAAGAGG | 19 | 9647 |
| BCL11A-7960 | + | GUGAAGAACCUAGAAAGAGG | 20 | 9648 |
| BCL11A-7961 | + | UGUGAAGAACCUAGAAAGAGG | 21 | 9649 |
| BCL11A-7962 | + | GUGUGAAGAACCUAGAAAGAGG | 22 | 9650 |
| BCL11A-7963 | + | UGUGUGAAGAACCUAGAAAGAGG | 23 | 9651 |
| BCL11A-7964 | + | GUGUGUGAAGAACCUAGAAAGAGG | 24 | 9652 |
| BCL11A-7965 | + | AGAGGUUGGAGACAGAGG | 18 | 9653 |
| BCL11A-7966 | + | AAGAGGUUGGAGACAGAGG | 19 | 9654 |
| BCL11A-6113 | + | AAAGAGGUUGGAGACAGAGG | 20 | 9655 |
| BCL11A-7967 | + | GAAAGAGGUUGGAGACAGAGG | 21 | 9656 |
| BCL11A-7968 | + | AGAAAGAGGUUGGAGACAGAGG | 22 | 9657 |
| BCL11A-7969 | + | UAGAAAGAGGUUGGAGACAGAGG | 23 | 9658 |
| BCL11A-7970 | + | CUAGAAAGAGGUUGGAGACAGAGG | 24 | 9659 |
| BCL11A-7971 | + | AGGGGCGGAUUGCAGAGG | 18 | 9660 |
| BCL11A-7972 | + | GAGGGGCGGAUUGCAGAGG | 19 | 9661 |
| BCL11A-6114 | + | GGAGGGGCGGAUUGCAGAGG | 20 | 9662 |
| BCL11A-7973 | + | AGGAGGGGCGGAUUGCAGAGG | 21 | 9663 |
| BCL11A-7974 | + | GAGGAGGGGCGGAUUGCAGAGG | 22 | 9664 |
| BCL11A-7975 | + | GGAGGAGGGGCGGAUUGCAGAGG | 23 | 9665 |
| BCL11A-7976 | + | GGGAGGAGGGGCGGAUUGCAGAGG | 24 | 9666 |
| BCL11A-7977 | + | GGCGGAUUGCAGAGGAGG | 18 | 9667 |

TABLE 16E-continued

5th Tier

| gRNA Name | DNA Strand | Targeting Domain | Target Site Length | SEQ ID NO: |
|---|---|---|---|---|
| BCL11A-7978 | + | GGGCGGAUUGCAGAGGAGG | 19 | 9668 |
| BCL11A-7979 | + | GGGGCGGAUUGCAGAGGAGG | 20 | 9669 |
| BCL11A-7980 | + | AGGGGCGGAUUGCAGAGGAGG | 21 | 9670 |
| BCL11A-7981 | + | GAGGGGCGGAUUGCAGAGGAGG | 22 | 9671 |
| BCL11A-7982 | + | GGAGGGGCGGAUUGCAGAGGAGG | 23 | 9672 |
| BCL11A-7983 | + | AGGAGGGGCGGAUUGCAGAGGAGG | 24 | 9673 |
| BCL11A-7984 | + | GAUUGCAGAGGAGGGAGG | 18 | 9674 |
| BCL11A-7985 | + | GGAUUGCAGAGGAGGGAGG | 19 | 9675 |
| BCL11A-6118 | + | CGGAUUGCAGAGGAGGGAGG | 20 | 9676 |
| BCL11A-7986 | + | GCGGAUUGCAGAGGAGGGAGG | 21 | 9677 |
| BCL11A-7987 | + | GGCGGAUUGCAGAGGAGGGAGG | 22 | 9678 |
| BCL11A-7988 | + | GGGCGGAUUGCAGAGGAGGGAGG | 23 | 9679 |
| BCL11A-7989 | + | GGGGCGGAUUGCAGAGGAGGGAGG | 24 | 9680 |
| BCL11A-7990 | + | CGGGGGCUGGGAGGGAGG | 18 | 9681 |
| BCL11A-7991 | + | CCGGGGGCUGGGAGGGAGG | 19 | 9682 |
| BCL11A-6119 | + | ACCGGGGGCUGGGAGGGAGG | 20 | 9683 |
| BCL11A-7992 | + | GACCGGGGGCUGGGAGGGAGG | 21 | 9684 |
| BCL11A-7993 | + | UGACCGGGGGCUGGGAGGGAGG | 22 | 9685 |
| BCL11A-7994 | + | UUGACCGGGGGCUGGGAGGGAGG | 23 | 9686 |
| BCL11A-7995 | + | CUUGACCGGGGGCUGGGAGGGAGG | 24 | 9687 |
| BCL11A-7996 | + | UGACCGGGGGCUGGGAGG | 18 | 9688 |
| BCL11A-7997 | + | UUGACCGGGGGCUGGGAGG | 19 | 9689 |
| BCL11A-7998 | + | CUUGACCGGGGGCUGGGAGG | 20 | 9690 |
| BCL11A-7999 | + | ACUUGACCGGGGGCUGGGAGG | 21 | 9691 |
| BCL11A-8000 | + | GACUUGACCGGGGGCUGGGAGG | 22 | 9692 |
| BCL11A-8001 | + | GGACUUGACCGGGGGCUGGGAGG | 23 | 9693 |
| BCL11A-8002 | + | UGGACUUGACCGGGGGCUGGGAGG | 24 | 9694 |
| BCL11A-8003 | + | CCGUGUUGGGCAUCGCGG | 18 | 9695 |
| BCL11A-8004 | + | UCCGUGUUGGGCAUCGCGG | 19 | 9696 |
| BCL11A-8005 | + | CUCCGUGUUGGGCAUCGCGG | 20 | 9697 |
| BCL11A-8006 | + | UCUCCGUGUUGGGCAUCGCGG | 21 | 9698 |
| BCL11A-8007 | + | UUCUCCGUGUUGGGCAUCGCGG | 22 | 9699 |
| BCL11A-8008 | + | GUUCUCCGUGUUGGGCAUCGCGG | 23 | 9700 |
| BCL11A-8009 | + | CGUUCUCCGUGUUGGGCAUCGCGG | 24 | 9701 |
| BCL11A-8010 | + | GUUCCGGGGAGCUGGCGG | 18 | 9702 |
| BCL11A-8011 | + | GGUUCCGGGGAGCUGGCGG | 19 | 9703 |
| BCL11A-6125 | + | GGGUUCCGGGGAGCUGGCGG | 20 | 9704 |
| BCL11A-8012 | + | CGGGUUCCGGGGAGCUGGCGG | 21 | 9705 |

TABLE 16E-continued

5th Tier

| gRNA Name | DNA Strand | Targeting Domain | Target Site Length | SEQ ID NO: |
|---|---|---|---|---|
| BCL11A-8013 | + | CCGGGUUCCGGGGAGCUGGCGG | 22 | 9706 |
| BCL11A-8014 | + | GCCGGGUUCCGGGGAGCUGGCGG | 23 | 9707 |
| BCL11A-8015 | + | UGCCGGGUUCCGGGGAGCUGGCGG | 24 | 9708 |
| BCL11A-8016 | + | CCCAGGCGCUCUAUGCGG | 18 | 9709 |
| BCL11A-8017 | + | CCCCAGGCGCUCUAUGCGG | 19 | 9710 |
| BCL11A-6126 | + | CCCCCAGGCGCUCUAUGCGG | 20 | 9711 |
| BCL11A-8018 | + | GCCCCCAGGCGCUCUAUGCGG | 21 | 9712 |
| BCL11A-8019 | + | CGCCCCCAGGCGCUCUAUGCGG | 22 | 9713 |
| BCL11A-8020 | + | CCGCCCCCAGGCGCUCUAUGCGG | 23 | 9714 |
| BCL11A-8021 | + | UCCGCCCCCAGGCGCUCUAUGCGG | 24 | 9715 |
| BCL11A-8022 | + | GUGGUGGACUAAACAGGG | 18 | 9716 |
| BCL11A-8023 | + | GGUGGUGGACUAAACAGGG | 19 | 9717 |
| BCL11A-6131 | + | CGGUGGUGGACUAAACAGGG | 20 | 9718 |
| BCL11A-8024 | + | UCGGUGGUGGACUAAACAGGG | 21 | 9719 |
| BCL11A-8025 | + | CUCGGUGGUGGACUAAACAGGG | 22 | 9720 |
| BCL11A-8026 | + | UCUCGGUGGUGGACUAAACAGGG | 23 | 9721 |
| BCL11A-8027 | + | GUCUCGGUGGUGGACUAAACAGGG | 24 | 9722 |
| BCL11A-8028 | + | GCGGAUUGCAGAGGAGGG | 18 | 9723 |
| BCL11A-8029 | + | GGCGGAUUGCAGAGGAGGG | 19 | 9724 |
| BCL11A-6133 | + | GGGCGGAUUGCAGAGGAGGG | 20 | 9725 |
| BCL11A-8030 | + | GGGGCGGAUUGCAGAGGAGGG | 21 | 9726 |
| BCL11A-8031 | + | AGGGGCGGAUUGCAGAGGAGGG | 22 | 9727 |
| BCL11A-8032 | + | GAGGGGCGGAUUGCAGAGGAGGG | 23 | 9728 |
| BCL11A-8033 | + | GGAGGGGCGGAUUGCAGAGGAGGG | 24 | 9729 |
| BCL11A-8034 | + | GACCGGGGCUGGGAGGG | 18 | 9730 |
| BCL11A-8035 | + | UGACCGGGGCUGGGAGGG | 19 | 9731 |
| BCL11A-6135 | + | UUGACCGGGGCUGGGAGGG | 20 | 9732 |
| BCL11A-8036 | + | CUUGACCGGGGCUGGGAGGG | 21 | 9733 |
| BCL11A-8037 | + | ACUUGACCGGGGCUGGGAGGG | 22 | 9734 |
| BCL11A-8038 | + | GACUUGACCGGGGCUGGGAGGG | 23 | 9735 |
| BCL11A-8039 | + | GGACUUGACCGGGGCUGGGAGGG | 24 | 9736 |
| BCL11A-8040 | + | AGUAACCUUUGCAUAGGG | 18 | 9737 |
| BCL11A-8041 | + | CAGUAACCUUUGCAUAGGG | 19 | 9738 |
| BCL11A-8042 | + | GCAGUAACCUUUGCAUAGGG | 20 | 9739 |
| BCL11A-8043 | + | UGCAGUAACCUUUGCAUAGGG | 21 | 9740 |
| BCL11A-8044 | + | UUGCAGUAACCUUUGCAUAGGG | 22 | 9741 |
| BCL11A-8045 | + | GUUGCAGUAACCUUUGCAUAGGG | 23 | 9742 |

TABLE 16E-continued

5th Tier

| gRNA Name | DNA Strand | Targeting Domain | Target Site Length | SEQ ID NO: |
|---|---|---|---|---|
| BCL11A-8046 | + | GGUUGCAGUAACCUUUGCAUAGGG | 24 | 9743 |
| BCL11A-8047 | + | GCCCUGCAUGACGUCGGG | 18 | 9744 |
| BCL11A-8048 | + | UGCCCUGCAUGACGUCGGG | 19 | 9745 |
| BCL11A-8049 | + | AUGCCCUGCAUGACGUCGGG | 20 | 9746 |
| BCL11A-8050 | + | CAUGCCCUGCAUGACGUCGGG | 21 | 9747 |
| BCL11A-8051 | + | CCAUGCCCUGCAUGACGUCGGG | 22 | 9748 |
| BCL11A-8052 | + | ACCAUGCCCUGCAUGACGUCGGG | 23 | 9749 |
| BCL11A-8053 | + | CACCAUGCCCUGCAUGACGUCGGG | 24 | 9750 |
| BCL11A-8054 | + | CUUGGACUUGACCGGGGG | 18 | 9751 |
| BCL11A-8055 | + | ACUUGGACUUGACCGGGGG | 19 | 9752 |
| BCL11A-8056 | + | GACUUGGACUUGACCGGGGG | 20 | 9753 |
| BCL11A-8057 | + | UGACUUGGACUUGACCGGGGG | 21 | 9754 |
| BCL11A-8058 | + | AUGACUUGGACUUGACCGGGGG | 22 | 9755 |
| BCL11A-8059 | + | CAUGACUUGGACUUGACCGGGGG | 23 | 9756 |
| BCL11A-8060 | + | GCAUGACUUGGACUUGACCGGGGG | 24 | 9757 |
| BCL11A-8061 | + | ACUUGACCGGGGGCUGGG | 18 | 9758 |
| BCL11A-8062 | + | GACUUGACCGGGGGCUGGG | 19 | 9759 |
| BCL11A-6146 | + | GGACUUGACCGGGGGCUGGG | 20 | 9760 |
| BCL11A-8063 | + | UGGACUUGACCGGGGGCUGGG | 21 | 9761 |
| BCL11A-8064 | + | UUGGACUUGACCGGGGGCUGGG | 22 | 9762 |
| BCL11A-8065 | + | CUUGGACUUGACCGGGGGCUGGG | 23 | 9763 |
| BCL11A-8066 | + | ACUUGGACUUGACCGGGGGCUGGG | 24 | 9764 |
| BCL11A-8067 | + | CAUGGAGAGGUGGCUGGG | 18 | 9765 |
| BCL11A-8068 | + | CCAUGGAGAGGUGGCUGGG | 19 | 9766 |
| BCL11A-8069 | + | CCCAUGGAGAGGUGGCUGGG | 20 | 9767 |
| BCL11A-8070 | + | UCCCAUGGAGAGGUGGCUGGG | 21 | 9768 |
| BCL11A-8071 | + | AUCCCAUGGAGAGGUGGCUGGG | 22 | 9769 |
| BCL11A-8072 | + | AAUCCCAUGGAGAGGUGGCUGGG | 23 | 9770 |
| BCL11A-8073 | + | GAAUCCCAUGGAGAGGUGGCUGGG | 24 | 9771 |
| BCL11A-8074 | + | AAACAGGGGGGAGUGGG | 18 | 9772 |
| BCL11A-8075 | + | UAAACAGGGGGGAGUGGG | 19 | 9773 |
| BCL11A-6147 | + | CUAAACAGGGGGGAGUGGG | 20 | 9774 |
| BCL11A-8076 | + | ACUAAACAGGGGGGAGUGGG | 21 | 9775 |
| BCL11A-8077 | + | GACUAAACAGGGGGGAGUGGG | 22 | 9776 |
| BCL11A-8078 | + | GGACUAAACAGGGGGGAGUGGG | 23 | 9777 |
| BCL11A-8079 | + | UGGACUAAACAGGGGGGAGUGGG | 24 | 9778 |
| BCL11A-8080 | + | UCCUAGAGAAAUCCAUGG | 18 | 9779 |
| BCL11A-8081 | + | CUCCUAGAGAAAUCCAUGG | 19 | 9780 |

TABLE 16E-continued

5th Tier

| gRNA Name | DNA Strand | Targeting Domain | Target Site Length | SEQ ID NO: |
|---|---|---|---|---|
| BCL11A-6149 | + | UCUCCUAGAGAAAUCCAUGG | 20 | 9781 |
| BCL11A-8082 | + | GUCUCCUAGAGAAAUCCAUGG | 21 | 9782 |
| BCL11A-8083 | + | AGUCUCCUAGAGAAAUCCAUGG | 22 | 9783 |
| BCL11A-8084 | + | AAGUCUCCUAGAGAAAUCCAUGG | 23 | 9784 |
| BCL11A-8085 | + | UAAGUCUCCUAGAGAAAUCCAUGG | 24 | 9785 |
| BCL11A-8086 | + | UUCUCGCCCAGGACCUGG | 18 | 9786 |
| BCL11A-8087 | + | CUUCUCGCCCAGGACCUGG | 19 | 9787 |
| BCL11A-6152 | + | GCUUCUCGCCCAGGACCUGG | 20 | 9788 |
| BCL11A-8088 | + | UGCUUCUCGCCCAGGACCUGG | 21 | 9789 |
| BCL11A-8089 | + | AUGCUUCUCGCCCAGGACCUGG | 22 | 9790 |
| BCL11A-8090 | + | UAUGCUUCUCGCCCAGGACCUGG | 23 | 9791 |
| BCL11A-8091 | + | UUAUGCUUCUCGCCCAGGACCUGG | 24 | 9792 |
| BCL11A-8092 | + | GGGCGGCUUGCUACCUGG | 18 | 9793 |
| BCL11A-8093 | + | AGGGCGGCUUGCUACCUGG | 19 | 9794 |
| BCL11A-8094 | + | AAGGGCGGCUUGCUACCUGG | 20 | 9795 |
| BCL11A-8095 | + | GAAGGGCGGCUUGCUACCUGG | 21 | 9796 |
| BCL11A-8096 | + | GGAAGGGCGGCUUGCUACCUGG | 22 | 9797 |
| BCL11A-8097 | + | AGGAAGGGCGGCUUGCUACCUGG | 23 | 9798 |
| BCL11A-8098 | + | CAGGAAGGGCGGCUUGCUACCUGG | 24 | 9799 |
| BCL11A-8099 | + | GACUUGACCGGGGCUGG | 18 | 9800 |
| BCL11A-8100 | + | GGACUUGACCGGGGCUGG | 19 | 9801 |
| BCL11A-8101 | + | UGGACUUGACCGGGGCUGG | 20 | 9802 |
| BCL11A-8102 | + | UUGGACUUGACCGGGGCUGG | 21 | 9803 |
| BCL11A-8103 | + | CUUGGACUUGACCGGGGCUGG | 22 | 9804 |
| BCL11A-8104 | + | ACUUGGACUUGACCGGGGCUGG | 23 | 9805 |
| BCL11A-8105 | + | GACUUGGACUUGACCGGGGCUGG | 24 | 9806 |
| BCL11A-8106 | + | UAAACAGGGGGGAGUGG | 18 | 9807 |
| BCL11A-8107 | + | CUAAACAGGGGGGAGUGG | 19 | 9808 |
| BCL11A-8108 | + | ACUAAACAGGGGGGAGUGG | 20 | 9809 |
| BCL11A-8109 | + | GACUAAACAGGGGGGAGUGG | 21 | 9810 |
| BCL11A-8110 | + | GGACUAAACAGGGGGGAGUGG | 22 | 9811 |
| BCL11A-8111 | + | UGGACUAAACAGGGGGGAGUGG | 23 | 9812 |
| BCL11A-8112 | + | GUGGACUAAACAGGGGGGAGUGG | 24 | 9813 |
| BCL11A-8113 | + | AAUCCCAUGGAGAGGUGG | 18 | 9814 |
| BCL11A-8114 | + | GAAUCCCAUGGAGAGGUGG | 19 | 9815 |
| BCL11A-8115 | + | UGAAUCCCAUGGAGAGGUGG | 20 | 9816 |
| BCL11A-8116 | + | AUGAAUCCCAUGGAGAGGUGG | 21 | 9817 |

TABLE 16E-continued

5th Tier

| gRNA Name | DNA Strand | Targeting Domain | Target Site Length | SEQ ID NO: |
|---|---|---|---|---|
| BCL11A-8117 | + | UAUGAAUCCCAUGGAGAGGUGG | 22 | 9818 |
| BCL11A-8118 | + | AUAUGAAUCCCAUGGAGAGGUGG | 23 | 9819 |
| BCL11A-8119 | + | AAUAUGAAUCCCAUGGAGAGGUGG | 24 | 9820 |
| BCL11A-8120 | + | UGCAAUAUGAAUCCCAUG | 18 | 9821 |
| BCL11A-8121 | + | CUGCAAUAUGAAUCCCAUG | 19 | 9822 |
| BCL11A-8122 | + | UCUGCAAUAUGAAUCCCAUG | 20 | 9823 |
| BCL11A-8123 | + | GUCUGCAAUAUGAAUCCCAUG | 21 | 9824 |
| BCL11A-8124 | + | UGUCUGCAAUAUGAAUCCCAUG | 22 | 9825 |
| BCL11A-8125 | + | UUGUCUGCAAUAUGAAUCCCAUG | 23 | 9826 |
| BCL11A-8126 | + | AUUGUCUGCAAUAUGAAUCCCAUG | 24 | 9827 |
| BCL11A-8127 | + | CUCCUAGAGAAAUCCAUG | 18 | 9828 |
| BCL11A-8128 | + | UCUCCUAGAGAAAUCCAUG | 19 | 9829 |
| BCL11A-8129 | + | GUCUCCUAGAGAAAUCCAUG | 20 | 9830 |
| BCL11A-8130 | + | AGUCUCCUAGAGAAAUCCAUG | 21 | 9831 |
| BCL11A-8131 | + | AAGUCUCCUAGAGAAAUCCAUG | 22 | 9832 |
| BCL11A-8132 | + | UAAGUCUCCUAGAGAAAUCCAUG | 23 | 9833 |
| BCL11A-8133 | + | CUAAGUCUCCUAGAGAAAUCCAUG | 24 | 9834 |
| BCL11A-8134 | + | UCGGACUUGACCGUCAUG | 18 | 9835 |
| BCL11A-8135 | + | GUCGGACUUGACCGUCAUG | 19 | 9836 |
| BCL11A-6164 | + | CGUCGGACUUGACCGUCAUG | 20 | 9837 |
| BCL11A-8136 | + | UCGUCGGACUUGACCGUCAUG | 21 | 9838 |
| BCL11A-8137 | + | GUCGUCGGACUUGACCGUCAUG | 22 | 9839 |
| BCL11A-8138 | + | CGUCGUCGGACUUGACCGUCAUG | 23 | 9840 |
| BCL11A-8139 | + | CCGUCGUCGGACUUGACCGUCAUG | 24 | 9841 |
| BCL11A-8140 | + | CUUCUCGCCCAGGACCUG | 18 | 9842 |
| BCL11A-8141 | + | GCUUCUCGCCCAGGACCUG | 19 | 9843 |
| BCL11A-8142 | + | UGCUUCUCGCCCAGGACCUG | 20 | 9844 |
| BCL11A-8143 | + | AUGCUUCUCGCCCAGGACCUG | 21 | 9845 |
| BCL11A-8144 | + | UAUGCUUCUCGCCCAGGACCUG | 22 | 9846 |
| BCL11A-8145 | + | UUAUGCUUCUCGCCCAGGACCUG | 23 | 9847 |
| BCL11A-8146 | + | CUUAUGCUUCUCGCCCAGGACCUG | 24 | 9848 |
| BCL11A-8147 | + | AUUCUGCACCUAGUCCUG | 18 | 9849 |
| BCL11A-8148 | + | CAUUCUGCACCUAGUCCUG | 19 | 9850 |
| BCL11A-8149 | + | ACAUUCUGCACCUAGUCCUG | 20 | 9851 |
| BCL11A-8150 | + | GACAUUCUGCACCUAGUCCUG | 21 | 9852 |
| BCL11A-8151 | + | GGACAUUCUGCACCUAGUCCUG | 22 | 9853 |
| BCL11A-8152 | + | AGGACAUUCUGCACCUAGUCCUG | 23 | 9854 |
| BCL11A-8153 | + | AAGGACAUUCUGCACCUAGUCCUG | 24 | 9855 |

TABLE 16E-continued

| | | 5th Tier | | |
|---|---|---|---|---|
| gRNA Name | DNA Strand | Targeting Domain | Target Site Length | SEQ ID NO: |
| BCL11A-6537 | + | GUUGUACAUGUGUAGCUG | 18 | 9856 |
| BCL11A-6538 | + | AGUUGUACAUGUGUAGCUG | 19 | 9857 |
| BCL11A-6539 | + | AAGUUGUACAUGUGUAGCUG | 20 | 9858 |
| BCL11A-6540 | + | CAAGUUGUACAUGUGUAGCUG | 21 | 9859 |
| BCL11A-6541 | + | GCAAGUUGUACAUGUGUAGCUG | 22 | 9860 |
| BCL11A-6542 | + | UGCAAGUUGUACAUGUGUAGCUG | 23 | 9861 |
| BCL11A-6543 | + | UUGCAAGUUGUACAUGUGUAGCUG | 24 | 9862 |
| BCL11A-8154 | + | GAGUACACGUUCUCCGUG | 18 | 9863 |
| BCL11A-8155 | + | CGAGUACACGUUCUCCGUG | 19 | 9864 |
| BCL11A-8156 | + | GCGAGUACACGUUCUCCGUG | 20 | 9865 |
| BCL11A-8157 | + | UGCGAGUACACGUUCUCCGUG | 21 | 9866 |
| BCL11A-8158 | + | CUGCGAGUACACGUUCUCCGUG | 22 | 9867 |
| BCL11A-8159 | + | ACUGCGAGUACACGUUCUCCGUG | 23 | 9868 |
| BCL11A-8160 | + | CACUGCGAGUACACGUUCUCCGUG | 24 | 9869 |
| BCL11A-8161 | + | CCAGCUCCCCGGGCGGUG | 18 | 9870 |
| BCL11A-8162 | + | UCCAGCUCCCCGGGCGGUG | 19 | 9871 |
| BCL11A-6177 | + | GUCCAGCUCCCCGGGCGGUG | 20 | 9872 |
| BCL11A-8163 | + | CGUCCAGCUCCCCGGGCGGUG | 21 | 9873 |
| BCL11A-8164 | + | CCGUCCAGCUCCCCGGGCGGUG | 22 | 9874 |
| BCL11A-8165 | + | UCCGUCCAGCUCCCCGGGCGGUG | 23 | 9875 |
| BCL11A-8166 | + | CUCCGUCCAGCUCCCCGGGCGGUG | 24 | 9876 |
| BCL11A-8167 | + | UCCGGGGAGCUGGCGGUG | 18 | 9877 |
| BCL11A-8168 | + | UUCCGGGGAGCUGGCGGUG | 19 | 9878 |
| BCL11A-8169 | + | GUUCCGGGGAGCUGGCGGUG | 20 | 9879 |
| BCL11A-8170 | + | GGUUCCGGGGAGCUGGCGGUG | 21 | 9880 |
| BCL11A-8171 | + | GGGUUCCGGGGAGCUGGCGGUG | 22 | 9881 |
| BCL11A-8172 | + | CGGGUUCCGGGGAGCUGGCGGUG | 23 | 9882 |
| BCL11A-8173 | + | CCGGGUUCCGGGGAGCUGGCGGUG | 24 | 9883 |
| BCL11A-8174 | + | CCAAGUGAUGUCUCGGUG | 18 | 9884 |
| BCL11A-8175 | + | UCCAAGUGAUGUCUCGGUG | 19 | 9885 |
| BCL11A-8176 | + | GUCCAAGUGAUGUCUCGGUG | 20 | 9886 |
| BCL11A-8177 | + | GGUCCAAGUGAUGUCUCGGUG | 21 | 9887 |
| BCL11A-8178 | + | GGGUCCAAGUGAUGUCUCGGUG | 22 | 9888 |
| BCL11A-8179 | + | GGGGUCCAAGUGAUGUCUCGGUG | 23 | 9889 |
| BCL11A-8180 | + | GGGGGUCCAAGUGAUGUCUCGGUG | 24 | 9890 |
| BCL11A-8181 | + | AGCUCCCCGGGCGGUGUG | 18 | 9891 |
| BCL11A-8182 | + | CAGCUCCCCGGGCGGUGUG | 19 | 9892 |

TABLE 16E-continued

5th Tier

| gRNA Name | DNA Strand | Targeting Domain | Target Site Length | SEQ ID NO: |
|---|---|---|---|---|
| BCL11A-8183 | + | CCAGCUCCCCGGGCGGUGUG | 20 | 9893 |
| BCL11A-8184 | + | UCCAGCUCCCCGGGCGGUGUG | 21 | 9894 |
| BCL11A-8185 | + | GUCCAGCUCCCCGGGCGGUGUG | 22 | 9895 |
| BCL11A-8186 | + | CGUCCAGCUCCCCGGGCGGUGUG | 23 | 9896 |
| BCL11A-8187 | + | CCGUCCAGCUCCCCGGGCGGUGUG | 24 | 9897 |
| BCL11A-8188 | + | GCCGAAUGGGGUGUGUG | 18 | 9898 |
| BCL11A-8189 | + | CGCCGAAUGGGGUGUGUG | 19 | 9899 |
| BCL11A-8190 | + | ACGCCGAAUGGGGUGUGUG | 20 | 9900 |
| BCL11A-8191 | + | UACGCCGAAUGGGGUGUGUG | 21 | 9901 |
| BCL11A-8192 | + | CUACGCCGAAUGGGGUGUGUG | 22 | 9902 |
| BCL11A-8193 | + | ACUACGCCGAAUGGGGUGUGUG | 23 | 9903 |
| BCL11A-8194 | + | UACUACGCCGAAUGGGGUGUGUG | 24 | 9904 |
| BCL11A-8195 | + | GGGAGGAGGGGCGGAUUG | 18 | 9905 |
| BCL11A-8196 | + | AGGGAGGAGGGGCGGAUUG | 19 | 9906 |
| BCL11A-8197 | + | GAGGGAGGAGGGGCGGAUUG | 20 | 9907 |
| BCL11A-8198 | + | GGAGGGAGGAGGGGCGGAUUG | 21 | 9908 |
| BCL11A-8199 | + | GGGAGGGAGGAGGGGCGGAUUG | 22 | 9909 |
| BCL11A-8200 | + | UGGGAGGGAGGAGGGGCGGAUUG | 23 | 9910 |
| BCL11A-8201 | + | CUGGGAGGGAGGAGGGGCGGAUUG | 24 | 9911 |
| BCL11A-8202 | + | UCGCACAGGUUGCACUUG | 18 | 9912 |
| BCL11A-8203 | + | GUCGCACAGGUUGCACUUG | 19 | 9913 |
| BCL11A-8204 | + | GGUCGCACAGGUUGCACUUG | 20 | 9914 |
| BCL11A-8205 | + | UGGUCGCACAGGUUGCACUUG | 21 | 9915 |
| BCL11A-8206 | + | GUGGUCGCACAGGUUGCACUUG | 22 | 9916 |
| BCL11A-8207 | + | CGUGGUCGCACAGGUUGCACUUG | 23 | 9917 |
| BCL11A-8208 | + | GCGUGGUCGCACAGGUUGCACUUG | 24 | 9918 |
| BCL11A-8209 | + | ACCAGGUUGCUCUGAAAU | 18 | 9919 |
| BCL11A-8210 | + | CACCAGGUUGCUCUGAAAU | 19 | 9920 |
| BCL11A-8211 | + | CCACCAGGUUGCUCUGAAAU | 20 | 9921 |
| BCL11A-8212 | + | ACCACCAGGUUGCUCUGAAAU | 21 | 9922 |
| BCL11A-8213 | + | CACCACCAGGUUGCUCUGAAAU | 22 | 9923 |
| BCL11A-8214 | + | GCACCACCAGGUUGCUCUGAAAU | 23 | 9924 |
| BCL11A-8215 | + | UGCACCACCAGGUUGCUCUGAAAU | 24 | 9925 |
| BCL11A-8216 | + | CGGGCCCGGACCACUAAU | 18 | 9926 |
| BCL11A-8217 | + | CCGGGCCCGGACCACUAAU | 19 | 9927 |
| BCL11A-8218 | + | CCCGGGCCCGGACCACUAAU | 20 | 9928 |
| BCL11A-8219 | + | GCCCGGGCCCGGACCACUAAU | 21 | 9929 |
| BCL11A-8220 | + | UGCCCGGGCCCGGACCACUAAU | 22 | 9930 |

TABLE 16E-continued

5th Tier

| gRNA Name | DNA Strand | Targeting Domain | Target Site Length | SEQ ID NO: |
|---|---|---|---|---|
| BCL11A-8221 | + | CUGCCCGGGCCCGGACCACUAAU | 23 | 9931 |
| BCL11A-8222 | + | CCUGCCCGGGCCCGGACCACUAAU | 24 | 9932 |
| BCL11A-8223 | + | GGGCUCUCGAGCUUCCAU | 18 | 9933 |
| BCL11A-8224 | + | AGGGCUCUCGAGCUUCCAU | 19 | 9934 |
| BCL11A-8225 | + | AAGGGCUCUCGAGCUUCCAU | 20 | 9935 |
| BCL11A-8226 | + | UAAGGGCUCUCGAGCUUCCAU | 21 | 9936 |
| BCL11A-8227 | + | UUAAGGGCUCUCGAGCUUCCAU | 22 | 9937 |
| BCL11A-8228 | + | CUUAAGGGCUCUCGAGCUUCCAU | 23 | 9938 |
| BCL11A-8229 | + | ACUUAAGGGCUCUCGAGCUUCCAU | 24 | 9939 |
| BCL11A-8230 | + | GUCGGACUUGACCGUCAU | 18 | 9940 |
| BCL11A-8231 | + | CGUCGGACUUGACCGUCAU | 19 | 9941 |
| BCL11A-6186 | + | UCGUCGGACUUGACCGUCAU | 20 | 9942 |
| BCL11A-8232 | + | GUCGUCGGACUUGACCGUCAU | 21 | 9943 |
| BCL11A-8233 | + | CGUCGUCGGACUUGACCGUCAU | 22 | 9944 |
| BCL11A-8234 | + | CCGUCGUCGGACUUGACCGUCAU | 23 | 9945 |
| BCL11A-8235 | + | ACCGUCGUCGGACUUGACCGUCAU | 24 | 9946 |
| BCL11A-8236 | + | AUAGGGCUGGGCCGGCCU | 18 | 9947 |
| BCL11A-8237 | + | CAUAGGGCUGGGCCGGCCU | 19 | 9948 |
| BCL11A-6198 | + | GCAUAGGGCUGGGCCGGCCU | 20 | 9949 |
| BCL11A-8238 | + | UGCAUAGGGCUGGGCCGGCCU | 21 | 9950 |
| BCL11A-8239 | + | UUGCAUAGGGCUGGGCCGGCCU | 22 | 9951 |
| BCL11A-8240 | + | UUUGCAUAGGGCUGGGCCGGCCU | 23 | 9952 |
| BCL11A-8241 | + | CUUUGCAUAGGGCUGGGCCGGCCU | 24 | 9953 |
| BCL11A-8242 | + | UCUGGAGUCUCCGAAGCU | 18 | 9954 |
| BCL11A-8243 | + | GUCUGGAGUCUCCGAAGCU | 19 | 9955 |
| BCL11A-8244 | + | UGUCUGGAGUCUCCGAAGCU | 20 | 9956 |
| BCL11A-8245 | + | UUGUCUGGAGUCUCCGAAGCU | 21 | 9957 |
| BCL11A-8246 | + | AUUGUCUGGAGUCUCCGAAGCU | 22 | 9958 |
| BCL11A-8247 | + | GAUUGUCUGGAGUCUCCGAAGCU | 23 | 9959 |
| BCL11A-8248 | + | CGAUUGUCUGGAGUCUCCGAAGCU | 24 | 9960 |
| BCL11A-8249 | + | UCUCGAGCUUGAUGCGCU | 18 | 9961 |
| BCL11A-8250 | + | UUCUCGAGCUUGAUGCGCU | 19 | 9962 |
| BCL11A-8251 | + | CUUCUCGAGCUUGAUGCGCU | 20 | 9963 |
| BCL11A-8252 | + | CCUUCUCGAGCUUGAUGCGCU | 21 | 9964 |
| BCL11A-8253 | + | UCCUUCUCGAGCUUGAUGCGCU | 22 | 9965 |
| BCL11A-8254 | + | CUCCUUCUCGAGCUUGAUGCGCU | 23 | 9966 |
| BCL11A-8255 | + | ACUCCUUCUCGAGCUUGAUGCGCU | 24 | 9967 |

TABLE 16E-continued

5th Tier

| gRNA Name | DNA Strand | Targeting Domain | Target Site Length | SEQ ID NO: |
|---|---|---|---|---|
| BCL11A-8256 | + | UGGACUUGACCGGGGCU | 18 | 9968 |
| BCL11A-8257 | + | UUGGACUUGACCGGGGCU | 19 | 9969 |
| BCL11A-6207 | + | CUUGGACUUGACCGGGGCU | 20 | 9970 |
| BCL11A-8258 | + | ACUUGGACUUGACCGGGGCU | 21 | 9971 |
| BCL11A-8259 | + | GACUUGGACUUGACCGGGGCU | 22 | 9972 |
| BCL11A-8260 | + | UGACUUGGACUUGACCGGGGCU | 23 | 9973 |
| BCL11A-8261 | + | AUGACUUGGACUUGACCGGGGCU | 24 | 9974 |
| BCL11A-8262 | + | UCCCAUGGAGAGGUGGCU | 18 | 9975 |
| BCL11A-8263 | + | AUCCCAUGGAGAGGUGGCU | 19 | 9976 |
| BCL11A-6208 | + | AAUCCCAUGGAGAGGUGGCU | 20 | 9977 |
| BCL11A-8264 | + | GAAUCCCAUGGAGAGGUGGCU | 21 | 9978 |
| BCL11A-8265 | + | UGAAUCCCAUGGAGAGGUGGCU | 22 | 9979 |
| BCL11A-8266 | + | AUGAAUCCCAUGGAGAGGUGGCU | 23 | 9980 |
| BCL11A-8267 | + | UAUGAAUCCCAUGGAGAGGUGGCU | 24 | 9981 |
| BCL11A-8268 | + | GUGCACCACCAGGUUGCU | 18 | 9982 |
| BCL11A-8269 | + | GGUGCACCACCAGGUUGCU | 19 | 9983 |
| BCL11A-8270 | + | CGGUGCACCACCAGGUUGCU | 20 | 9984 |
| BCL11A-8271 | + | CCGGUGCACCACCAGGUUGCU | 21 | 9985 |
| BCL11A-8272 | + | GCCGGUGCACCACCAGGUUGCU | 22 | 9986 |
| BCL11A-8273 | + | CGCCGGUGCACCACCAGGUUGCU | 23 | 9987 |
| BCL11A-8274 | + | GCGCCGGUGCACCACCAGGUUGCU | 24 | 9988 |
| BCL11A-8275 | + | AAGCUAAGGAAGGGAUCU | 18 | 9989 |
| BCL11A-8276 | + | GAAGCUAAGGAAGGGAUCU | 19 | 9990 |
| BCL11A-8277 | + | CGAAGCUAAGGAAGGGAUCU | 20 | 9991 |
| BCL11A-8278 | + | CCGAAGCUAAGGAAGGGAUCU | 21 | 9992 |
| BCL11A-8279 | + | UCCGAAGCUAAGGAAGGGAUCU | 22 | 9993 |
| BCL11A-8280 | + | CUCCGAAGCUAAGGAAGGGAUCU | 23 | 9994 |
| BCL11A-8281 | + | UCUCCGAAGCUAAGGAAGGGAUCU | 24 | 9995 |
| BCL11A-8282 | + | GGCGAUUGUCUGGAGUCU | 18 | 9996 |
| BCL11A-8283 | + | AGGCGAUUGUCUGGAGUCU | 19 | 9997 |
| BCL11A-8284 | + | AAGGCGAUUGUCUGGAGUCU | 20 | 9998 |
| BCL11A-8285 | + | AAAGGCGAUUGUCUGGAGUCU | 21 | 9999 |
| BCL11A-8286 | + | AAAAGGCGAUUGUCUGGAGUCU | 22 | 10000 |
| BCL11A-8287 | + | CAAAAGGCGAUUGUCUGGAGUCU | 23 | 10001 |
| BCL11A-8288 | + | GCAAAAGGCGAUUGUCUGGAGUCU | 24 | 10002 |
| BCL11A-8289 | + | CCUCCUCGUCCCCGUUCU | 18 | 10003 |
| BCL11A-8290 | + | UCCUCCUCGUCCCCGUUCU | 19 | 10004 |
| BCL11A-8291 | + | UUCCUCCUCGUCCCCGUUCU | 20 | 10005 |

TABLE 16E-continued

5th Tier

| gRNA Name | DNA Strand | Targeting Domain | Target Site Length | SEQ ID NO: |
|---|---|---|---|---|
| BCL11A-8292 | + | CUUCCUCCUCGUCCCCGUUCU | 21 | 10006 |
| BCL11A-8293 | + | UCUUCCUCCUCGUCCCCGUUCU | 22 | 10007 |
| BCL11A-8294 | + | CUCUUCCUCCUCGUCCCCGUUCU | 23 | 10008 |
| BCL11A-8295 | + | CCUCUUCCUCCUCGUCCCCGUUCU | 24 | 10009 |
| BCL11A-8296 | + | AGCGCAAACUCCCGUUCU | 18 | 10010 |
| BCL11A-8297 | + | AAGCGCAAACUCCCGUUCU | 19 | 10011 |
| BCL11A-8298 | + | GAAGCGCAAACUCCCGUUCU | 20 | 10012 |
| BCL11A-8299 | + | AGAAGCGCAAACUCCCGUUCU | 21 | 10013 |
| BCL11A-8300 | + | GAGAAGCGCAAACUCCCGUUCU | 22 | 10014 |
| BCL11A-8301 | + | GGAGAAGCGCAAACUCCCGUUCU | 23 | 10015 |
| BCL11A-8302 | + | UGGAGAAGCGCAAACUCCCGUUCU | 24 | 10016 |
| BCL11A-8303 | + | GGGGGCUUCAAAUUUUCU | 18 | 10017 |
| BCL11A-8304 | + | UGGGGGCUUCAAAUUUUCU | 19 | 10018 |
| BCL11A-8305 | + | CUGGGGGCUUCAAAUUUUCU | 20 | 10019 |
| BCL11A-8306 | + | CCUGGGGGCUUCAAAUUUUCU | 21 | 10020 |
| BCL11A-8307 | + | CCCUGGGGGCUUCAAAUUUUCU | 22 | 10021 |
| BCL11A-8308 | + | CCCCUGGGGGCUUCAAAUUUUCU | 23 | 10022 |
| BCL11A-8309 | + | ACCCCUGGGGGCUUCAAAUUUUCU | 24 | 10023 |
| BCL11A-8310 | + | AAGAACCUAGAAAGAGGU | 18 | 10024 |
| BCL11A-8311 | + | GAAGAACCUAGAAAGAGGU | 19 | 10025 |
| BCL11A-6224 | + | UGAAGAACCUAGAAAGAGGU | 20 | 10026 |
| BCL11A-8312 | + | GUGAAGAACCUAGAAAGAGGU | 21 | 10027 |
| BCL11A-8313 | + | UGUGAAGAACCUAGAAAGAGGU | 22 | 10028 |
| BCL11A-8314 | + | GUGUGAAGAACCUAGAAAGAGGU | 23 | 10029 |
| BCL11A-8315 | + | UGUGUGAAGAACCUAGAAAGAGGU | 24 | 10030 |
| BCL11A-8316 | + | UCCAGCUCCCCGGGCGGU | 18 | 10031 |
| BCL11A-8317 | + | GUCCAGCUCCCCGGGCGGU | 19 | 10032 |
| BCL11A-8318 | + | CGUCCAGCUCCCCGGGCGGU | 20 | 10033 |
| BCL11A-8319 | + | CCGUCCAGCUCCCCGGGCGGU | 21 | 10034 |
| BCL11A-8320 | + | UCCGUCCAGCUCCCCGGGCGGU | 22 | 10035 |
| BCL11A-8321 | + | CUCCGUCCAGCUCCCCGGGCGGU | 23 | 10036 |
| BCL11A-8322 | + | CCUCCGUCCAGCUCCCCGGGCGGU | 24 | 10037 |
| BCL11A-8323 | + | GAUACCAACCCGCGGGGU | 18 | 10038 |
| BCL11A-8324 | + | GGAUACCAACCCGCGGGGU | 19 | 10039 |
| BCL11A-8325 | + | GGGAUACCAACCCGCGGGGU | 20 | 10040 |
| BCL11A-8326 | + | AGGGAUACCAACCCGCGGGGU | 21 | 10041 |
| BCL11A-8327 | + | AAGGGAUACCAACCCGCGGGGU | 22 | 10042 |

TABLE 16E-continued

5th Tier

| gRNA Name | DNA Strand | Targeting Domain | Target Site Length | SEQ ID NO: |
|---|---|---|---|---|
| BCL11A-8328 | + | GAAGGGAUACCAACCCGCGGGGU | 23 | 10043 |
| BCL11A-8329 | + | UGAAGGGAUACCAACCCGCGGGGU | 24 | 10044 |
| BCL11A-8330 | + | UACGCCGAAUGGGGGUGU | 18 | 10045 |
| BCL11A-8331 | + | CUACGCCGAAUGGGGGUGU | 19 | 10046 |
| BCL11A-8332 | + | ACUACGCCGAAUGGGGGUGU | 20 | 10047 |
| BCL11A-8333 | + | UACUACGCCGAAUGGGGGUGU | 21 | 10048 |
| BCL11A-8334 | + | GUACUACGCCGAAUGGGGGUGU | 22 | 10049 |
| BCL11A-8335 | + | GGUACUACGCCGAAUGGGGGUGU | 23 | 10050 |
| BCL11A-8336 | + | GGGUACUACGCCGAAUGGGGGUGU | 24 | 10051 |
| BCL11A-8337 | + | GAGGCAAAAGGCGAUUGU | 18 | 10052 |
| BCL11A-8338 | + | GGAGGCAAAAGGCGAUUGU | 19 | 10053 |
| BCL11A-8339 | + | AGGAGGCAAAAGGCGAUUGU | 20 | 10054 |
| BCL11A-8340 | + | GAGGAGGCAAAAGGCGAUUGU | 21 | 10055 |
| BCL11A-8341 | + | CGAGGAGGCAAAAGGCGAUUGU | 22 | 10056 |
| BCL11A-8342 | + | ACGAGGAGGCAAAAGGCGAUUGU | 23 | 10057 |
| BCL11A-8343 | + | GACGAGGAGGCAAAAGGCGAUUGU | 24 | 10058 |
| BCL11A-8344 | + | CAAAUUUCUCAGAACUU | 18 | 10059 |
| BCL11A-8345 | + | UCAAAUUUCUCAGAACUU | 19 | 10060 |
| BCL11A-8346 | + | UUCAAAUUUCUCAGAACUU | 20 | 10061 |
| BCL11A-8347 | + | CUUCAAAUUUCUCAGAACUU | 21 | 10062 |
| BCL11A-8348 | + | GCUUCAAAUUUCUCAGAACUU | 22 | 10063 |
| BCL11A-8349 | + | GGCUUCAAAUUUCUCAGAACUU | 23 | 10064 |
| BCL11A-8350 | + | GGGCUUCAAAUUUCUCAGAACUU | 24 | 10065 |
| BCL11A-8351 | + | CGCUGCGUCUGCCCUCUU | 18 | 10066 |
| BCL11A-8352 | + | UCGCUGCGUCUGCCCUCUU | 19 | 10067 |
| BCL11A-8353 | + | GUCGCUGCGUCUGCCCUCUU | 20 | 10068 |
| BCL11A-8354 | + | UGUCGCUGCGUCUGCCCUCUU | 21 | 10069 |
| BCL11A-8355 | + | GUGUCGCUGCGUCUGCCCUCUU | 22 | 10070 |
| BCL11A-8356 | + | AGUGUCGCUGCGUCUGCCCUCUU | 23 | 10071 |
| BCL11A-8357 | + | AAGUGUCGCUGCGUCUGCCCUCUU | 24 | 10072 |
| BCL11A-8358 | + | AGUCGCUGGUGCCGGGUU | 18 | 10073 |
| BCL11A-8359 | + | AAGUCGCUGGUGCCGGGUU | 19 | 10074 |
| BCL11A-8360 | + | CAAGUCGCUGGUGCCGGGUU | 20 | 10075 |
| BCL11A-8361 | + | CCAAGUCGCUGGUGCCGGGUU | 21 | 10076 |
| BCL11A-8362 | + | ACCAAGUCGCUGGUGCCGGGUU | 22 | 10077 |
| BCL11A-8363 | + | CACCAAGUCGCUGGUGCCGGGUU | 23 | 10078 |
| BCL11A-8364 | + | CCACCAAGUCGCUGGUGCCGGGUU | 24 | 10079 |
| BCL11A-8365 | + | CUGCCCAGCAGCAGCUUU | 18 | 10080 |

TABLE 16E-continued

5th Tier

| gRNA Name | DNA Strand | Targeting Domain | Target Site Length | SEQ ID NO: |
|---|---|---|---|---|
| BCL11A-8366 | + | GCUGCCCAGCAGCAGCUUU | 19 | 10081 |
| BCL11A-8367 | + | GGCUGCCCAGCAGCAGCUUU | 20 | 10082 |
| BCL11A-8368 | + | GGGCUGCCCAGCAGCAGCUUU | 21 | 10083 |
| BCL11A-8369 | + | GGGGCUGCCCAGCAGCAGCUUU | 22 | 10084 |
| BCL11A-8370 | + | UGGGGCUGCCCAGCAGCAGCUUU | 23 | 10085 |
| BCL11A-8371 | + | CUGGGGCUGCCCAGCAGCAGCUUU | 24 | 10086 |
| BCL11A-8372 | − | GGCAGGCCCAGCUCAAAA | 18 | 10087 |
| BCL11A-8373 | − | GGGCAGGCCCAGCUCAAAA | 19 | 10088 |
| BCL11A-8374 | − | CGGGCAGGCCCAGCUCAAAA | 20 | 10089 |
| BCL11A-8375 | − | CCGGGCAGGCCCAGCUCAAAA | 21 | 10090 |
| BCL11A-8376 | − | CCCGGGCAGGCCCAGCUCAAAA | 22 | 10091 |
| BCL11A-8377 | − | GCCCGGGCAGGCCCAGCUCAAAA | 23 | 10092 |
| BCL11A-8378 | − | GGCCCGGGCAGGCCCAGCUCAAAA | 24 | 10093 |
| BCL11A-8379 | − | UAAGAAUCUACUUAGAAA | 18 | 10094 |
| BCL11A-8380 | − | UUAAGAAUCUACUUAGAAA | 19 | 10095 |
| BCL11A-8381 | − | AUUAAGAAUCUACUUAGAAA | 20 | 10096 |
| BCL11A-8382 | − | GAUUAAGAAUCUACUUAGAAA | 21 | 10097 |
| BCL11A-8383 | − | GGAUUAAGAAUCUACUUAGAAA | 22 | 10098 |
| BCL11A-8384 | − | UGGAUUAAGAAUCUACUUAGAAA | 23 | 10099 |
| BCL11A-8385 | − | AUGGAUUAAGAAUCUACUUAGAAA | 24 | 10100 |
| BCL11A-8386 | − | CGGGCAGGCCCAGCUCAA | 18 | 10101 |
| BCL11A-8387 | − | CCGGGCAGGCCCAGCUCAA | 19 | 10102 |
| BCL11A-8388 | − | CCCGGGCAGGCCCAGCUCAA | 20 | 10103 |
| BCL11A-8389 | − | GCCCGGGCAGGCCCAGCUCAA | 21 | 10104 |
| BCL11A-8390 | − | GGCCCGGGCAGGCCCAGCUCAA | 22 | 10105 |
| BCL11A-8391 | − | GGGCCCGGGCAGGCCCAGCUCAA | 23 | 10106 |
| BCL11A-8392 | − | CGGGCCCGGGCAGGCCCAGCUCAA | 24 | 10107 |
| BCL11A-8393 | − | GACGAGGAAGAGGAAGAA | 18 | 10108 |
| BCL11A-8394 | − | CGACGAGGAAGAGGAAGAA | 19 | 10109 |
| BCL11A-3947 | − | ACGACGAGGAAGAGGAAGAA | 20 | 10110 |
| BCL11A-8395 | − | GACGACGAGGAAGAGGAAGAA | 21 | 10111 |
| BCL11A-8396 | − | GGACGACGAGGAAGAGGAAGAA | 22 | 10112 |
| BCL11A-8397 | − | AGGACGACGAGGAAGAGGAAGAA | 23 | 10113 |
| BCL11A-8398 | − | GAGGACGACGAGGAAGAGGAAGAA | 24 | 10114 |
| BCL11A-8399 | − | CAACCUGAUCCCGGAGAA | 18 | 10115 |
| BCL11A-8400 | − | CCAACCUGAUCCCGGAGAA | 19 | 10116 |
| BCL11A-5881 | − | CCCAACCUGAUCCCGGAGAA | 20 | 10117 |

TABLE 16E-continued

5th Tier

| gRNA Name | DNA Strand | Targeting Domain | Target Site Length | SEQ ID NO: |
|---|---|---|---|---|
| BCL11A-8401 | − | CCCCAACCUGAUCCCGGAGAA | 21 | 10118 |
| BCL11A-8402 | − | ACCCCAACCUGAUCCCGGAGAA | 22 | 10119 |
| BCL11A-8403 | − | GACCCCAACCUGAUCCCGGAGAA | 23 | 10120 |
| BCL11A-8404 | − | CGACCCCAACCUGAUCCCGGAGAA | 24 | 10121 |
| BCL11A-8405 | − | GGAGCACUCCUCGGAGAA | 18 | 10122 |
| BCL11A-8406 | − | CGGAGCACUCCUCGGAGAA | 19 | 10123 |
| BCL11A-5882 | − | UCGGAGCACUCCUCGGAGAA | 20 | 10124 |
| BCL11A-8407 | − | GUCGGAGCACUCCUCGGAGAA | 21 | 10125 |
| BCL11A-8408 | − | CGUCGGAGCACUCCUCGGAGAA | 22 | 10126 |
| BCL11A-8409 | − | UCGUCGGAGCACUCCUCGGAGAA | 23 | 10127 |
| BCL11A-8410 | − | CUCGUCGGAGCACUCCUCGGAGAA | 24 | 10128 |
| BCL11A-8411 | − | GAGGAGGACGACGAGGAA | 18 | 10129 |
| BCL11A-8412 | − | AGAGGAGGACGACGAGGAA | 19 | 10130 |
| BCL11A-3950 | − | AAGAGGAGGACGACGAGGAA | 20 | 10131 |
| BCL11A-8413 | − | GAAGAGGAGGACGACGAGGAA | 21 | 10132 |
| BCL11A-8414 | − | GGAAGAGGAGGACGACGAGGAA | 22 | 10133 |
| BCL11A-8415 | − | AGGAAGAGGAGGACGACGAGGAA | 23 | 10134 |
| BCL11A-8416 | − | GAGGAAGAGGAGGACGACGAGGAA | 24 | 10135 |
| BCL11A-8417 | − | GAGGAAGAAGAGGAGGAA | 18 | 10136 |
| BCL11A-8418 | − | AGAGGAAGAAGAGGAGGAA | 19 | 10137 |
| BCL11A-3962 | − | AAGAGGAAGAAGAGGAGGAA | 20 | 10138 |
| BCL11A-8419 | − | GAAGAGGAAGAAGAGGAGGAA | 21 | 10139 |
| BCL11A-8420 | − | GGAAGAGGAAGAAGAGGAGGAA | 22 | 10140 |
| BCL11A-8421 | − | AGGAAGAGGAAGAAGAGGAGGAA | 23 | 10141 |
| BCL11A-8422 | − | GAGGAAGAGGAAGAAGAGGAGGAA | 24 | 10142 |
| BCL11A-8423 | − | AACGGGGACGAGGAGGAA | 18 | 10143 |
| BCL11A-8424 | − | GAACGGGGACGAGGAGGAA | 19 | 10144 |
| BCL11A-3934 | − | AGAACGGGGACGAGGAGGAA | 20 | 10145 |
| BCL11A-8425 | − | GAGAACGGGGACGAGGAGGAA | 21 | 10146 |
| BCL11A-8426 | − | GGAGAACGGGGACGAGGAGGAA | 22 | 10147 |
| BCL11A-8427 | − | CGGAGAACGGGGACGAGGAGGAA | 23 | 10148 |
| BCL11A-8428 | − | CCGGAGAACGGGGACGAGGAGGAA | 24 | 10149 |
| BCL11A-8429 | − | GGCGCAGCGGCACGGGAA | 18 | 10150 |
| BCL11A-8430 | − | GGGCGCAGCGGCACGGGAA | 19 | 10151 |
| BCL11A-3857 | − | GGGGCGCAGCGGCACGGGAA | 20 | 10152 |
| BCL11A-8431 | − | CGGGGCGCAGCGGCACGGGAA | 21 | 10153 |
| BCL11A-8432 | − | UCGGGGCGCAGCGGCACGGGAA | 22 | 10154 |
| BCL11A-8433 | − | CUCGGGGCGCAGCGGCACGGGAA | 23 | 10155 |

TABLE 16E-continued

5th Tier

| gRNA Name | DNA Strand | Targeting Domain | Target Site Length | SEQ ID NO: |
|---|---|---|---|---|
| BCL11A-8434 | - | UCUCGGGGCGCAGCGGCACGGGAA | 24 | 10156 |
| BCL11A-8435 | - | CGGCCGCGAUGCCCAACA | 18 | 10157 |
| BCL11A-8436 | - | CCGGCCGCGAUGCCCAACA | 19 | 10158 |
| BCL11A-5893 | - | CCCGGCCGCGAUGCCCAACA | 20 | 10159 |
| BCL11A-8437 | - | CCCCGGCCGCGAUGCCCAACA | 21 | 10160 |
| BCL11A-8438 | - | CCCCCGGCCGCGAUGCCCAACA | 22 | 10161 |
| BCL11A-8439 | - | GCCCCCGGCCGCGAUGCCCAACA | 23 | 10162 |
| BCL11A-8440 | - | UGCCCCCGGCCGCGAUGCCCAACA | 24 | 10163 |
| BCL11A-8441 | - | CUACUUAGAAAGCGAACA | 18 | 10164 |
| BCL11A-8442 | - | UCUACUUAGAAAGCGAACA | 19 | 10165 |
| BCL11A-5894 | - | AUCUACUUAGAAAGCGAACA | 20 | 10166 |
| BCL11A-8443 | - | AAUCUACUUAGAAAGCGAACA | 21 | 10167 |
| BCL11A-8444 | - | GAAUCUACUUAGAAAGCGAACA | 22 | 10168 |
| BCL11A-8445 | - | AGAAUCUACUUAGAAAGCGAACA | 23 | 10169 |
| BCL11A-8446 | - | AAGAAUCUACUUAGAAAGCGAACA | 24 | 10170 |
| BCL11A-8447 | - | CCCCUGUUUAGUCCACCA | 18 | 10171 |
| BCL11A-8448 | - | CCCCCUGUUUAGUCCACCA | 19 | 10172 |
| BCL11A-8449 | - | CCCCCCUGUUUAGUCCACCA | 20 | 10173 |
| BCL11A-8450 | - | CCCCCCCUGUUUAGUCCACCA | 21 | 10174 |
| BCL11A-8451 | - | UCCCCCCCUGUUUAGUCCACCA | 22 | 10175 |
| BCL11A-8452 | - | CUCCCCCCCUGUUUAGUCCACCA | 23 | 10176 |
| BCL11A-8453 | - | ACUCCCCCCCUGUUUAGUCCACCA | 24 | 10177 |
| BCL11A-8454 | - | CAUUCGGCGUAGUACCCA | 18 | 10178 |
| BCL11A-8455 | - | CCAUUCGGCGUAGUACCCA | 19 | 10179 |
| BCL11A-8456 | - | CCCAUUCGGCGUAGUACCCA | 20 | 10180 |
| BCL11A-8457 | - | CCCCAUUCGGCGUAGUACCCA | 21 | 10181 |
| BCL11A-8458 | - | CCCCCAUUCGGCGUAGUACCCA | 22 | 10182 |
| BCL11A-8459 | - | ACCCCCAUUCGGCGUAGUACCCA | 23 | 10183 |
| BCL11A-8460 | - | CACCCCCAUUCGGCGUAGUACCCA | 24 | 10184 |
| BCL11A-8461 | - | GGCCGAGGCCGAGGGCCA | 18 | 10185 |
| BCL11A-8462 | - | UGGCCGAGGCCGAGGGCCA | 19 | 10186 |
| BCL11A-8463 | - | CUGGCCGAGGCCGAGGGCCA | 20 | 10187 |
| BCL11A-8464 | - | CCUGGCCGAGGCCGAGGGCCA | 21 | 10188 |
| BCL11A-8465 | - | ACCUGGCCGAGGCCGAGGGCCA | 22 | 10189 |
| BCL11A-8466 | - | CACCUGGCCGAGGCCGAGGGCCA | 23 | 10190 |
| BCL11A-8467 | - | CCACCUGGCCGAGGCCGAGGGCCA | 24 | 10191 |
| BCL11A-8468 | - | UUUCUCUUGCAACACGCA | 18 | 10192 |

TABLE 16E-continued

5th Tier

| gRNA Name | DNA Strand | Targeting Domain | Target Site Length | SEQ ID NO: |
|---|---|---|---|---|
| BCL11A-8469 | − | GUUUCUCUUGCAACACGCA | 19 | 10193 |
| BCL11A-8470 | − | GGUUUCUCUUGCAACACGCA | 20 | 10194 |
| BCL11A-8471 | − | UGGUUUCUCUUGCAACACGCA | 21 | 10195 |
| BCL11A-8472 | − | AUGGUUUCUCUUGCAACACGCA | 22 | 10196 |
| BCL11A-8473 | − | CAUGGUUUCUCUUGCAACACGCA | 23 | 10197 |
| BCL11A-8474 | − | GCAUGGUUUCUCUUGCAACACGCA | 24 | 10198 |
| BCL11A-8475 | − | ACUUGGACCCCCACCGCA | 18 | 10199 |
| BCL11A-8476 | − | CACUUGGACCCCCACCGCA | 19 | 10200 |
| BCL11A-8477 | − | UCACUUGGACCCCCACCGCA | 20 | 10201 |
| BCL11A-8478 | − | AUCACUUGGACCCCCACCGCA | 21 | 10202 |
| BCL11A-8479 | − | CAUCACUUGGACCCCCACCGCA | 22 | 10203 |
| BCL11A-8480 | − | ACAUCACUUGGACCCCCACCGCA | 23 | 10204 |
| BCL11A-8481 | − | GACAUCACUUGGACCCCCACCGCA | 24 | 10205 |
| BCL11A-8482 | − | UCUCGGGGCGCAGCGGCA | 18 | 10206 |
| BCL11A-8483 | − | AUCUCGGGGCGCAGCGGCA | 19 | 10207 |
| BCL11A-5904 | − | GAUCUCGGGGCGCAGCGGCA | 20 | 10208 |
| BCL11A-8484 | − | GGAUCUCGGGGCGCAGCGGCA | 21 | 10209 |
| BCL11A-8485 | − | GGGAUCUCGGGGCGCAGCGGCA | 22 | 10210 |
| BCL11A-8486 | − | AGGGAUCUCGGGGCGCAGCGGCA | 23 | 10211 |
| BCL11A-8487 | − | GAGGGAUCUCGGGGCGCAGCGGCA | 24 | 10212 |
| BCL11A-8488 | − | AGACUUAGAGAGCUGGCA | 18 | 10213 |
| BCL11A-8489 | − | GAGACUUAGAGAGCUGGCA | 19 | 10214 |
| BCL11A-5907 | − | GGAGACUUAGAGAGCUGGCA | 20 | 10215 |
| BCL11A-8490 | − | AGGAGACUUAGAGAGCUGGCA | 21 | 10216 |
| BCL11A-8491 | − | UAGGAGACUUAGAGAGCUGGCA | 22 | 10217 |
| BCL11A-8492 | − | CUAGGAGACUUAGAGAGCUGGCA | 23 | 10218 |
| BCL11A-8493 | − | UCUAGGAGACUUAGAGAGCUGGCA | 24 | 10219 |
| BCL11A-8494 | − | GCUCCAUGCAGCACUUCA | 18 | 10220 |
| BCL11A-8495 | − | AGCUCCAUGCAGCACUUCA | 19 | 10221 |
| BCL11A-8496 | − | CAGCUCCAUGCAGCACUUCA | 20 | 10222 |
| BCL11A-8497 | − | UCAGCUCCAUGCAGCACUUCA | 21 | 10223 |
| BCL11A-8498 | − | CUCAGCUCCAUGCAGCACUUCA | 22 | 10224 |
| BCL11A-8499 | − | GCUCAGCUCCAUGCAGCACUUCA | 23 | 10225 |
| BCL11A-8500 | − | UGCUCAGCUCCAUGCAGCACUUCA | 24 | 10226 |
| BCL11A-8501 | − | UGGUGGCCAAGUUCAAGA | 18 | 10227 |
| BCL11A-8502 | − | GUGGUGGCCAAGUUCAAGA | 19 | 10228 |
| BCL11A-8503 | − | CGUGGUGGCCAAGUUCAAGA | 20 | 10229 |
| BCL11A-8504 | − | CCGUGGUGGCCAAGUUCAAGA | 21 | 10230 |

TABLE 16E-continued

5th Tier

| gRNA Name | DNA Strand | Targeting Domain | Target Site Length | SEQ ID NO: |
|---|---|---|---|---|
| BCL11A-8505 | - | UCCGUGGUGGCCAAGUUCAAGA | 22 | 10231 |
| BCL11A-8506 | - | GUCCGUGGUGGCCAAGUUCAAGA | 23 | 10232 |
| BCL11A-8507 | - | AGUCCGUGGUGGCCAAGUUCAAGA | 24 | 10233 |
| BCL11A-8508 | - | AGGAGGAGCUGACGGAGA | 18 | 10234 |
| BCL11A-8509 | - | GAGGAGGAGCUGACGGAGA | 19 | 10235 |
| BCL11A-8510 | - | GGAGGAGGAGCUGACGGAGA | 20 | 10236 |
| BCL11A-8511 | - | AGGAGGAGGAGCUGACGGAGA | 21 | 10237 |
| BCL11A-8512 | - | GAGGAGGAGGAGCUGACGGAGA | 22 | 10238 |
| BCL11A-8513 | - | GGAGGAGGAGGAGCUGACGGAGA | 23 | 10239 |
| BCL11A-8514 | - | AGGAGGAGGAGGAGCUGACGGAGA | 24 | 10240 |
| BCL11A-8515 | - | CCAACCUGAUCCCGGAGA | 18 | 10241 |
| BCL11A-8516 | - | CCCAACCUGAUCCCGGAGA | 19 | 10242 |
| BCL11A-8517 | - | CCCCAACCUGAUCCCGGAGA | 20 | 10243 |
| BCL11A-8518 | - | ACCCCAACCUGAUCCCGGAGA | 21 | 10244 |
| BCL11A-8519 | - | GACCCCAACCUGAUCCCGGAGA | 22 | 10245 |
| BCL11A-8520 | - | CGACCCCAACCUGAUCCCGGAGA | 23 | 10246 |
| BCL11A-8521 | - | ACGACCCCAACCUGAUCCCGGAGA | 24 | 10247 |
| BCL11A-8522 | - | CGGAGCACUCCUCGGAGA | 18 | 10248 |
| BCL11A-8523 | - | UCGGAGCACUCCUCGGAGA | 19 | 10249 |
| BCL11A-8524 | - | GUCGGAGCACUCCUCGGAGA | 20 | 10250 |
| BCL11A-8525 | - | CGUCGGAGCACUCCUCGGAGA | 21 | 10251 |
| BCL11A-8526 | - | UCGUCGGAGCACUCCUCGGAGA | 22 | 10252 |
| BCL11A-8527 | - | CUCGUCGGAGCACUCCUCGGAGA | 23 | 10253 |
| BCL11A-8528 | - | CCUCGUCGGAGCACUCCUCGGAGA | 24 | 10254 |
| BCL11A-8529 | - | UACCAGGAUCAGUAUCGA | 18 | 10255 |
| BCL11A-8530 | - | AUACCAGGAUCAGUAUCGA | 19 | 10256 |
| BCL11A-8531 | - | AAUACCAGGAUCAGUAUCGA | 20 | 10257 |
| BCL11A-8532 | - | GAAUACCAGGAUCAGUAUCGA | 21 | 10258 |
| BCL11A-8533 | - | AGAAUACCAGGAUCAGUAUCGA | 22 | 10259 |
| BCL11A-8534 | - | AAGAAUACCAGGAUCAGUAUCGA | 23 | 10260 |
| BCL11A-8535 | - | UAAGAAUACCAGGAUCAGUAUCGA | 24 | 10261 |
| BCL11A-8536 | - | UGUGUGGCAGUUUUCGGA | 18 | 10262 |
| BCL11A-8537 | - | AUGUGUGGCAGUUUUCGGA | 19 | 10263 |
| BCL11A-5929 | - | GAUGUGUGGCAGUUUUCGGA | 20 | 10264 |
| BCL11A-8538 | - | AGAUGUGUGGCAGUUUUCGGA | 21 | 10265 |
| BCL11A-8539 | - | AAGAUGUGUGGCAGUUUUCGGA | 22 | 10266 |
| BCL11A-8540 | - | CAAGAUGUGUGGCAGUUUUCGGA | 23 | 10267 |

TABLE 16E-continued

5th Tier

| gRNA Name | DNA Strand | Targeting Domain | Target Site Length | SEQ ID NO: |
|---|---|---|---|---|
| BCL11A-8541 | - | UCAAGAUGUGUGGCAGUUUUCGGA | 24 | 10268 |
| BCL11A-8542 | - | ACCGCCCGGGGAGCUGGA | 18 | 10269 |
| BCL11A-8543 | - | CACCGCCCGGGGAGCUGGA | 19 | 10270 |
| BCL11A-5933 | - | ACACCGCCCGGGGAGCUGGA | 20 | 10271 |
| BCL11A-8544 | - | CACACCGCCCGGGGAGCUGGA | 21 | 10272 |
| BCL11A-8545 | - | CCACACCGCCCGGGGAGCUGGA | 22 | 10273 |
| BCL11A-8546 | - | UCCACACCGCCCGGGGAGCUGGA | 23 | 10274 |
| BCL11A-8547 | - | CUCCACACCGCCCGGGGAGCUGGA | 24 | 10275 |
| BCL11A-8548 | - | AGCGGCACGGGAAGUGGA | 18 | 10276 |
| BCL11A-8549 | - | CAGCGGCACGGGAAGUGGA | 19 | 10277 |
| BCL11A-5934 | - | GCAGCGGCACGGGAAGUGGA | 20 | 10278 |
| BCL11A-8550 | - | CGCAGCGGCACGGGAAGUGGA | 21 | 10279 |
| BCL11A-8551 | - | GCGCAGCGGCACGGGAAGUGGA | 22 | 10280 |
| BCL11A-8552 | - | GGCGCAGCGGCACGGGAAGUGGA | 23 | 10281 |
| BCL11A-8553 | - | GGGCGCAGCGGCACGGGAAGUGGA | 24 | 10282 |
| BCL11A-8554 | - | AGGAGGAGGAGGAGCUGA | 18 | 10283 |
| BCL11A-8555 | - | GAGGAGGAGGAGGAGCUGA | 19 | 10284 |
| BCL11A-5938 | - | AGAGGAGGAGGAGGAGCUGA | 20 | 10285 |
| BCL11A-8556 | - | AAGAGGAGGAGGAGGAGCUGA | 21 | 10286 |
| BCL11A-8557 | - | GAAGAGGAGGAGGAGGAGCUGA | 22 | 10287 |
| BCL11A-8558 | - | GGAAGAGGAGGAGGAGGAGCUGA | 23 | 10288 |
| BCL11A-8559 | - | AGGAAGAGGAGGAGGAGGAGCUGA | 24 | 10289 |
| BCL11A-8560 | - | GGUUGAAUCCAAUGGCUA | 18 | 10290 |
| BCL11A-8561 | - | CGGUUGAAUCCAAUGGCUA | 19 | 10291 |
| BCL11A-5944 | - | GCGGUUGAAUCCAAUGGCUA | 20 | 10292 |
| BCL11A-8562 | - | UGCGGUUGAAUCCAAUGGCUA | 21 | 10293 |
| BCL11A-8563 | - | CUGCGGUUGAAUCCAAUGGCUA | 22 | 10294 |
| BCL11A-8564 | - | GCUGCGGUUGAAUCCAAUGGCUA | 23 | 10295 |
| BCL11A-8565 | - | UGCUGCGGUUGAAUCCAAUGGCUA | 24 | 10296 |
| BCL11A-8566 | - | AGAAUACCAGGAUCAGUA | 18 | 10297 |
| BCL11A-8567 | - | AAGAAUACCAGGAUCAGUA | 19 | 10298 |
| BCL11A-8568 | - | UAAGAAUACCAGGAUCAGUA | 20 | 10299 |
| BCL11A-8569 | - | CUAAGAAUACCAGGAUCAGUA | 21 | 10300 |
| BCL11A-8570 | - | GCUAAGAAUACCAGGAUCAGUA | 22 | 10301 |
| BCL11A-8571 | - | UGCUAAGAAUACCAGGAUCAGUA | 23 | 10302 |
| BCL11A-8572 | - | CUGCUAAGAAUACCAGGAUCAGUA | 24 | 10303 |
| BCL11A-8573 | - | AUUUCUCUAGGAGACUUA | 18 | 10304 |
| BCL11A-8574 | - | GAUUUCUCUAGGAGACUUA | 19 | 10305 |

TABLE 16E-continued

5th Tier

| gRNA Name | DNA Strand | Targeting Domain | Target Site Length | SEQ ID NO: |
|---|---|---|---|---|
| BCL11A-8575 | − | GGAUUUCUCUAGGAGACUUA | 20 | 10306 |
| BCL11A-8576 | − | UGGAUUUCUCUAGGAGACUUA | 21 | 10307 |
| BCL11A-8577 | − | AUGGAUUUCUCUAGGAGACUUA | 22 | 10308 |
| BCL11A-8578 | − | CAUGGAUUUCUCUAGGAGACUUA | 23 | 10309 |
| BCL11A-8579 | − | CCAUGGAUUUCUCUAGGAGACUUA | 24 | 10310 |
| BCL11A-8580 | − | CCGGCCGCGAUGCCCAAC | 18 | 10311 |
| BCL11A-8581 | − | CCCGGCCGCGAUGCCCAAC | 19 | 10312 |
| BCL11A-8582 | − | CCCCGGCCGCGAUGCCCAAC | 20 | 10313 |
| BCL11A-8583 | − | CCCCCGGCCGCGAUGCCCAAC | 21 | 10314 |
| BCL11A-8584 | − | GCCCCCGGCCGCGAUGCCCAAC | 22 | 10315 |
| BCL11A-8585 | − | UGCCCCCGGCCGCGAUGCCCAAC | 23 | 10316 |
| BCL11A-8586 | − | CUGCCCCCGGCCGCGAUGCCCAAC | 24 | 10317 |
| BCL11A-8587 | − | AACCUGAUCCCGGAGAAC | 18 | 10318 |
| BCL11A-8588 | − | CAACCUGAUCCCGGAGAAC | 19 | 10319 |
| BCL11A-5948 | − | CCAACCUGAUCCCGGAGAAC | 20 | 10320 |
| BCL11A-8589 | − | CCCAACCUGAUCCCGGAGAAC | 21 | 10321 |
| BCL11A-8590 | − | CCCCAACCUGAUCCCGGAGAAC | 22 | 10322 |
| BCL11A-8591 | − | ACCCCAACCUGAUCCCGGAGAAC | 23 | 10323 |
| BCL11A-8592 | − | GACCCCAACCUGAUCCCGGAGAAC | 24 | 10324 |
| BCL11A-8593 | − | UCUACUUAGAAAGCGAAC | 18 | 10325 |
| BCL11A-8594 | − | AUCUACUUAGAAAGCGAAC | 19 | 10326 |
| BCL11A-8595 | − | AAUCUACUUAGAAAGCGAAC | 20 | 10327 |
| BCL11A-8596 | − | GAAUCUACUUAGAAAGCGAAC | 21 | 10328 |
| BCL11A-8597 | − | AGAAUCUACUUAGAAAGCGAAC | 22 | 10329 |
| BCL11A-8598 | − | AAGAAUCUACUUAGAAAGCGAAC | 23 | 10330 |
| BCL11A-8599 | − | UAAGAAUCUACUUAGAAAGCGAAC | 24 | 10331 |
| BCL11A-8600 | − | GAGGCGGCGCGCCACCAC | 18 | 10332 |
| BCL11A-8601 | − | GGAGGCGGCGCGCCACCAC | 19 | 10333 |
| BCL11A-8602 | − | UGGAGGCGGCGCGCCACCAC | 20 | 10334 |
| BCL11A-8603 | − | CUGGAGGCGGCGCGCCACCAC | 21 | 10335 |
| BCL11A-8604 | − | CCUGGAGGCGGCGCGCCACCAC | 22 | 10336 |
| BCL11A-8605 | − | GCCUGGAGGCGGCGCGCCACCAC | 23 | 10337 |
| BCL11A-8606 | − | AGCCUGGAGGCGGCGCGCCACCAC | 24 | 10338 |
| BCL11A-8607 | − | GUGCACCGGCGCAGCCAC | 18 | 10339 |
| BCL11A-8608 | − | GGUGCACCGGCGCAGCCAC | 19 | 10340 |
| BCL11A-8609 | − | UGGUGCACCGGCGCAGCCAC | 20 | 10341 |
| BCL11A-8610 | − | GUGGUGCACCGGCGCAGCCAC | 21 | 10342 |

TABLE 16E-continued

5th Tier

| gRNA Name | DNA Strand | Targeting Domain | Target Site Length | SEQ ID NO: |
|---|---|---|---|---|
| BCL11A-8611 | - | GGUGGUGCACCGGCGCAGCCAC | 22 | 10343 |
| BCL11A-8612 | - | UGGUGGUGCACCGGCGCAGCCAC | 23 | 10344 |
| BCL11A-8613 | - | CUGGUGGUGCACCGGCGCAGCCAC | 24 | 10345 |
| BCL11A-8614 | - | AGCAAGCUGAAGCGCCAC | 18 | 10346 |
| BCL11A-8615 | - | CAGCAAGCUGAAGCGCCAC | 19 | 10347 |
| BCL11A-8616 | - | CCAGCAAGCUGAAGCGCCAC | 20 | 10348 |
| BCL11A-8617 | - | GCCAGCAAGCUGAAGCGCCAC | 21 | 10349 |
| BCL11A-8618 | - | GGCCAGCAAGCUGAAGCGCCAC | 22 | 10350 |
| BCL11A-8619 | - | AGGCCAGCAAGCUGAAGCGCCAC | 23 | 10351 |
| BCL11A-8620 | - | CAGGCCAGCAAGCUGAAGCGCCAC | 24 | 10352 |
| BCL11A-8621 | - | GCCGAGGCCGAGGGCCAC | 18 | 10353 |
| BCL11A-8622 | - | GGCCGAGGCCGAGGGCCAC | 19 | 10354 |
| BCL11A-5951 | - | UGGCCGAGGCCGAGGGCCAC | 20 | 10355 |
| BCL11A-8623 | - | CUGGCCGAGGCCGAGGGCCAC | 21 | 10356 |
| BCL11A-8624 | - | CCUGGCCGAGGCCGAGGGCCAC | 22 | 10357 |
| BCL11A-8625 | - | ACCUGGCCGAGGCCGAGGGCCAC | 23 | 10358 |
| BCL11A-8626 | - | CACCUGGCCGAGGCCGAGGGCCAC | 24 | 10359 |
| BCL11A-8627 | - | CUCGGGGCGCAGCGGCAC | 18 | 10360 |
| BCL11A-8628 | - | UCUCGGGGCGCAGCGGCAC | 19 | 10361 |
| BCL11A-5953 | - | AUCUCGGGGCGCAGCGGCAC | 20 | 10362 |
| BCL11A-8629 | - | GAUCUCGGGGCGCAGCGGCAC | 21 | 10363 |
| BCL11A-8630 | - | GGAUCUCGGGGCGCAGCGGCAC | 22 | 10364 |
| BCL11A-8631 | - | GGGAUCUCGGGGCGCAGCGGCAC | 23 | 10365 |
| BCL11A-8632 | - | AGGGAUCUCGGGGCGCAGCGGCAC | 24 | 10366 |
| BCL11A-8633 | - | CCACCACCGAGACAUCAC | 18 | 10367 |
| BCL11A-8634 | - | UCCACCACCGAGACAUCAC | 19 | 10368 |
| BCL11A-8635 | - | GUCCACCACCGAGACAUCAC | 20 | 10369 |
| BCL11A-8636 | - | AGUCCACCACCGAGACAUCAC | 21 | 10370 |
| BCL11A-8637 | - | UAGUCCACCACCGAGACAUCAC | 22 | 10371 |
| BCL11A-8638 | - | UUAGUCCACCACCGAGACAUCAC | 23 | 10372 |
| BCL11A-8639 | - | UUUAGUCCACCACCGAGACAUCAC | 24 | 10373 |
| BCL11A-8640 | - | GAGGAAGAGGAGGACGAC | 18 | 10374 |
| BCL11A-8641 | - | GGAGGAAGAGGAGGACGAC | 19 | 10375 |
| BCL11A-3949 | - | AGGAGGAAGAGGAGGACGAC | 20 | 10376 |
| BCL11A-8642 | - | GAGGAGGAAGAGGAGGACGAC | 21 | 10377 |
| BCL11A-8643 | - | CGAGGAGGAAGAGGAGGACGAC | 22 | 10378 |
| BCL11A-8644 | - | ACGAGGAGGAAGAGGAGGACGAC | 23 | 10379 |
| BCL11A-8645 | - | GACGAGGAGGAAGAGGAGGACGAC | 24 | 10380 |

TABLE 16E-continued

5th Tier

| gRNA Name | DNA Strand | Targeting Domain | Target Site Length | SEQ ID NO: |
|---|---|---|---|---|
| BCL11A-8646 | - | GUCGUGGGCGUGGGCGAC | 18 | 10381 |
| BCL11A-8647 | - | GGUCGUGGGCGUGGGCGAC | 19 | 10382 |
| BCL11A-8648 | - | CGGUCGUGGGCGUGGGCGAC | 20 | 10383 |
| BCL11A-8649 | - | GCGGUCGUGGGCGUGGGCGAC | 21 | 10384 |
| BCL11A-8650 | - | CGCGGUCGUGGGCGUGGGCGAC | 22 | 10385 |
| BCL11A-8651 | - | GCGCGGUCGUGGGCGUGGGCGAC | 23 | 10386 |
| BCL11A-8652 | - | GGCGCGGUCGUGGGCGUGGGCGAC | 24 | 10387 |
| BCL11A-8653 | - | AUCCCGGAGAACGGGAC | 18 | 10388 |
| BCL11A-8654 | - | GAUCCCGGAGAACGGGAC | 19 | 10389 |
| BCL11A-8655 | - | UGAUCCCGGAGAACGGGAC | 20 | 10390 |
| BCL11A-8656 | - | CUGAUCCCGGAGAACGGGAC | 21 | 10391 |
| BCL11A-8657 | - | CCUGAUCCCGGAGAACGGGAC | 22 | 10392 |
| BCL11A-8658 | - | ACCUGAUCCCGGAGAACGGGAC | 23 | 10393 |
| BCL11A-8659 | - | AACCUGAUCCCGGAGAACGGGAC | 24 | 10394 |
| BCL11A-8660 | - | UGGAGGCGGCGCGCCACC | 18 | 10395 |
| BCL11A-8661 | - | CUGGAGGCGGCGCGCCACC | 19 | 10396 |
| BCL11A-8662 | - | CCUGGAGGCGGCGCGCCACC | 20 | 10397 |
| BCL11A-8663 | - | GCCUGGAGGCGGCGCGCCACC | 21 | 10398 |
| BCL11A-8664 | - | AGCCUGGAGGCGGCGCGCCACC | 22 | 10399 |
| BCL11A-8665 | - | GAGCCUGGAGGCGGCGCGCCACC | 23 | 10400 |
| BCL11A-8666 | - | UGAGCCUGGAGGCGGCGCGCCACC | 24 | 10401 |
| BCL11A-8667 | - | CCCAUUCGGCGUAGUACC | 18 | 10402 |
| BCL11A-8668 | - | CCCCAUUCGGCGUAGUACC | 19 | 10403 |
| BCL11A-8669 | - | CCCCCAUUCGGCGUAGUACC | 20 | 10404 |
| BCL11A-8670 | - | ACCCCCAUUCGGCGUAGUACC | 21 | 10405 |
| BCL11A-8671 | - | CACCCCCAUUCGGCGUAGUACC | 22 | 10406 |
| BCL11A-8672 | - | ACACCCCCAUUCGGCGUAGUACC | 23 | 10407 |
| BCL11A-8673 | - | CACACCCCCAUUCGGCGUAGUACC | 24 | 10408 |
| BCL11A-8674 | - | GAGAAAAUUUGAAGCCCC | 18 | 10409 |
| BCL11A-8675 | - | UGAGAAAAUUUGAAGCCCC | 19 | 10410 |
| BCL11A-8676 | - | CUGAGAAAAUUUGAAGCCCC | 20 | 10411 |
| BCL11A-8677 | - | UCUGAGAAAAUUUGAAGCCCC | 21 | 10412 |
| BCL11A-8678 | - | UUCUGAGAAAAUUUGAAGCCCC | 22 | 10413 |
| BCL11A-8679 | - | GUUCUGAGAAAAUUUGAAGCCCC | 23 | 10414 |
| BCL11A-8680 | - | AGUUCUGAGAAAAUUUGAAGCCCC | 24 | 10415 |
| BCL11A-8681 | - | CGCUUCUCCACACCGCCC | 18 | 10416 |
| BCL11A-8682 | - | GCGCUUCUCCACACCGCCC | 19 | 10417 |

TABLE 16E-continued

5th Tier

| gRNA Name | DNA Strand | Targeting Domain | Target Site Length | SEQ ID NO: |
|---|---|---|---|---|
| BCL11A-5976 | - | UGCGCUUCUCCACACCGCCC | 20 | 10418 |
| BCL11A-8683 | - | UUGCGCUUCUCCACACCGCCC | 21 | 10419 |
| BCL11A-8684 | - | UUUGCGCUUCUCCACACCGCCC | 22 | 10420 |
| BCL11A-8685 | - | GUUUGCGCUUCUCCACACCGCCC | 23 | 10421 |
| BCL11A-8686 | - | AGUUUGCGCUUCUCCACACCGCCC | 24 | 10422 |
| BCL11A-8687 | - | UCUCCACCGCCAGCUCCC | 18 | 10423 |
| BCL11A-8688 | - | CUCUCCACCGCCAGCUCCC | 19 | 10424 |
| BCL11A-5982 | - | UCUCUCCACCGCCAGCUCCC | 20 | 10425 |
| BCL11A-8689 | - | GUCUCUCCACCGCCAGCUCCC | 21 | 10426 |
| BCL11A-8690 | - | GGUCUCUCCACCGCCAGCUCCC | 22 | 10427 |
| BCL11A-8691 | - | CGGUCUCUCCACCGCCAGCUCCC | 23 | 10428 |
| BCL11A-8692 | - | ACGGUCUCUCCACCGCCAGCUCCC | 24 | 10429 |
| BCL11A-8693 | - | ACGGCUUCGGGCUGAGCC | 18 | 10430 |
| BCL11A-8694 | - | UACGGCUUCGGGCUGAGCC | 19 | 10431 |
| BCL11A-5986 | - | CUACGGCUUCGGGCUGAGCC | 20 | 10432 |
| BCL11A-8695 | - | ACUACGGCUUCGGGCUGAGCC | 21 | 10433 |
| BCL11A-8696 | - | GACUACGGCUUCGGGCUGAGCC | 22 | 10434 |
| BCL11A-8697 | - | GGACUACGGCUUCGGGCUGAGCC | 23 | 10435 |
| BCL11A-8698 | - | UGGACUACGGCUUCGGGCUGAGCC | 24 | 10436 |
| BCL11A-8699 | - | GCGCUUCUCCACACCGCC | 18 | 10437 |
| BCL11A-8700 | - | UGCGCUUCUCCACACCGCC | 19 | 10438 |
| BCL11A-5987 | - | UUGCGCUUCUCCACACCGCC | 20 | 10439 |
| BCL11A-8701 | - | UUUGCGCUUCUCCACACCGCC | 21 | 10440 |
| BCL11A-8702 | - | GUUUGCGCUUCUCCACACCGCC | 22 | 10441 |
| BCL11A-8703 | - | AGUUUGCGCUUCUCCACACCGCC | 23 | 10442 |
| BCL11A-8704 | - | GAGUUUGCGCUUCUCCACACCGCC | 24 | 10443 |
| BCL11A-8705 | - | CCCACCGCAUAGAGCGCC | 18 | 10444 |
| BCL11A-8706 | - | CCCCACCGCAUAGAGCGCC | 19 | 10445 |
| BCL11A-5988 | - | CCCCCACCGCAUAGAGCGCC | 20 | 10446 |
| BCL11A-8707 | - | ACCCCCACCGCAUAGAGCGCC | 21 | 10447 |
| BCL11A-8708 | - | GACCCCCACCGCAUAGAGCGCC | 22 | 10448 |
| BCL11A-8709 | - | GGACCCCCACCGCAUAGAGCGCC | 23 | 10449 |
| BCL11A-8710 | - | UGGACCCCCACCGCAUAGAGCGCC | 24 | 10450 |
| BCL11A-8711 | - | GGCCACCUGGCCGAGGCC | 18 | 10451 |
| BCL11A-8712 | - | CGGCCACCUGGCCGAGGCC | 19 | 10452 |
| BCL11A-8713 | - | GCGGCCACCUGGCCGAGGCC | 20 | 10453 |
| BCL11A-8714 | - | CGCGGCCACCUGGCCGAGGCC | 21 | 10454 |
| BCL11A-8715 | - | GCGCGGCCACCUGGCCGAGGCC | 22 | 10455 |

TABLE 16E-continued

5th Tier

| gRNA Name | DNA Strand | Targeting Domain | Target Site Length | SEQ ID NO: |
|---|---|---|---|---|
| BCL11A-8716 | - | AGCGCGGCCACCUGGCCGAGGCC | 23 | 10456 |
| BCL11A-8717 | - | AAGCGCGGCCACCUGGCCGAGGCC | 24 | 10457 |
| BCL11A-8718 | - | UCCCCGGGCGAGUCGGCC | 18 | 10458 |
| BCL11A-8719 | - | CUCCCCGGGCGAGUCGGCC | 19 | 10459 |
| BCL11A-8720 | - | GCUCCCCGGGCGAGUCGGCC | 20 | 10460 |
| BCL11A-8721 | - | UGCUCCCCGGGCGAGUCGGCC | 21 | 10461 |
| BCL11A-8722 | - | CUGCUCCCCGGGCGAGUCGGCC | 22 | 10462 |
| BCL11A-8723 | - | GCUGCUCCCCGGGCGAGUCGGCC | 23 | 10463 |
| BCL11A-8724 | - | GGCUGCUCCCCGGGCGAGUCGGCC | 24 | 10464 |
| BCL11A-8725 | - | ACGACCCCAACCUGAUCC | 18 | 10465 |
| BCL11A-8726 | - | AACGACCCCAACCUGAUCC | 19 | 10466 |
| BCL11A-6004 | - | GAACGACCCCAACCUGAUCC | 20 | 10467 |
| BCL11A-8727 | - | AGAACGACCCCAACCUGAUCC | 21 | 10468 |
| BCL11A-8728 | - | GAGAACGACCCCAACCUGAUCC | 22 | 10469 |
| BCL11A-8729 | - | CGAGAACGACCCCAACCUGAUCC | 23 | 10470 |
| BCL11A-8730 | - | GCGAGAACGACCCCAACCUGAUCC | 24 | 10471 |
| BCL11A-8731 | - | UCCUCGUCGGAGCACUCC | 18 | 10472 |
| BCL11A-8732 | - | CUCCUCGUCGGAGCACUCC | 19 | 10473 |
| BCL11A-8733 | - | CCUCCUCGUCGGAGCACUCC | 20 | 10474 |
| BCL11A-8734 | - | GCCUCCUCGUCGGAGCACUCC | 21 | 10475 |
| BCL11A-8735 | - | UGCCUCCUCGUCGGAGCACUCC | 22 | 10476 |
| BCL11A-8736 | - | UUGCCUCCUCGUCGGAGCACUCC | 23 | 10477 |
| BCL11A-8737 | - | UUUGCCUCCUCGUCGGAGCACUCC | 24 | 10478 |
| BCL11A-8738 | - | CUCUCCACCGCCAGCUCC | 18 | 10479 |
| BCL11A-8739 | - | UCUCUCCACCGCCAGCUCC | 19 | 10480 |
| BCL11A-8740 | - | GUCUCUCCACCGCCAGCUCC | 20 | 10481 |
| BCL11A-8741 | - | GGUCUCUCCACCGCCAGCUCC | 21 | 10482 |
| BCL11A-8742 | - | CGGUCUCUCCACCGCCAGCUCC | 22 | 10483 |
| BCL11A-8743 | - | ACGGUCUCUCCACCGCCAGCUCC | 23 | 10484 |
| BCL11A-8744 | - | GACGGUCUCUCCACCGCCAGCUCC | 24 | 10485 |
| BCL11A-8745 | - | AAUGGCCGCGGCUGCUCC | 18 | 10486 |
| BCL11A-8746 | - | UAAUGGCCGCGGCUGCUCC | 19 | 10487 |
| BCL11A-8747 | - | UUAAUGGCCGCGGCUGCUCC | 20 | 10488 |
| BCL11A-8748 | - | GUUAAUGGCCGCGGCUGCUCC | 21 | 10489 |
| BCL11A-8749 | - | UGUUAAUGGCCGCGGCUGCUCC | 22 | 10490 |
| BCL11A-8750 | - | CUGUUAAUGGCCGCGGCUGCUCC | 23 | 10491 |
| BCL11A-8751 | - | ACUGUUAAUGGCCGCGGCUGCUCC | 24 | 10492 |

TABLE 16E-continued

5th Tier

| gRNA Name | DNA Strand | Targeting Domain | Target Site Length | SEQ ID NO: |
|---|---|---|---|---|
| BCL11A-8752 | - | CUUCCCAGCCACCUCUCC | 18 | 10493 |
| BCL11A-8753 | - | CCUUCCCAGCCACCUCUCC | 19 | 10494 |
| BCL11A-8754 | - | UCCUUCCCAGCCACCUCUCC | 20 | 10495 |
| BCL11A-8755 | - | GUCCUUCCCAGCCACCUCUCC | 21 | 10496 |
| BCL11A-8756 | - | UGUCCUUCCCAGCCACCUCUCC | 22 | 10497 |
| BCL11A-8757 | - | AUGUCCUUCCCAGCCACCUCUCC | 23 | 10498 |
| BCL11A-8758 | - | AAUGUCCUUCCCAGCCACCUCUCC | 24 | 10499 |
| BCL11A-8759 | - | UCUCUAAGCGCAUCAAGC | 18 | 10500 |
| BCL11A-8760 | - | UUCUCUAAGCGCAUCAAGC | 19 | 10501 |
| BCL11A-8761 | - | CUUCUCUAAGCGCAUCAAGC | 20 | 10502 |
| BCL11A-8762 | - | CCUUCUCUAAGCGCAUCAAGC | 21 | 10503 |
| BCL11A-8763 | - | CCCUUCUCUAAGCGCAUCAAGC | 22 | 10504 |
| BCL11A-8764 | - | CCCCUUCUCUAAGCGCAUCAAGC | 23 | 10505 |
| BCL11A-8765 | - | GCCCCUUCUCUAAGCGCAUCAAGC | 24 | 10506 |
| BCL11A-8766 | - | CAGUUUUCGGAUGGAAGC | 18 | 10507 |
| BCL11A-8767 | - | GCAGUUUUCGGAUGGAAGC | 19 | 10508 |
| BCL11A-8768 | - | GGCAGUUUUCGGAUGGAAGC | 20 | 10509 |
| BCL11A-8769 | - | UGGCAGUUUUCGGAUGGAAGC | 21 | 10510 |
| BCL11A-8770 | - | GUGGCAGUUUUCGGAUGGAAGC | 22 | 10511 |
| BCL11A-8771 | - | UGUGGCAGUUUUCGGAUGGAAGC | 23 | 10512 |
| BCL11A-8772 | - | GUGUGGCAGUUUUCGGAUGGAAGC | 24 | 10513 |
| BCL11A-8773 | - | GUGGCCAAGUUCAAGAGC | 18 | 10514 |
| BCL11A-8774 | - | GGUGGCCAAGUUCAAGAGC | 19 | 10515 |
| BCL11A-8775 | - | UGGUGGCCAAGUUCAAGAGC | 20 | 10516 |
| BCL11A-8776 | - | GUGGUGGCCAAGUUCAAGAGC | 21 | 10517 |
| BCL11A-8777 | - | CGUGGUGGCCAAGUUCAAGAGC | 22 | 10518 |
| BCL11A-8778 | - | CCGUGGUGGCCAAGUUCAAGAGC | 23 | 10519 |
| BCL11A-8779 | - | UCCGUGGUGGCCAAGUUCAAGAGC | 24 | 10520 |
| BCL11A-8780 | - | GAGGAGCUGACGGAGAGC | 18 | 10521 |
| BCL11A-8781 | - | GGAGGAGCUGACGGAGAGC | 19 | 10522 |
| BCL11A-8782 | - | AGGAGGAGCUGACGGAGAGC | 20 | 10523 |
| BCL11A-8783 | - | GAGGAGGAGCUGACGGAGAGC | 21 | 10524 |
| BCL11A-8784 | - | GGAGGAGGAGCUGACGGAGAGC | 22 | 10525 |
| BCL11A-8785 | - | AGGAGGAGGAGCUGACGGAGAGC | 23 | 10526 |
| BCL11A-8786 | - | GAGGAGGAGGAGCUGACGGAGAGC | 24 | 10527 |
| BCL11A-8787 | - | UACGGCUUCGGGCUGAGC | 18 | 10528 |
| BCL11A-8788 | - | CUACGGCUUCGGGCUGAGC | 19 | 10529 |
| BCL11A-8789 | - | ACUACGGCUUCGGGCUGAGC | 20 | 10530 |

TABLE 16E-continued

5th Tier

| gRNA Name | DNA Strand | Targeting Domain | Target Site Length | SEQ ID NO: |
|---|---|---|---|---|
| BCL11A-8790 | - | GACUACGGCUUCGGGCUGAGC | 21 | 10531 |
| BCL11A-8791 | - | GGACUACGGCUUCGGGCUGAGC | 22 | 10532 |
| BCL11A-8792 | - | UGGACUACGGCUUCGGGCUGAGC | 23 | 10533 |
| BCL11A-8793 | - | GUGGACUACGGCUUCGGGCUGAGC | 24 | 10534 |
| BCL11A-8794 | - | UGCGCUUCUCCACACCGC | 18 | 10535 |
| BCL11A-8795 | - | UUGCGCUUCUCCACACCGC | 19 | 10536 |
| BCL11A-8796 | - | UUUGCGCUUCUCCACACCGC | 20 | 10537 |
| BCL11A-8797 | - | GUUUGCGCUUCUCCACACCGC | 21 | 10538 |
| BCL11A-8798 | - | AGUUUGCGCUUCUCCACACCGC | 22 | 10539 |
| BCL11A-8799 | - | GAGUUUGCGCUUCUCCACACCGC | 23 | 10540 |
| BCL11A-8800 | - | GGAGUUUGCGCUUCUCCACACCGC | 24 | 10541 |
| BCL11A-8801 | - | CCCCACCGCAUAGAGCGC | 18 | 10542 |
| BCL11A-8802 | - | CCCCCACCGCAUAGAGCGC | 19 | 10543 |
| BCL11A-8803 | - | ACCCCCACCGCAUAGAGCGC | 20 | 10544 |
| BCL11A-8804 | - | GACCCCCACCGCAUAGAGCGC | 21 | 10545 |
| BCL11A-8805 | - | GGACCCCCACCGCAUAGAGCGC | 22 | 10546 |
| BCL11A-8806 | - | UGGACCCCCACCGCAUAGAGCGC | 23 | 10547 |
| BCL11A-8807 | - | UUGGACCCCCACCGCAUAGAGCGC | 24 | 10548 |
| BCL11A-8808 | - | AUCUCGGGGCGCAGCGGC | 18 | 10549 |
| BCL11A-8809 | - | GAUCUCGGGGCGCAGCGGC | 19 | 10550 |
| BCL11A-8810 | - | GGAUCUCGGGGCGCAGCGGC | 20 | 10551 |
| BCL11A-8811 | - | GGGAUCUCGGGGCGCAGCGGC | 21 | 10552 |
| BCL11A-8812 | - | AGGGAUCUCGGGGCGCAGCGGC | 22 | 10553 |
| BCL11A-8813 | - | GAGGGAUCUCGGGGCGCAGCGGC | 23 | 10554 |
| BCL11A-8814 | - | GGAGGGAUCUCGGGGCGCAGCGGC | 24 | 10555 |
| BCL11A-8815 | - | CGGCGCAGCCACACGGGC | 18 | 10556 |
| BCL11A-8816 | - | CCGGCGCAGCCACACGGGC | 19 | 10557 |
| BCL11A-3804 | - | ACCGGCGCAGCCACACGGGC | 20 | 10558 |
| BCL11A-8817 | - | CACCGGCGCAGCCACACGGGC | 21 | 10559 |
| BCL11A-8818 | - | GCACCGGCGCAGCCACACGGGC | 22 | 10560 |
| BCL11A-8819 | - | UGCACCGGCGCAGCCACACGGGC | 23 | 10561 |
| BCL11A-8820 | - | GUGCACCGGCGCAGCCACACGGGC | 24 | 10562 |
| BCL11A-8821 | - | CAUAUUAGUGGUCCGGGC | 18 | 10563 |
| BCL11A-8822 | - | CCAUAUUAGUGGUCCGGGC | 19 | 10564 |
| BCL11A-8823 | - | CCCAUAUUAGUGGUCCGGGC | 20 | 10565 |
| BCL11A-8824 | - | CCCCAUAUUAGUGGUCCGGGC | 21 | 10566 |
| BCL11A-8825 | - | GCCCCAUAUUAGUGGUCCGGGC | 22 | 10567 |

TABLE 16E-continued

5th Tier

| gRNA Name | DNA Strand | Targeting Domain | Target Site Length | SEQ ID NO: |
|---|---|---|---|---|
| BCL11A-8826 | - | CGCCCCAUAUUAGUGGUCCGGGC | 23 | 10568 |
| BCL11A-8827 | - | ACGCCCCAUAUUAGUGGUCCGGGC | 24 | 10569 |
| BCL11A-8828 | - | UUCCACCAGGUCCUGGGC | 18 | 10570 |
| BCL11A-8829 | - | CUUCCACCAGGUCCUGGGC | 19 | 10571 |
| BCL11A-8830 | - | CCUUCCACCAGGUCCUGGGC | 20 | 10572 |
| BCL11A-8831 | - | GCCUUCCACCAGGUCCUGGGC | 21 | 10573 |
| BCL11A-8832 | - | GGCCUUCCACCAGGUCCUGGGC | 22 | 10574 |
| BCL11A-8833 | - | AGGCCUUCCACCAGGUCCUGGGC | 23 | 10575 |
| BCL11A-8834 | - | GAGGCCUUCCACCAGGUCCUGGGC | 24 | 10576 |
| BCL11A-8835 | - | CGGGGCGCGGUCGUGGGC | 18 | 10577 |
| BCL11A-8836 | - | GCGGGGCGCGGUCGUGGGC | 19 | 10578 |
| BCL11A-8837 | - | CGCGGGGCGCGGUCGUGGGC | 20 | 10579 |
| BCL11A-8838 | - | UCGCGGGGCGCGGUCGUGGGC | 21 | 10580 |
| BCL11A-8839 | - | CUCGCGGGGCGCGGUCGUGGGC | 22 | 10581 |
| BCL11A-8840 | - | GCUCGCGGGGCGCGGUCGUGGGC | 23 | 10582 |
| BCL11A-8841 | - | AGCUCGCGGGGCGCGGUCGUGGGC | 24 | 10583 |
| BCL11A-8842 | - | GAGACUUAGAGAGCUGGC | 18 | 10584 |
| BCL11A-8843 | - | GGAGACUUAGAGAGCUGGC | 19 | 10585 |
| BCL11A-6037 | - | AGGAGACUUAGAGAGCUGGC | 20 | 10586 |
| BCL11A-8844 | - | UAGGAGACUUAGAGAGCUGGC | 21 | 10587 |
| BCL11A-8845 | - | CUAGGAGACUUAGAGAGCUGGC | 22 | 10588 |
| BCL11A-8846 | - | UCUAGGAGACUUAGAGAGCUGGC | 23 | 10589 |
| BCL11A-8847 | - | CUCUAGGAGACUUAGAGAGCUGGC | 24 | 10590 |
| BCL11A-8848 | - | GAGCUGGACGGAGGGAUC | 18 | 10591 |
| BCL11A-8849 | - | GGAGCUGGACGGAGGGAUC | 19 | 10592 |
| BCL11A-8850 | - | GGGAGCUGGACGGAGGGAUC | 20 | 10593 |
| BCL11A-8851 | - | GGGGAGCUGGACGGAGGGAUC | 21 | 10594 |
| BCL11A-8852 | - | CGGGGAGCUGGACGGAGGGAUC | 22 | 10595 |
| BCL11A-8853 | - | CCGGGGAGCUGGACGGAGGGAUC | 23 | 10596 |
| BCL11A-8854 | - | CCCGGGGAGCUGGACGGAGGGAUC | 24 | 10597 |
| BCL11A-8855 | - | AACGACCCCAACCUGAUC | 18 | 10598 |
| BCL11A-8856 | - | GAACGACCCCAACCUGAUC | 19 | 10599 |
| BCL11A-8857 | - | AGAACGACCCCAACCUGAUC | 20 | 10600 |
| BCL11A-8858 | - | GAGAACGACCCCAACCUGAUC | 21 | 10601 |
| BCL11A-8859 | - | CGAGAACGACCCCAACCUGAUC | 22 | 10602 |
| BCL11A-8860 | - | GCGAGAACGACCCCAACCUGAUC | 23 | 10603 |
| BCL11A-8861 | - | AGCGAGAACGACCCCAACCUGAUC | 24 | 10604 |
| BCL11A-8862 | - | AAUACCAGGAUCAGUAUC | 18 | 10605 |

TABLE 16E-continued

5th Tier

| gRNA Name | DNA Strand | Targeting Domain | Target Site Length | SEQ ID NO: |
|---|---|---|---|---|
| BCL11A-8863 | - | GAAUACCAGGAUCAGUAUC | 19 | 10606 |
| BCL11A-8864 | - | AGAAUACCAGGAUCAGUAUC | 20 | 10607 |
| BCL11A-8865 | - | AAGAAUACCAGGAUCAGUAUC | 21 | 10608 |
| BCL11A-8866 | - | UAAGAAUACCAGGAUCAGUAUC | 22 | 10609 |
| BCL11A-8867 | - | CUAAGAAUACCAGGAUCAGUAUC | 23 | 10610 |
| BCL11A-8868 | - | GCUAAGAAUACCAGGAUCAGUAUC | 24 | 10611 |
| BCL11A-8869 | - | CCCGGGCGAGUCGGCCUC | 18 | 10612 |
| BCL11A-8870 | - | CCCCGGGCGAGUCGGCCUC | 19 | 10613 |
| BCL11A-6047 | - | UCCCCGGGCGAGUCGGCCUC | 20 | 10614 |
| BCL11A-8871 | - | CUCCCCGGGCGAGUCGGCCUC | 21 | 10615 |
| BCL11A-8872 | - | GCUCCCCGGGCGAGUCGGCCUC | 22 | 10616 |
| BCL11A-8873 | - | UGCUCCCCGGGCGAGUCGGCCUC | 23 | 10617 |
| BCL11A-8874 | - | CUGCUCCCCGGGCGAGUCGGCCUC | 24 | 10618 |
| BCL11A-8875 | - | UCUAAGCGCAUCAAGCUC | 18 | 10619 |
| BCL11A-8876 | - | CUCUAAGCGCAUCAAGCUC | 19 | 10620 |
| BCL11A-8877 | - | UCUCUAAGCGCAUCAAGCUC | 20 | 10621 |
| BCL11A-8878 | - | UUCUCUAAGCGCAUCAAGCUC | 21 | 10622 |
| BCL11A-8879 | - | CUUCUCUAAGCGCAUCAAGCUC | 22 | 10623 |
| BCL11A-8880 | - | CCUUCUCUAAGCGCAUCAAGCUC | 23 | 10624 |
| BCL11A-8881 | - | CCCUUCUCUAAGCGCAUCAAGCUC | 24 | 10625 |
| BCL11A-8882 | - | GUUUUCGGAUGGAAGCUC | 18 | 10626 |
| BCL11A-8883 | - | AGUUUUCGGAUGGAAGCUC | 19 | 10627 |
| BCL11A-8884 | - | CAGUUUUCGGAUGGAAGCUC | 20 | 10628 |
| BCL11A-8885 | - | GCAGUUUUCGGAUGGAAGCUC | 21 | 10629 |
| BCL11A-8886 | - | GGCAGUUUUCGGAUGGAAGCUC | 22 | 10630 |
| BCL11A-8887 | - | UGGCAGUUUUCGGAUGGAAGCUC | 23 | 10631 |
| BCL11A-8888 | - | GUGGCAGUUUUCGGAUGGAAGCUC | 24 | 10632 |
| BCL11A-8889 | - | CCACCACGAGAACAGCUC | 18 | 10633 |
| BCL11A-8890 | - | GCCACCACGAGAACAGCUC | 19 | 10634 |
| BCL11A-8891 | - | CGCCACCACGAGAACAGCUC | 20 | 10635 |
| BCL11A-8892 | - | GCGCCACCACGAGAACAGCUC | 21 | 10636 |
| BCL11A-8893 | - | CGCGCCACCACGAGAACAGCUC | 22 | 10637 |
| BCL11A-8894 | - | GCGCGCCACCACGAGAACAGCUC | 23 | 10638 |
| BCL11A-8895 | - | GGCGCGCCACCACGAGAACAGCUC | 24 | 10639 |
| BCL11A-8896 | - | UCCCGCCAUGGAUUUCUC | 18 | 10640 |
| BCL11A-8897 | - | CUCCCGCCAUGGAUUUCUC | 19 | 10641 |
| BCL11A-8898 | - | CCUCCCGCCAUGGAUUUCUC | 20 | 10642 |

TABLE 16E-continued

5th Tier

| gRNA Name | DNA Strand | Targeting Domain | Target Site Length | SEQ ID NO: |
|---|---|---|---|---|
| BCL11A-8899 | - | GCCUCCCGCCAUGGAUUUCUC | 21 | 10643 |
| BCL11A-8900 | - | AGCCUCCCGCCAUGGAUUUCUC | 22 | 10644 |
| BCL11A-8901 | - | GAGCCUCCCGCCAUGGAUUUCUC | 23 | 10645 |
| BCL11A-8902 | - | GGAGCCUCCCGCCAUGGAUUUCUC | 24 | 10646 |
| BCL11A-8903 | - | GAGGCCUUCCACCAGGUC | 18 | 10647 |
| BCL11A-8904 | - | CGAGGCCUUCCACCAGGUC | 19 | 10648 |
| BCL11A-8905 | - | GCGAGGCCUUCCACCAGGUC | 20 | 10649 |
| BCL11A-8906 | - | AGCGAGGCCUUCCACCAGGUC | 21 | 10650 |
| BCL11A-8907 | - | CAGCGAGGCCUUCCACCAGGUC | 22 | 10651 |
| BCL11A-8908 | - | UCAGCGAGGCCUUCCACCAGGUC | 23 | 10652 |
| BCL11A-8909 | - | UUCAGCGAGGCCUUCCACCAGGUC | 24 | 10653 |
| BCL11A-8910 | - | AGCUCGCGGGGCGCGGUC | 18 | 10654 |
| BCL11A-8911 | - | CAGCUCGCGGGGCGCGGUC | 19 | 10655 |
| BCL11A-8912 | - | ACAGCUCGCGGGGCGCGGUC | 20 | 10656 |
| BCL11A-8913 | - | AACAGCUCGCGGGGCGCGGUC | 21 | 10657 |
| BCL11A-8914 | - | GAACAGCUCGCGGGGCGCGGUC | 22 | 10658 |
| BCL11A-8915 | - | AGAACAGCUCGCGGGGCGCGGUC | 23 | 10659 |
| BCL11A-8916 | - | GAGAACAGCUCGCGGGGCGCGGUC | 24 | 10660 |
| BCL11A-8917 | - | UACUGUGGGAAAGUCUUC | 18 | 10661 |
| BCL11A-8918 | - | GUACUGUGGGAAAGUCUUC | 19 | 10662 |
| BCL11A-8919 | - | AGUACUGUGGGAAAGUCUUC | 20 | 10663 |
| BCL11A-8920 | - | GAGUACUGUGGGAAAGUCUUC | 21 | 10664 |
| BCL11A-8921 | - | UGAGUACUGUGGGAAAGUCUUC | 22 | 10665 |
| BCL11A-8922 | - | GUGAGUACUGUGGGAAAGUCUUC | 23 | 10666 |
| BCL11A-8923 | - | UGUGAGUACUGUGGGAAAGUCUUC | 24 | 10667 |
| BCL11A-8924 | - | UCCGUGGUGGCCAAGUUC | 18 | 10668 |
| BCL11A-8925 | - | GUCCGUGGUGGCCAAGUUC | 19 | 10669 |
| BCL11A-8926 | - | AGUCCGUGGUGGCCAAGUUC | 20 | 10670 |
| BCL11A-8927 | - | AAGUCCGUGGUGGCCAAGUUC | 21 | 10671 |
| BCL11A-8928 | - | CAAGUCCGUGGUGGCCAAGUUC | 22 | 10672 |
| BCL11A-8929 | - | UCAAGUCCGUGGUGGCCAAGUUC | 23 | 10673 |
| BCL11A-8930 | - | CUCAAGUCCGUGGUGGCCAAGUUC | 24 | 10674 |
| BCL11A-6826 | - | AUUAUUUUGCAGGUAAAG | 18 | 10675 |
| BCL11A-6827 | - | UAUUAUUUUGCAGGUAAAG | 19 | 10676 |
| BCL11A-6828 | - | GUAUUAUUUUGCAGGUAAAG | 20 | 10677 |
| BCL11A-8931 | - | UGCACCCAGGCCAGCAAG | 18 | 10678 |
| BCL11A-8932 | - | GUGCACCCAGGCCAGCAAG | 19 | 10679 |
| BCL11A-8933 | - | CGUGCACCCAGGCCAGCAAG | 20 | 10680 |

TABLE 16E-continued

5th Tier

| gRNA Name | DNA Strand | Targeting Domain | Target Site Length | SEQ ID NO: |
|---|---|---|---|---|
| BCL11A-8934 | - | GCGUGCACCCAGGCCAGCAAG | 21 | 10681 |
| BCL11A-8935 | - | CGCGUGCACCCAGGCCAGCAAG | 22 | 10682 |
| BCL11A-8936 | - | ACGCGUGCACCCAGGCCAGCAAG | 23 | 10683 |
| BCL11A-8937 | - | CACGCGUGCACCCAGGCCAGCAAG | 24 | 10684 |
| BCL11A-8938 | - | ACGAGGAAGAGGAAGAAG | 18 | 10685 |
| BCL11A-8939 | - | GACGAGGAAGAGGAAGAAG | 19 | 10686 |
| BCL11A-3449 | - | CGACGAGGAAGAGGAAGAAG | 20 | 10687 |
| BCL11A-8940 | - | ACGACGAGGAAGAGGAAGAAG | 21 | 10688 |
| BCL11A-8941 | - | GACGACGAGGAAGAGGAAGAAG | 22 | 10689 |
| BCL11A-8942 | - | GGACGACGAGGAAGAGGAAGAAG | 23 | 10690 |
| BCL11A-8943 | - | AGGACGACGAGGAAGAGGAAGAAG | 24 | 10691 |
| BCL11A-8944 | - | ACGACGAGGAAGAGGAAG | 18 | 10692 |
| BCL11A-8945 | - | GACGACGAGGAAGAGGAAG | 19 | 10693 |
| BCL11A-3959 | - | GGACGACGAGGAAGAGGAAG | 20 | 10694 |
| BCL11A-8946 | - | AGGACGACGAGGAAGAGGAAG | 21 | 10695 |
| BCL11A-8947 | - | GAGGACGACGAGGAAGAGGAAG | 22 | 10696 |
| BCL11A-8948 | - | GGAGGACGACGAGGAAGAGGAAG | 23 | 10697 |
| BCL11A-8949 | - | AGGAGGACGACGAGGAAGAGGAAG | 24 | 10698 |
| BCL11A-8950 | - | AGGAGGACGACGAGGAAG | 18 | 10699 |
| BCL11A-8951 | - | GAGGAGGACGACGAGGAAG | 19 | 10700 |
| BCL11A-3448 | - | AGAGGAGGACGACGAGGAAG | 20 | 10701 |
| BCL11A-8952 | - | AAGAGGAGGACGACGAGGAAG | 21 | 10702 |
| BCL11A-8953 | - | GAAGAGGAGGACGACGAGGAAG | 22 | 10703 |
| BCL11A-8954 | - | GGAAGAGGAGGACGACGAGGAAG | 23 | 10704 |
| BCL11A-8955 | - | AGGAAGAGGAGGACGACGAGGAAG | 24 | 10705 |
| BCL11A-8956 | - | AGGAAGAAGAGGAGGAAG | 18 | 10706 |
| BCL11A-8957 | - | GAGGAAGAAGAGGAGGAAG | 19 | 10707 |
| BCL11A-3453 | - | AGAGGAAGAAGAGGAGGAAG | 20 | 10708 |
| BCL11A-8958 | - | AAGAGGAAGAAGAGGAGGAAG | 21 | 10709 |
| BCL11A-8959 | - | GAAGAGGAAGAAGAGGAGGAAG | 22 | 10710 |
| BCL11A-8960 | - | GGAAGAGGAAGAAGAGGAGGAAG | 23 | 10711 |
| BCL11A-8961 | - | AGGAAGAGGAAGAAGAGGAGGAAG | 24 | 10712 |
| BCL11A-8962 | - | ACGGGGACGAGGAGGAAG | 18 | 10713 |
| BCL11A-8963 | - | AACGGGGACGAGGAGGAAG | 19 | 10714 |
| BCL11A-3441 | - | GAACGGGGACGAGGAGGAAG | 20 | 10715 |
| BCL11A-8964 | - | AGAACGGGGACGAGGAGGAAG | 21 | 10716 |
| BCL11A-8965 | - | GAGAACGGGGACGAGGAGGAAG | 22 | 10717 |

TABLE 16E-continued

5th Tier

| gRNA Name | DNA Strand | Targeting Domain | Target Site Length | SEQ ID NO: |
|---|---|---|---|---|
| BCL11A-8966 | - | GGAGAACGGGGACGAGGAGGAAG | 23 | 10718 |
| BCL11A-8967 | - | CGGAGAACGGGGACGAGGAGGAAG | 24 | 10719 |
| BCL11A-8968 | - | GCGCAGCGGCACGGGAAG | 18 | 10720 |
| BCL11A-8969 | - | GGCGCAGCGGCACGGGAAG | 19 | 10721 |
| BCL11A-3376 | - | GGGCGCAGCGGCACGGGAAG | 20 | 10722 |
| BCL11A-8970 | - | GGGGCGCAGCGGCACGGGAAG | 21 | 10723 |
| BCL11A-8971 | - | CGGGGCGCAGCGGCACGGGAAG | 22 | 10724 |
| BCL11A-8972 | - | UCGGGGCGCAGCGGCACGGGAAG | 23 | 10725 |
| BCL11A-8973 | - | CUCGGGGCGCAGCGGCACGGGAAG | 24 | 10726 |
| BCL11A-8974 | - | AGGCUUCCGGCCUGGCAG | 18 | 10727 |
| BCL11A-8975 | - | GAGGCUUCCGGCCUGGCAG | 19 | 10728 |
| BCL11A-8976 | - | AGAGGCUUCCGGCCUGGCAG | 20 | 10729 |
| BCL11A-8977 | - | GAGAGGCUUCCGGCCUGGCAG | 21 | 10730 |
| BCL11A-8978 | - | AGAGAGGCUUCCGGCCUGGCAG | 22 | 10731 |
| BCL11A-8979 | - | GAGAGAGGCUUCCGGCCUGGCAG | 23 | 10732 |
| BCL11A-8980 | - | CGAGAGAGGCUUCCGGCCUGGCAG | 24 | 10733 |
| BCL11A-8981 | - | GAGGAAGAGGAAGAAGAG | 18 | 10734 |
| BCL11A-8982 | - | CGAGGAAGAGGAAGAAGAG | 19 | 10735 |
| BCL11A-3948 | - | ACGAGGAAGAGGAAGAAGAG | 20 | 10736 |
| BCL11A-8983 | - | GACGAGGAAGAGGAAGAAGAG | 21 | 10737 |
| BCL11A-8984 | - | CGACGAGGAAGAGGAAGAAGAG | 22 | 10738 |
| BCL11A-8985 | - | ACGACGAGGAAGAGGAAGAAGAG | 23 | 10739 |
| BCL11A-8986 | - | GACGACGAGGAAGAGGAAGAAGAG | 24 | 10740 |
| BCL11A-8987 | - | GAAGAAGAGGAGGAAGAG | 18 | 10741 |
| BCL11A-8988 | - | GGAAGAAGAGGAGGAAGAG | 19 | 10742 |
| BCL11A-3961 | - | AGGAAGAAGAGGAGGAAGAG | 20 | 10743 |
| BCL11A-8989 | - | GAGGAAGAAGAGGAGGAAGAG | 21 | 10744 |
| BCL11A-8990 | - | AGAGGAAGAAGAGGAGGAAGAG | 22 | 10745 |
| BCL11A-8991 | - | AAGAGGAAGAAGAGGAGGAAGAG | 23 | 10746 |
| BCL11A-8992 | - | GAAGAGGAAGAAGAGGAGGAAGAG | 24 | 10747 |
| BCL11A-8993 | - | GGGGACGAGGAGGAAGAG | 18 | 10748 |
| BCL11A-8994 | - | CGGGGACGAGGAGGAAGAG | 19 | 10749 |
| BCL11A-3945 | - | ACGGGGACGAGGAGGAAGAG | 20 | 10750 |
| BCL11A-8995 | - | AACGGGGACGAGGAGGAAGAG | 21 | 10751 |
| BCL11A-8996 | - | GAACGGGGACGAGGAGGAAGAG | 22 | 10752 |
| BCL11A-8997 | - | AGAACGGGGACGAGGAGGAAGAG | 23 | 10753 |
| BCL11A-8998 | - | GAGAACGGGGACGAGGAGGAAGAG | 24 | 10754 |
| BCL11A-8999 | - | CCGGAGAACGGGGACGAG | 18 | 10755 |

TABLE 16E-continued

5th Tier

| gRNA Name | DNA Strand | Targeting Domain | Target Site Length | SEQ ID NO: |
|---|---|---|---|---|
| BCL11A-9000 | − | CCCGGAGAACGGGGACGAG | 19 | 10756 |
| BCL11A-9001 | − | UCCCGGAGAACGGGGACGAG | 20 | 10757 |
| BCL11A-9002 | − | AUCCCGGAGAACGGGGACGAG | 21 | 10758 |
| BCL11A-9003 | − | GAUCCCGGAGAACGGGGACGAG | 22 | 10759 |
| BCL11A-9004 | − | UGAUCCCGGAGAACGGGGACGAG | 23 | 10760 |
| BCL11A-9005 | − | CUGAUCCCGGAGAACGGGGACGAG | 24 | 10761 |
| BCL11A-9006 | − | GACUCGGUGGCCGGCGAG | 18 | 10762 |
| BCL11A-9007 | − | AGACUCGGUGGCCGGCGAG | 19 | 10763 |
| BCL11A-9008 | − | AAGACUCGGUGGCCGGCGAG | 20 | 10764 |
| BCL11A-9009 | − | GAAGACUCGGUGGCCGGCGAG | 21 | 10765 |
| BCL11A-9010 | − | CGAAGACUCGGUGGCCGGCGAG | 22 | 10766 |
| BCL11A-9011 | − | ACGAAGACUCGGUGGCCGGCGAG | 23 | 10767 |
| BCL11A-9012 | − | GACGAAGACUCGGUGGCCGGCGAG | 24 | 10768 |
| BCL11A-9013 | − | AAGCGCAUCAAGCUCGAG | 18 | 10769 |
| BCL11A-9014 | − | UAAGCGCAUCAAGCUCGAG | 19 | 10770 |
| BCL11A-9015 | − | CUAAGCGCAUCAAGCUCGAG | 20 | 10771 |
| BCL11A-9016 | − | UCUAAGCGCAUCAAGCUCGAG | 21 | 10772 |
| BCL11A-9017 | − | CUCUAAGCGCAUCAAGCUCGAG | 22 | 10773 |
| BCL11A-9018 | − | UCUCUAAGCGCAUCAAGCUCGAG | 23 | 10774 |
| BCL11A-9019 | − | UUCUCUAAGCGCAUCAAGCUCGAG | 24 | 10775 |
| BCL11A-9020 | − | GAAGAGGAGGAAGAGGAG | 18 | 10776 |
| BCL11A-9021 | − | AGAAGAGGAGGAAGAGGAG | 19 | 10777 |
| BCL11A-3964 | − | AAGAAGAGGAGGAAGAGGAG | 20 | 10778 |
| BCL11A-9022 | − | GAAGAAGAGGAGGAAGAGGAG | 21 | 10779 |
| BCL11A-9023 | − | GGAAGAAGAGGAGGAAGAGGAG | 22 | 10780 |
| BCL11A-9024 | − | AGGAAGAAGAGGAGGAAGAGGAG | 23 | 10781 |
| BCL11A-9025 | − | GAGGAAGAAGAGGAGGAAGAGGAG | 24 | 10782 |
| BCL11A-9026 | − | GAGGAGGAAGAGGAGGAG | 18 | 10783 |
| BCL11A-9027 | − | AGAGGAGGAAGAGGAGGAG | 19 | 10784 |
| BCL11A-3965 | − | AAGAGGAGGAAGAGGAGGAG | 20 | 10785 |
| BCL11A-9028 | − | GAAGAGGAGGAAGAGGAGGAG | 21 | 10786 |
| BCL11A-9029 | − | AGAAGAGGAGGAAGAGGAGGAG | 22 | 10787 |
| BCL11A-9030 | − | AAGAAGAGGAGGAAGAGGAGGAG | 23 | 10788 |
| BCL11A-9031 | − | GAAGAAGAGGAGGAAGAGGAGGAG | 24 | 10789 |
| BCL11A-9032 | − | UCCACACCGCCCGGGAG | 18 | 10790 |
| BCL11A-9033 | − | CUCCACACCGCCCGGGAG | 19 | 10791 |
| BCL11A-9034 | − | UCUCCACACCGCCCGGGAG | 20 | 10792 |

TABLE 16E-continued

5th Tier

| gRNA Name | DNA Strand | Targeting Domain | Target Site Length | SEQ ID NO: |
|---|---|---|---|---|
| BCL11A-9035 | - | UUCUCCACACCGCCCGGGGAG | 21 | 10793 |
| BCL11A-9036 | - | CUUCUCCACACCGCCCGGGGAG | 22 | 10794 |
| BCL11A-9037 | - | GCUUCUCCACACCGCCCGGGGAG | 23 | 10795 |
| BCL11A-9038 | - | CGCUUCUCCACACCGCCCGGGGAG | 24 | 10796 |
| BCL11A-9039 | - | GCCGCGAUGCCCAACACG | 18 | 10797 |
| BCL11A-9040 | - | GGCCGCGAUGCCCAACACG | 19 | 10798 |
| BCL11A-9041 | - | CGGCCGCGAUGCCCAACACG | 20 | 10799 |
| BCL11A-9042 | - | CCGGCCGCGAUGCCCAACACG | 21 | 10800 |
| BCL11A-9043 | - | CCCGGCCGCGAUGCCCAACACG | 22 | 10801 |
| BCL11A-9044 | - | CCCCGGCCGCGAUGCCCAACACG | 23 | 10802 |
| BCL11A-9045 | - | CCCCCGGCCGCGAUGCCCAACACG | 24 | 10803 |
| BCL11A-9046 | - | AGGAAGAGGAGGACGACG | 18 | 10804 |
| BCL11A-9047 | - | GAGGAAGAGGAGGACGACG | 19 | 10805 |
| BCL11A-3450 | - | GGAGGAAGAGGAGGACGACG | 20 | 10806 |
| BCL11A-9048 | - | AGGAGGAAGAGGAGGACGACG | 21 | 10807 |
| BCL11A-9049 | - | GAGGAGGAAGAGGAGGACGACG | 22 | 10808 |
| BCL11A-9050 | - | CGAGGAGGAAGAGGAGGACGACG | 23 | 10809 |
| BCL11A-9051 | - | ACGAGGAGGAAGAGGAGGACGACG | 24 | 10810 |
| BCL11A-9052 | - | AGGAGGAAGAGGAGGACG | 18 | 10811 |
| BCL11A-9053 | - | GAGGAGGAAGAGGAGGACG | 19 | 10812 |
| BCL11A-3953 | - | CGAGGAGGAAGAGGAGGACG | 20 | 10813 |
| BCL11A-9054 | - | ACGAGGAGGAAGAGGAGGACG | 21 | 10814 |
| BCL11A-9055 | - | GACGAGGAGGAAGAGGAGGACG | 22 | 10815 |
| BCL11A-9056 | - | GGACGAGGAGGAAGAGGAGGACG | 23 | 10816 |
| BCL11A-9057 | - | GGGACGAGGAGGAAGAGGAGGACG | 24 | 10817 |
| BCL11A-9058 | - | UCCCGGAGAACGGGGACG | 18 | 10818 |
| BCL11A-9059 | - | AUCCCGGAGAACGGGGACG | 19 | 10819 |
| BCL11A-6081 | - | GAUCCCGGAGAACGGGGACG | 20 | 10820 |
| BCL11A-9060 | - | UGAUCCCGGAGAACGGGGACG | 21 | 10821 |
| BCL11A-9061 | - | CUGAUCCCGGAGAACGGGGACG | 22 | 10822 |
| BCL11A-9062 | - | CCUGAUCCCGGAGAACGGGGACG | 23 | 10823 |
| BCL11A-9063 | - | ACCUGAUCCCGGAGAACGGGGACG | 24 | 10824 |
| BCL11A-9064 | - | CGCCCGGGGAGCUGGACG | 18 | 10825 |
| BCL11A-9065 | - | CCGCCCGGGGAGCUGGACG | 19 | 10826 |
| BCL11A-9066 | - | ACCGCCCGGGGAGCUGGACG | 20 | 10827 |
| BCL11A-9067 | - | CACCGCCCGGGGAGCUGGACG | 21 | 10828 |
| BCL11A-9068 | - | ACACCGCCCGGGGAGCUGGACG | 22 | 10829 |
| BCL11A-9069 | - | CACACCGCCCGGGGAGCUGGACG | 23 | 10830 |

TABLE 16E-continued

5th Tier

| gRNA Name | DNA Strand | Targeting Domain | Target Site Length | SEQ ID NO: |
|---|---|---|---|---|
| BCL11A-9070 | - | CCACACCGCCCGGGGAGCUGGACG | 24 | 10831 |
| BCL11A-9071 | - | GAGGAGGAGGAGCUGACG | 18 | 10832 |
| BCL11A-9072 | - | GGAGGAGGAGGAGCUGACG | 19 | 10833 |
| BCL11A-9073 | - | AGGAGGAGGAGGAGCUGACG | 20 | 10834 |
| BCL11A-9074 | - | GAGGAGGAGGAGGAGCUGACG | 21 | 10835 |
| BCL11A-9075 | - | AGAGGAGGAGGAGGAGCUGACG | 22 | 10836 |
| BCL11A-9076 | - | AAGAGGAGGAGGAGGAGCUGACG | 23 | 10837 |
| BCL11A-9077 | - | GAAGAGGAGGAGGAGGAGCUGACG | 24 | 10838 |
| BCL11A-9078 | - | GCUUCUCCACACCGCCCG | 18 | 10839 |
| BCL11A-9079 | - | CGCUUCUCCACACCGCCCG | 19 | 10840 |
| BCL11A-6087 | - | GCGCUUCUCCACACCGCCCG | 20 | 10841 |
| BCL11A-9080 | - | UGCGCUUCUCCACACCGCCCG | 21 | 10842 |
| BCL11A-9081 | - | UUGCGCUUCUCCACACCGCCCG | 22 | 10843 |
| BCL11A-9082 | - | UUUGCGCUUCUCCACACCGCCCG | 23 | 10844 |
| BCL11A-9083 | - | GUUUGCGCUUCUCCACACCGCCCG | 24 | 10845 |
| BCL11A-9084 | - | GACCCCAACCUGAUCCCG | 18 | 10846 |
| BCL11A-9085 | - | CGACCCCAACCUGAUCCCG | 19 | 10847 |
| BCL11A-9086 | - | ACGACCCCAACCUGAUCCCG | 20 | 10848 |
| BCL11A-9087 | - | AACGACCCCAACCUGAUCCCG | 21 | 10849 |
| BCL11A-9088 | - | GAACGACCCCAACCUGAUCCCG | 22 | 10850 |
| BCL11A-9089 | - | AGAACGACCCCAACCUGAUCCCG | 23 | 10851 |
| BCL11A-9090 | - | GAGAACGACCCCAACCUGAUCCCG | 24 | 10852 |
| BCL11A-9091 | - | CGGUCGUGGGCGUGGGCG | 18 | 10853 |
| BCL11A-9092 | - | GCGGUCGUGGGCGUGGGCG | 19 | 10854 |
| BCL11A-9093 | - | CGCGGUCGUGGGCGUGGGCG | 20 | 10855 |
| BCL11A-9094 | - | GCGCGGUCGUGGGCGUGGGCG | 21 | 10856 |
| BCL11A-9095 | - | GGCGCGGUCGUGGGCGUGGGCG | 22 | 10857 |
| BCL11A-9096 | - | GGGCGCGGUCGUGGGCGUGGGCG | 23 | 10858 |
| BCL11A-9097 | - | GGGGCGCGGUCGUGGGCGUGGGCG | 24 | 10859 |
| BCL11A-9098 | - | GCCACAGGGACACUUGCG | 18 | 10860 |
| BCL11A-9099 | - | GGCCACAGGGACACUUGCG | 19 | 10861 |
| BCL11A-9100 | - | GGGCCACAGGGACACUUGCG | 20 | 10862 |
| BCL11A-9101 | - | AGGGCCACAGGGACACUUGCG | 21 | 10863 |
| BCL11A-9102 | - | GAGGGCCACAGGGACACUUGCG | 22 | 10864 |
| BCL11A-9103 | - | CGAGGGCCACAGGGACACUUGCG | 23 | 10865 |
| BCL11A-9104 | - | CCGAGGGCCACAGGGACACUUGCG | 24 | 10866 |
| BCL11A-9105 | - | CCGGGCGAGUCGGCCUCG | 18 | 10867 |

TABLE 16E-continued

5th Tier

| gRNA Name | DNA Strand | Targeting Domain | Target Site Length | SEQ ID NO: |
|---|---|---|---|---|
| BCL11A-9106 | - | CCCGGGCGAGUCGGCCUCG | 19 | 10868 |
| BCL11A-6106 | - | CCCCGGGCGAGUCGGCCUCG | 20 | 10869 |
| BCL11A-9107 | - | UCCCCGGGCGAGUCGGCCUCG | 21 | 10870 |
| BCL11A-9108 | - | CUCCCCGGGCGAGUCGGCCUCG | 22 | 10871 |
| BCL11A-9109 | - | GCUCCCCGGGCGAGUCGGCCUCG | 23 | 10872 |
| BCL11A-9110 | - | UGCUCCCCGGGCGAGUCGGCCUCG | 24 | 10873 |
| BCL11A-9111 | - | UCGUCGGAGCACUCCUCG | 18 | 10874 |
| BCL11A-9112 | - | CUCGUCGGAGCACUCCUCG | 19 | 10875 |
| BCL11A-9113 | - | CCUCGUCGGAGCACUCCUCG | 20 | 10876 |
| BCL11A-9114 | - | UCCUCGUCGGAGCACUCCUCG | 21 | 10877 |
| BCL11A-9115 | - | CUCCUCGUCGGAGCACUCCUCG | 22 | 10878 |
| BCL11A-9116 | - | CCUCCUCGUCGGAGCACUCCUCG | 23 | 10879 |
| BCL11A-9117 | - | GCCUCCUCGUCGGAGCACUCCUCG | 24 | 10880 |
| BCL11A-9118 | - | UCGCCUUUUGCCUCCUCG | 18 | 10881 |
| BCL11A-9119 | - | AUCGCCUUUUGCCUCCUCG | 19 | 10882 |
| BCL11A-9120 | - | AAUCGCCUUUUGCCUCCUCG | 20 | 10883 |
| BCL11A-9121 | - | CAAUCGCCUUUUGCCUCCUCG | 21 | 10884 |
| BCL11A-9122 | - | ACAAUCGCCUUUUGCCUCCUCG | 22 | 10885 |
| BCL11A-9123 | - | GACAAUCGCCUUUUGCCUCCUCG | 23 | 10886 |
| BCL11A-9124 | - | AGACAAUCGCCUUUUGCCUCCUCG | 24 | 10887 |
| BCL11A-9125 | - | CACCACGAGAACAGCUCG | 18 | 10888 |
| BCL11A-9126 | - | CCACCACGAGAACAGCUCG | 19 | 10889 |
| BCL11A-6107 | - | GCCACCACGAGAACAGCUCG | 20 | 10890 |
| BCL11A-9127 | - | CGCCACCACGAGAACAGCUCG | 21 | 10891 |
| BCL11A-9128 | - | GCGCCACCACGAGAACAGCUCG | 22 | 10892 |
| BCL11A-9129 | - | CGCGCCACCACGAGAACAGCUCG | 23 | 10893 |
| BCL11A-9130 | - | GCGCGCCACCACGAGAACAGCUCG | 24 | 10894 |
| BCL11A-9131 | - | CUGGGCAGCCCCAGCUCG | 18 | 10895 |
| BCL11A-9132 | - | GCUGGGCAGCCCCAGCUCG | 19 | 10896 |
| BCL11A-9133 | - | UGCUGGGCAGCCCCAGCUCG | 20 | 10897 |
| BCL11A-9134 | - | CUGCUGGGCAGCCCCAGCUCG | 21 | 10898 |
| BCL11A-9135 | - | GCUGCUGGGCAGCCCCAGCUCG | 22 | 10899 |
| BCL11A-9136 | - | UGCUGCUGGGCAGCCCCAGCUCG | 23 | 10900 |
| BCL11A-9137 | - | CUGCUGCUGGGCAGCCCCAGCUCG | 24 | 10901 |
| BCL11A-9138 | - | AGGAAGAGGAAGAAGAGG | 18 | 10902 |
| BCL11A-9139 | - | GAGGAAGAGGAAGAAGAGG | 19 | 10903 |
| BCL11A-3451 | - | CGAGGAAGAGGAAGAAGAGG | 20 | 10904 |
| BCL11A-9140 | - | ACGAGGAAGAGGAAGAAGAGG | 21 | 10905 |

TABLE 16E-continued

5th Tier

| gRNA Name | DNA Strand | Targeting Domain | Target Site Length | SEQ ID NO: |
|---|---|---|---|---|
| BCL11A-9141 | - | GACGAGGAAGAGGAAGAAGAGG | 22 | 10906 |
| BCL11A-9142 | - | CGACGAGGAAGAGGAAGAAGAGG | 23 | 10907 |
| BCL11A-9143 | - | ACGACGAGGAAGAGGAAGAAGAGG | 24 | 10908 |
| BCL11A-9144 | - | AGGACGACGAGGAAGAGG | 18 | 10909 |
| BCL11A-9145 | - | GAGGACGACGAGGAAGAGG | 19 | 10910 |
| BCL11A-3957 | - | GGAGGACGACGAGGAAGAGG | 20 | 10911 |
| BCL11A-9146 | - | AGGAGGACGACGAGGAAGAGG | 21 | 10912 |
| BCL11A-9147 | - | GAGGAGGACGACGAGGAAGAGG | 22 | 10913 |
| BCL11A-9148 | - | AGAGGAGGACGACGAGGAAGAGG | 23 | 10914 |
| BCL11A-9149 | - | AAGAGGAGGACGACGAGGAAGAGG | 24 | 10915 |
| BCL11A-9150 | - | AAGAAGAGGAGGAAGAGG | 18 | 10916 |
| BCL11A-9151 | - | GAAGAAGAGGAGGAAGAGG | 19 | 10917 |
| BCL11A-3452 | - | GGAAGAAGAGGAGGAAGAGG | 20 | 10918 |
| BCL11A-9152 | - | AGGAAGAAGAGGAGGAAGAGG | 21 | 10919 |
| BCL11A-9153 | - | GAGGAAGAAGAGGAGGAAGAGG | 22 | 10920 |
| BCL11A-9154 | - | AGAGGAAGAAGAGGAGGAAGAGG | 23 | 10921 |
| BCL11A-9155 | - | AAGAGGAAGAAGAGGAGGAAGAGG | 24 | 10922 |
| BCL11A-9156 | - | CUGACGGAGAGCGAGAGG | 18 | 10923 |
| BCL11A-9157 | - | GCUGACGGAGAGCGAGAGG | 19 | 10924 |
| BCL11A-9158 | - | AGCUGACGGAGAGCGAGAGG | 20 | 10925 |
| BCL11A-9159 | - | GAGCUGACGGAGAGCGAGAGG | 21 | 10926 |
| BCL11A-9160 | - | GGAGCUGACGGAGAGCGAGAGG | 22 | 10927 |
| BCL11A-9161 | - | AGGAGCUGACGGAGAGCGAGAGG | 23 | 10928 |
| BCL11A-9162 | - | GAGGAGCUGACGGAGAGCGAGAGG | 24 | 10929 |
| BCL11A-9163 | - | AAGAGGAGGACGACGAGG | 18 | 10930 |
| BCL11A-9164 | - | GAAGAGGAGGACGACGAGG | 19 | 10931 |
| BCL11A-3960 | - | GGAAGAGGAGGACGACGAGG | 20 | 10932 |
| BCL11A-9165 | - | AGGAAGAGGAGGACGACGAGG | 21 | 10933 |
| BCL11A-9166 | - | GAGGAAGAGGAGGACGACGAGG | 22 | 10934 |
| BCL11A-9167 | - | GGAGGAAGAGGAGGACGACGAGG | 23 | 10935 |
| BCL11A-9168 | - | AGGAGGAAGAGGAGGACGACGAGG | 24 | 10936 |
| BCL11A-9169 | - | CGGAGAACGGGGACGAGG | 18 | 10937 |
| BCL11A-9170 | - | CCGGAGAACGGGGACGAGG | 19 | 10938 |
| BCL11A-3330 | - | CCCGGAGAACGGGGACGAGG | 20 | 10939 |
| BCL11A-9171 | - | UCCCGGAGAACGGGGACGAGG | 21 | 10940 |
| BCL11A-9172 | - | AUCCCGGAGAACGGGGACGAGG | 22 | 10941 |
| BCL11A-9173 | - | GAUCCCGGAGAACGGGGACGAGG | 23 | 10942 |

TABLE 16E-continued

5th Tier

| gRNA Name | DNA Strand | Targeting Domain | Target Site Length | SEQ ID NO: |
|---|---|---|---|---|
| BCL11A-9174 | - | UGAUCCCGGAGAACGGGGACGAGG | 24 | 10943 |
| BCL11A-9175 | - | GCGGCCACCUGGCCGAGG | 18 | 10944 |
| BCL11A-9176 | - | CGCGGCCACCUGGCCGAGG | 19 | 10945 |
| BCL11A-9177 | - | GCGCGGCCACCUGGCCGAGG | 20 | 10946 |
| BCL11A-9178 | - | AGCGCGGCCACCUGGCCGAGG | 21 | 10947 |
| BCL11A-9179 | - | AAGCGCGGCCACCUGGCCGAGG | 22 | 10948 |
| BCL11A-9180 | - | UAAGCGCGGCCACCUGGCCGAGG | 23 | 10949 |
| BCL11A-9181 | - | AUAAGCGCGGCCACCUGGCCGAGG | 24 | 10950 |
| BCL11A-9182 | - | AAGAGGAAGAAGAGGAGG | 18 | 10951 |
| BCL11A-9183 | - | GAAGAGGAAGAAGAGGAGG | 19 | 10952 |
| BCL11A-3963 | - | GGAAGAGGAAGAAGAGGAGG | 20 | 10953 |
| BCL11A-9184 | - | AGGAAGAGGAAGAAGAGGAGG | 21 | 10954 |
| BCL11A-9185 | - | GAGGAAGAGGAAGAAGAGGAGG | 22 | 10955 |
| BCL11A-9186 | - | CGAGGAAGAGGAAGAAGAGGAGG | 23 | 10956 |
| BCL11A-9187 | - | ACGAGGAAGAGGAAGAAGAGGAGG | 24 | 10957 |
| BCL11A-9188 | - | AAGAGGAGGAAGAGGAGG | 18 | 10958 |
| BCL11A-9189 | - | GAAGAGGAGGAAGAGGAGG | 19 | 10959 |
| BCL11A-3454 | - | AGAAGAGGAGGAAGAGGAGG | 20 | 10960 |
| BCL11A-9190 | - | AAGAAGAGGAGGAAGAGGAGG | 21 | 10961 |
| BCL11A-9191 | - | GAAGAAGAGGAGGAAGAGGAGG | 22 | 10962 |
| BCL11A-9192 | - | GGAAGAAGAGGAGGAAGAGGAGG | 23 | 10963 |
| BCL11A-9193 | - | AGGAAGAAGAGGAGGAAGAGGAGG | 24 | 10964 |
| BCL11A-9194 | - | AGAACGGGGACGAGGAGG | 18 | 10965 |
| BCL11A-9195 | - | GAGAACGGGGACGAGGAGG | 19 | 10966 |
| BCL11A-3918 | - | GGAGAACGGGGACGAGGAGG | 20 | 10967 |
| BCL11A-9196 | - | CGGAGAACGGGGACGAGGAGG | 21 | 10968 |
| BCL11A-9197 | - | CCGGAGAACGGGGACGAGGAGG | 22 | 10969 |
| BCL11A-9198 | - | CCCGGAGAACGGGGACGAGGAGG | 23 | 10970 |
| BCL11A-9199 | - | UCCCGGAGAACGGGGACGAGGAGG | 24 | 10971 |
| BCL11A-9200 | - | AGGAGGAAGAGGAGGAGG | 18 | 10972 |
| BCL11A-9201 | - | GAGGAGGAAGAGGAGGAGG | 19 | 10973 |
| BCL11A-3455 | - | AGAGGAGGAAGAGGAGGAGG | 20 | 10974 |
| BCL11A-9202 | - | AAGAGGAGGAAGAGGAGGAGG | 21 | 10975 |
| BCL11A-9203 | - | GAAGAGGAGGAAGAGGAGGAGG | 22 | 10976 |
| BCL11A-9204 | - | AGAAGAGGAGGAAGAGGAGGAGG | 23 | 10977 |
| BCL11A-9205 | - | AAGAAGAGGAGGAAGAGGAGGAGG | 24 | 10978 |
| BCL11A-9206 | - | ACCGGCGCAGCCACACGG | 18 | 10979 |
| BCL11A-9207 | - | CACCGGCGCAGCCACACGG | 19 | 10980 |

TABLE 16E-continued

5th Tier

| gRNA Name | DNA Strand | Targeting Domain | Target Site Length | SEQ ID NO: |
|---|---|---|---|---|
| BCL11A-3764 | - | GCACCGGCGCAGCCACACGG | 20 | 10981 |
| BCL11A-9208 | - | UGCACCGGCGCAGCCACACGG | 21 | 10982 |
| BCL11A-9209 | - | GUGCACCGGCGCAGCCACACGG | 22 | 10983 |
| BCL11A-9210 | - | GGUGCACCGGCGCAGCCACACGG | 23 | 10984 |
| BCL11A-9211 | - | UGGUGCACCGGCGCAGCCACACGG | 24 | 10985 |
| BCL11A-9212 | - | UAGAGCGCCUGGGGCGG | 18 | 10986 |
| BCL11A-9213 | - | AUAGAGCGCCUGGGGCGG | 19 | 10987 |
| BCL11A-9214 | - | CAUAGAGCGCCUGGGGCGG | 20 | 10988 |
| BCL11A-9215 | - | GCAUAGAGCGCCUGGGGCGG | 21 | 10989 |
| BCL11A-9216 | - | CGCAUAGAGCGCCUGGGGCGG | 22 | 10990 |
| BCL11A-9217 | - | CCGCAUAGAGCGCCUGGGGCGG | 23 | 10991 |
| BCL11A-9218 | - | ACCGCAUAGAGCGCCUGGGGCGG | 24 | 10992 |
| BCL11A-9219 | - | AUGUGUGGCAGUUUUCGG | 18 | 10993 |
| BCL11A-9220 | - | GAUGUGUGGCAGUUUUCGG | 19 | 10994 |
| BCL11A-9221 | - | AGAUGUGUGGCAGUUUUCGG | 20 | 10995 |
| BCL11A-9222 | - | AAGAUGUGUGGCAGUUUUCGG | 21 | 10996 |
| BCL11A-9223 | - | CAAGAUGUGUGGCAGUUUUCGG | 22 | 10997 |
| BCL11A-9224 | - | UCAAGAUGUGUGGCAGUUUUCGG | 23 | 10998 |
| BCL11A-9225 | - | CUCAAGAUGUGUGGCAGUUUUCGG | 24 | 10999 |
| BCL11A-9226 | - | AAUUUGAAGCCCCCAGGG | 18 | 11000 |
| BCL11A-9227 | - | AAAUUUGAAGCCCCCAGGG | 19 | 11001 |
| BCL11A-9228 | - | AAAAUUUGAAGCCCCCAGGG | 20 | 11002 |
| BCL11A-9229 | - | GAAAAUUUGAAGCCCCCAGGG | 21 | 11003 |
| BCL11A-9230 | - | AGAAAAUUUGAAGCCCCCAGGG | 22 | 11004 |
| BCL11A-9231 | - | GAGAAAAUUUGAAGCCCCCAGGG | 23 | 11005 |
| BCL11A-9232 | - | UGAGAAAAUUUGAAGCCCCCAGGG | 24 | 11006 |
| BCL11A-9233 | - | GUGGACUACGGCUUCGGG | 18 | 11007 |
| BCL11A-9234 | - | GGUGGACUACGGCUUCGGG | 19 | 11008 |
| BCL11A-9235 | - | GGGUGGACUACGGCUUCGGG | 20 | 11009 |
| BCL11A-9236 | - | AGGGUGGACUACGGCUUCGGG | 21 | 11010 |
| BCL11A-9237 | - | GAGGGUGGACUACGGCUUCGGG | 22 | 11011 |
| BCL11A-9238 | - | AGAGGGUGGACUACGGCUUCGGG | 23 | 11012 |
| BCL11A-9239 | - | GAGAGGGUGGACUACGGCUUCGGG | 24 | 11013 |
| BCL11A-9240 | - | UGAUCCCGGAGAACGGGG | 18 | 11014 |
| BCL11A-9241 | - | CUGAUCCCGGAGAACGGGG | 19 | 11015 |
| BCL11A-9242 | - | CCUGAUCCCGGAGAACGGGG | 20 | 11016 |
| BCL11A-9243 | - | ACCUGAUCCCGGAGAACGGGG | 21 | 11017 |

TABLE 16E-continued

5th Tier

| gRNA Name | DNA Strand | Targeting Domain | Target Site Length | SEQ ID NO: |
|---|---|---|---|---|
| BCL11A-9244 | - | AACCUGAUCCCGGAGAACGGGG | 22 | 11018 |
| BCL11A-9245 | - | CAACCUGAUCCCGGAGAACGGGG | 23 | 11019 |
| BCL11A-9246 | - | CCAACCUGAUCCCGGAGAACGGGG | 24 | 11020 |
| BCL11A-9247 | - | GCAUAGAGCGCCUGGGGG | 18 | 11021 |
| BCL11A-9248 | - | CGCAUAGAGCGCCUGGGGG | 19 | 11022 |
| BCL11A-6143 | - | CCGCAUAGAGCGCCUGGGGG | 20 | 11023 |
| BCL11A-9249 | - | ACCGCAUAGAGCGCCUGGGGG | 21 | 11024 |
| BCL11A-9250 | - | CACCGCAUAGAGCGCCUGGGGG | 22 | 11025 |
| BCL11A-9251 | - | CCACCGCAUAGAGCGCCUGGGGG | 23 | 11026 |
| BCL11A-9252 | - | CCCACCGCAUAGAGCGCCUGGGGG | 24 | 11027 |
| BCL11A-9253 | - | CGCAUAGAGCGCCUGGGG | 18 | 11028 |
| BCL11A-9254 | - | CCGCAUAGAGCGCCUGGGG | 19 | 11029 |
| BCL11A-9255 | - | ACCGCAUAGAGCGCCUGGGG | 20 | 11030 |
| BCL11A-9256 | - | CACCGCAUAGAGCGCCUGGGG | 21 | 11031 |
| BCL11A-9257 | - | CCACCGCAUAGAGCGCCUGGGG | 22 | 11032 |
| BCL11A-9258 | - | CCCACCGCAUAGAGCGCCUGGGG | 23 | 11033 |
| BCL11A-9259 | - | CCCCACCGCAUAGAGCGCCUGGGG | 24 | 11034 |
| BCL11A-9260 | - | AUAAGCGCGGCCACCUGG | 18 | 11035 |
| BCL11A-9261 | - | CAUAAGCGCGGCCACCUGG | 19 | 11036 |
| BCL11A-9262 | - | GCAUAAGCGCGGCCACCUGG | 20 | 11037 |
| BCL11A-9263 | - | AGCAUAAGCGCGGCCACCUGG | 21 | 11038 |
| BCL11A-9264 | - | AAGCAUAAGCGCGGCCACCUGG | 22 | 11039 |
| BCL11A-9265 | - | GAAGCAUAAGCGCGGCCACCUGG | 23 | 11040 |
| BCL11A-9266 | - | AGAAGCAUAAGCGCGGCCACCUGG | 24 | 11041 |
| BCL11A-9267 | - | GAGAGGCUUCCGGCCUGG | 18 | 11042 |
| BCL11A-9268 | - | AGAGAGGCUUCCGGCCUGG | 19 | 11043 |
| BCL11A-9269 | - | GAGAGAGGCUUCCGGCCUGG | 20 | 11044 |
| BCL11A-9270 | - | CGAGAGAGGCUUCCGGCCUGG | 21 | 11045 |
| BCL11A-9271 | - | UCGAGAGAGGCUUCCGGCCUGG | 22 | 11046 |
| BCL11A-9272 | - | AUCGAGAGAGGCUUCCGGCCUGG | 23 | 11047 |
| BCL11A-9273 | - | UAUCGAGAGAGGCUUCCGGCCUGG | 24 | 11048 |
| BCL11A-9274 | - | CCUUCCACCAGGUCCUGG | 18 | 11049 |
| BCL11A-9275 | - | GCCUUCCACCAGGUCCUGG | 19 | 11050 |
| BCL11A-9276 | - | GGCCUUCCACCAGGUCCUGG | 20 | 11051 |
| BCL11A-9277 | - | AGGCCUUCCACCAGGUCCUGG | 21 | 11052 |
| BCL11A-9278 | - | GAGGCCUUCCACCAGGUCCUGG | 22 | 11053 |
| BCL11A-9279 | - | CGAGGCCUUCCACCAGGUCCUGG | 23 | 11054 |
| BCL11A-9280 | - | GCGAGGCCUUCCACCAGGUCCUGG | 24 | 11055 |

TABLE 16E-continued

5th Tier

| gRNA Name | DNA Strand | Targeting Domain | Target Site Length | SEQ ID NO: |
|---|---|---|---|---|
| BCL11A-9281 | − | GGAGACUUAGAGAGCUGG | 18 | 11056 |
| BCL11A-9282 | − | AGGAGACUUAGAGAGCUGG | 19 | 11057 |
| BCL11A-9283 | − | UAGGAGACUUAGAGAGCUGG | 20 | 11058 |
| BCL11A-9284 | − | CUAGGAGACUUAGAGAGCUGG | 21 | 11059 |
| BCL11A-9285 | − | UCUAGGAGACUUAGAGAGCUGG | 22 | 11060 |
| BCL11A-9286 | − | CUCUAGGAGACUUAGAGAGCUGG | 23 | 11061 |
| BCL11A-9287 | − | UCUCUAGGAGACUUAGAGAGCUGG | 24 | 11062 |
| BCL11A-9288 | − | CACCGCCCGGGGAGCUGG | 18 | 11063 |
| BCL11A-9289 | − | ACACCGCCCGGGGAGCUGG | 19 | 11064 |
| BCL11A-9290 | − | CACACCGCCCGGGGAGCUGG | 20 | 11065 |
| BCL11A-9291 | − | CCACACCGCCCGGGGAGCUGG | 21 | 11066 |
| BCL11A-9292 | − | UCCACACCGCCCGGGGAGCUGG | 22 | 11067 |
| BCL11A-9293 | − | CUCCACACCGCCCGGGGAGCUGG | 23 | 11068 |
| BCL11A-9294 | − | UCUCCACACCGCCCGGGGAGCUGG | 24 | 11069 |
| BCL11A-9295 | − | CAGCGGCACGGGAAGUGG | 18 | 11070 |
| BCL11A-9296 | − | GCAGCGGCACGGGAAGUGG | 19 | 11071 |
| BCL11A-6157 | − | CGCAGCGGCACGGGAAGUGG | 20 | 11072 |
| BCL11A-9297 | − | GCGCAGCGGCACGGGAAGUGG | 21 | 11073 |
| BCL11A-9298 | − | GGCGCAGCGGCACGGGAAGUGG | 22 | 11074 |
| BCL11A-9299 | − | GGGCGCAGCGGCACGGGAAGUGG | 23 | 11075 |
| BCL11A-9300 | − | GGGGCGCAGCGGCACGGGAAGUGG | 24 | 11076 |
| BCL11A-9301 | − | GCCCUGCCCGACGUCAUG | 18 | 11077 |
| BCL11A-9302 | − | CGCCCUGCCCGACGUCAUG | 19 | 11078 |
| BCL11A-9303 | − | GCGCCCUGCCCGACGUCAUG | 20 | 11079 |
| BCL11A-9304 | − | CGCGCCCUGCCCGACGUCAUG | 21 | 11080 |
| BCL11A-9305 | − | CCGCGCCCUGCCCGACGUCAUG | 22 | 11081 |
| BCL11A-9306 | − | GCCGCGCCCUGCCCGACGUCAUG | 23 | 11082 |
| BCL11A-9307 | − | AGCCGCGCCCUGCCCGACGUCAUG | 24 | 11083 |
| BCL11A-9308 | − | CGACACUUGUGAGUACUG | 18 | 11084 |
| BCL11A-9309 | − | GCGACACUUGUGAGUACUG | 19 | 11085 |
| BCL11A-6169 | − | AGCGACACUUGUGAGUACUG | 20 | 11086 |
| BCL11A-9310 | − | CAGCGACACUUGUGAGUACUG | 21 | 11087 |
| BCL11A-9311 | − | GCAGCGACACUUGUGAGUACUG | 22 | 11088 |
| BCL11A-9312 | − | CGCAGCGACACUUGUGAGUACUG | 23 | 11089 |
| BCL11A-9313 | − | ACGCAGCGACACUUGUGAGUACUG | 24 | 11090 |
| BCL11A-9314 | − | GAGGAGGAGGAGGAGCUG | 18 | 11091 |
| BCL11A-9315 | − | AGAGGAGGAGGAGGAGCUG | 19 | 11092 |

TABLE 16E-continued

5th Tier

| gRNA Name | DNA Strand | Targeting Domain | Target Site Length | SEQ ID NO: |
|---|---|---|---|---|
| BCL11A-9316 | - | AAGAGGAGGAGGAGGAGCUG | 20 | 11093 |
| BCL11A-9317 | - | GAAGAGGAGGAGGAGGAGCUG | 21 | 11094 |
| BCL11A-9318 | - | GGAAGAGGAGGAGGAGGAGCUG | 22 | 11095 |
| BCL11A-9319 | - | AGGAAGAGGAGGAGGAGGAGCUG | 23 | 11096 |
| BCL11A-9320 | - | GAGGAAGAGGAGGAGGAGGAGCUG | 24 | 11097 |
| BCL11A-9321 | - | CUGUCCAAAAAGCUGCUG | 18 | 11098 |
| BCL11A-9322 | - | CCUGUCCAAAAAGCUGCUG | 19 | 11099 |
| BCL11A-9323 | - | GCCUGUCCAAAAAGCUGCUG | 20 | 11100 |
| BCL11A-9324 | - | GGCCUGUCCAAAAAGCUGCUG | 21 | 11101 |
| BCL11A-9325 | - | GGGCCUGUCCAAAAAGCUGCUG | 22 | 11102 |
| BCL11A-9326 | - | GGGGCCUGUCCAAAAAGCUGCUG | 23 | 11103 |
| BCL11A-9327 | - | GGGGGCCUGUCCAAAAAGCUGCUG | 24 | 11104 |
| BCL11A-9328 | - | GCAGCGGCACGGGAAGUG | 18 | 11105 |
| BCL11A-9329 | - | CGCAGCGGCACGGGAAGUG | 19 | 11106 |
| BCL11A-9330 | - | GCGCAGCGGCACGGGAAGUG | 20 | 11107 |
| BCL11A-9331 | - | GGCGCAGCGGCACGGGAAGUG | 21 | 11108 |
| BCL11A-9332 | - | GGGCGCAGCGGCACGGGAAGUG | 22 | 11109 |
| BCL11A-9333 | - | GGGGCGCAGCGGCACGGGAAGUG | 23 | 11110 |
| BCL11A-9334 | - | CGGGGCGCAGCGGCACGGGAAGUG | 24 | 11111 |
| BCL11A-9335 | - | CCCGGCACCAGCGACUUG | 18 | 11112 |
| BCL11A-9336 | - | ACCCGGCACCAGCGACUUG | 19 | 11113 |
| BCL11A-9337 | - | AACCCGGCACCAGCGACUUG | 20 | 11114 |
| BCL11A-9338 | - | GAACCCGGCACCAGCGACUUG | 21 | 11115 |
| BCL11A-9339 | - | GGAACCCGGCACCAGCGACUUG | 22 | 11116 |
| BCL11A-9340 | - | CGGAACCCGGCACCAGCGACUUG | 23 | 11117 |
| BCL11A-9341 | - | CCGGAACCCGGCACCAGCGACUUG | 24 | 11118 |
| BCL11A-9342 | - | CUUAAGUUCUGAGAAAAU | 18 | 11119 |
| BCL11A-9343 | - | CCUUAAGUUCUGAGAAAAU | 19 | 11120 |
| BCL11A-9344 | - | CCCUUAAGUUCUGAGAAAAU | 20 | 11121 |
| BCL11A-9345 | - | GCCCUUAAGUUCUGAGAAAAU | 21 | 11122 |
| BCL11A-9346 | - | AGCCCUUAAGUUCUGAGAAAAU | 22 | 11123 |
| BCL11A-9347 | - | GAGCCCUUAAGUUCUGAGAAAAU | 23 | 11124 |
| BCL11A-9348 | - | AGAGCCCUUAAGUUCUGAGAAAAU | 24 | 11125 |
| BCL11A-9349 | - | GGAUUUCUCUAGGAGACU | 18 | 11126 |
| BCL11A-9350 | - | UGGAUUUCUCUAGGAGACU | 19 | 11127 |
| BCL11A-9351 | - | AUGGAUUUCUCUAGGAGACU | 20 | 11128 |
| BCL11A-9352 | - | CAUGGAUUUCUCUAGGAGACU | 21 | 11129 |
| BCL11A-9353 | - | CCAUGGAUUUCUCUAGGAGACU | 22 | 11130 |

TABLE 16E-continued

5th Tier

| gRNA Name | DNA Strand | Targeting Domain | Target Site Length | SEQ ID NO: |
|---|---|---|---|---|
| BCL11A-9354 | − | GCCAUGGAUUUCUCUAGGAGACU | 23 | 11131 |
| BCL11A-9355 | − | CGCCAUGGAUUUCUCUAGGAGACU | 24 | 11132 |
| BCL11A-9356 | − | AUGGAUUAAGAAUCUACU | 18 | 11133 |
| BCL11A-9357 | − | CAUGGAUUAAGAAUCUACU | 19 | 11134 |
| BCL11A-9358 | − | UCAUGGAUUAAGAAUCUACU | 20 | 11135 |
| BCL11A-9359 | − | CUCAUGGAUUAAGAAUCUACU | 21 | 11136 |
| BCL11A-9360 | − | ACUCAUGGAUUAAGAAUCUACU | 22 | 11137 |
| BCL11A-9361 | − | CACUCAUGGAUUAAGAAUCUACU | 23 | 11138 |
| BCL11A-9362 | − | ACACUCAUGGAUUAAGAAUCUACU | 24 | 11139 |
| BCL11A-9363 | − | GCGACACUUGUGAGUACU | 18 | 11140 |
| BCL11A-9364 | − | AGCGACACUUGUGAGUACU | 19 | 11141 |
| BCL11A-9365 | − | CAGCGACACUUGUGAGUACU | 20 | 11142 |
| BCL11A-9366 | − | GCAGCGACACUUGUGAGUACU | 21 | 11143 |
| BCL11A-9367 | − | CGCAGCGACACUUGUGAGUACU | 22 | 11144 |
| BCL11A-9368 | − | ACGCAGCGACACUUGUGAGUACU | 23 | 11145 |
| BCL11A-9369 | − | GACGCAGCGACACUUGUGAGUACU | 24 | 11146 |
| BCL11A-9370 | − | CCACCGCAUAGAGCGCCU | 18 | 11147 |
| BCL11A-9371 | − | CCCACCGCAUAGAGCGCCU | 19 | 11148 |
| BCL11A-6197 | − | CCCCACCGCAUAGAGCGCCU | 20 | 11149 |
| BCL11A-9372 | − | CCCCCACCGCAUAGAGCGCCU | 21 | 11150 |
| BCL11A-9373 | − | ACCCCCACCGCAUAGAGCGCCU | 22 | 11151 |
| BCL11A-9374 | − | GACCCCCACCGCAUAGAGCGCCU | 23 | 11152 |
| BCL11A-9375 | − | GGACCCCCACCGCAUAGAGCGCCU | 24 | 11153 |
| BCL11A-9376 | − | CCCCGGGCGAGUCGGCCU | 18 | 11154 |
| BCL11A-9377 | − | UCCCCGGGCGAGUCGGCCU | 19 | 11155 |
| BCL11A-6200 | − | CUCCCCGGGCGAGUCGGCCU | 20 | 11156 |
| BCL11A-9378 | − | GCUCCCCGGGCGAGUCGGCCU | 21 | 11157 |
| BCL11A-9379 | − | UGCUCCCCGGGCGAGUCGGCCU | 22 | 11158 |
| BCL11A-9380 | − | CUGCUCCCCGGGCGAGUCGGCCU | 23 | 11159 |
| BCL11A-9381 | − | GCUGCUCCCCGGGCGAGUCGGCCU | 24 | 11160 |
| BCL11A-9382 | − | CCUCGUCGGAGCACUCCU | 18 | 11161 |
| BCL11A-9383 | − | UCCUCGUCGGAGCACUCCU | 19 | 11162 |
| BCL11A-6202 | − | CUCCUCGUCGGAGCACUCCU | 20 | 11163 |
| BCL11A-9384 | − | CCUCCUCGUCGGAGCACUCCU | 21 | 11164 |
| BCL11A-9385 | − | GCCUCCUCGUCGGAGCACUCCU | 22 | 11165 |
| BCL11A-9386 | − | UGCCUCCUCGUCGGAGCACUCCU | 23 | 11166 |
| BCL11A-9387 | − | UUGCCUCCUCGUCGGAGCACUCCU | 24 | 11167 |

TABLE 16E-continued

5th Tier

| gRNA Name | DNA Strand | Targeting Domain | Target Site Length | SEQ ID NO: |
|---|---|---|---|---|
| BCL11A-9388 | - | AAGAUCCCUUCCUUAGCU | 18 | 11168 |
| BCL11A-9389 | - | AAAGAUCCCUUCCUUAGCU | 19 | 11169 |
| BCL11A-9390 | - | CAAAGAUCCCUUCCUUAGCU | 20 | 11170 |
| BCL11A-9391 | - | UCAAAGAUCCCUUCCUUAGCU | 21 | 11171 |
| BCL11A-9392 | - | CUCAAAGAUCCCUUCCUUAGCU | 22 | 11172 |
| BCL11A-9393 | - | GCUCAAAGAUCCCUUCCUUAGCU | 23 | 11173 |
| BCL11A-9394 | - | AGCUCAAAGAUCCCUUCCUUAGCU | 24 | 11174 |
| BCL11A-9395 | - | AGAGGGUGGACUACGGCU | 18 | 11175 |
| BCL11A-9396 | - | GAGAGGGUGGACUACGGCU | 19 | 11176 |
| BCL11A-9397 | - | CGAGAGGGUGGACUACGGCU | 20 | 11177 |
| BCL11A-9398 | - | GCGAGAGGGUGGACUACGGCU | 21 | 11178 |
| BCL11A-9399 | - | AGCGAGAGGGUGGACUACGGCU | 22 | 11179 |
| BCL11A-9400 | - | GAGCGAGAGGGUGGACUACGGCU | 23 | 11180 |
| BCL11A-9401 | - | AGAGCGAGAGGGUGGACUACGGCU | 24 | 11181 |
| BCL11A-9402 | - | CGGUUGAAUCCAAUGGCU | 18 | 11182 |
| BCL11A-9403 | - | GCGGUUGAAUCCAAUGGCU | 19 | 11183 |
| BCL11A-9404 | - | UGCGGUUGAAUCCAAUGGCU | 20 | 11184 |
| BCL11A-9405 | - | CUGCGGUUGAAUCCAAUGGCU | 21 | 11185 |
| BCL11A-9406 | - | GCUGCGGUUGAAUCCAAUGGCU | 22 | 11186 |
| BCL11A-9407 | - | UGCUGCGGUUGAAUCCAAUGGCU | 23 | 11187 |
| BCL11A-9408 | - | GUGCUGCGGUUGAAUCCAAUGGCU | 24 | 11188 |
| BCL11A-9409 | - | AGCUGGACGGAGGGAUCU | 18 | 11189 |
| BCL11A-9410 | - | GAGCUGGACGGAGGGAUCU | 19 | 11190 |
| BCL11A-6210 | - | GGAGCUGGACGGAGGGAUCU | 20 | 11191 |
| BCL11A-9411 | - | GGGAGCUGGACGGAGGGAUCU | 21 | 11192 |
| BCL11A-9412 | - | GGGGAGCUGGACGGAGGGAUCU | 22 | 11193 |
| BCL11A-9413 | - | CGGGGAGCUGGACGGAGGGAUCU | 23 | 11194 |
| BCL11A-9414 | - | CCGGGGAGCUGGACGGAGGGAUCU | 24 | 11195 |
| BCL11A-9415 | - | CCCGCCAUGGAUUUCUCU | 18 | 11196 |
| BCL11A-9416 | - | UCCCGCCAUGGAUUUCUCU | 19 | 11197 |
| BCL11A-6212 | - | CUCCCGCCAUGGAUUUCUCU | 20 | 11198 |
| BCL11A-9417 | - | CCUCCCGCCAUGGAUUUCUCU | 21 | 11199 |
| BCL11A-9418 | - | GCCUCCCGCCAUGGAUUUCUCU | 22 | 11200 |
| BCL11A-9419 | - | AGCCUCCCGCCAUGGAUUUCUCU | 23 | 11201 |
| BCL11A-9420 | - | GAGCCUCCCGCCAUGGAUUUCUCU | 24 | 11202 |
| BCL11A-9421 | - | CGAGAGCCCUUAAGUUCU | 18 | 11203 |
| BCL11A-9422 | - | UCGAGAGCCCUUAAGUUCU | 19 | 11204 |
| BCL11A-9423 | - | CUCGAGAGCCCUUAAGUUCU | 20 | 11205 |

TABLE 16E-continued

5th Tier

| gRNA Name | DNA Strand | Targeting Domain | Target Site Length | SEQ ID NO: |
|---|---|---|---|---|
| BCL11A-9424 | - | GCUCGAGAGCCCUUAAGUUCU | 21 | 11206 |
| BCL11A-9425 | - | AGCUCGAGAGCCCUUAAGUUCU | 22 | 11207 |
| BCL11A-9426 | - | AAGCUCGAGAGCCCUUAAGUUCU | 23 | 11208 |
| BCL11A-9427 | - | GAAGCUCGAGAGCCCUUAAGUUCU | 24 | 11209 |
| BCL11A-9428 | - | CGCCUUUUGCCUCCUCGU | 18 | 11210 |
| BCL11A-9429 | - | UCGCCUUUUGCCUCCUCGU | 19 | 11211 |
| BCL11A-6220 | - | AUCGCCUUUUGCCUCCUCGU | 20 | 11212 |
| BCL11A-9430 | - | AAUCGCCUUUUGCCUCCUCGU | 21 | 11213 |
| BCL11A-9431 | - | CAAUCGCCUUUUGCCUCCUCGU | 22 | 11214 |
| BCL11A-9432 | - | ACAAUCGCCUUUUGCCUCCUCGU | 23 | 11215 |
| BCL11A-9433 | - | GACAAUCGCCUUUUGCCUCCUCGU | 24 | 11216 |
| BCL11A-9434 | - | ACGCCCCAUAUUAGUGGU | 18 | 11217 |
| BCL11A-9435 | - | CACGCCCCAUAUUAGUGGU | 19 | 11218 |
| BCL11A-9436 | - | GCACGCCCCAUAUUAGUGGU | 20 | 11219 |
| BCL11A-9437 | - | AGCACGCCCCAUAUUAGUGGU | 21 | 11220 |
| BCL11A-9438 | - | GAGCACGCCCCAUAUUAGUGGU | 22 | 11221 |
| BCL11A-9439 | - | GGAGCACGCCCCAUAUUAGUGGU | 23 | 11222 |
| BCL11A-9440 | - | GGGAGCACGCCCCAUAUUAGUGGU | 24 | 11223 |
| BCL11A-9441 | - | GACACUUGUGAGUACUGU | 18 | 11224 |
| BCL11A-9442 | - | CGACACUUGUGAGUACUGU | 19 | 11225 |
| BCL11A-6230 | - | GCGACACUUGUGAGUACUGU | 20 | 11226 |
| BCL11A-9443 | - | AGCGACACUUGUGAGUACUGU | 21 | 11227 |
| BCL11A-9444 | - | CAGCGACACUUGUGAGUACUGU | 22 | 11228 |
| BCL11A-9445 | - | GCAGCGACACUUGUGAGUACUGU | 23 | 11229 |
| BCL11A-9446 | - | CGCAGCGACACUUGUGAGUACUGU | 24 | 11230 |
| BCL11A-9447 | - | CGCGGGUUGGUAUCCCUU | 18 | 11231 |
| BCL11A-9448 | - | CCGCGGGUUGGUAUCCCUU | 19 | 11232 |
| BCL11A-9449 | - | CCCGCGGGUUGGUAUCCCUU | 20 | 11233 |
| BCL11A-9450 | - | CCCCGCGGGUUGGUAUCCCUU | 21 | 11234 |
| BCL11A-9451 | - | ACCCCGCGGGUUGGUAUCCCUU | 22 | 11235 |
| BCL11A-9452 | - | GACCCCGCGGGUUGGUAUCCCUU | 23 | 11236 |
| BCL11A-9453 | - | UGACCCCGCGGGUUGGUAUCCCUU | 24 | 11237 |
| BCL11A-9454 | - | AGAUCCCUUCCUUAGCUU | 18 | 11238 |
| BCL11A-9455 | - | AAGAUCCCUUCCUUAGCUU | 19 | 11239 |
| BCL11A-6234 | - | AAAGAUCCCUUCCUUAGCUU | 20 | 11240 |
| BCL11A-9456 | - | CAAAGAUCCCUUCCUUAGCUU | 21 | 11241 |
| BCL11A-9457 | - | UCAAAGAUCCCUUCCUUAGCUU | 22 | 11242 |

TABLE 16E-continued

5th Tier

| gRNA Name | DNA Strand | Targeting Domain | Target Site Length | SEQ ID NO: |
|---|---|---|---|---|
| BCL11A-9458 | − | CUCAAAGAUCCCUUCCUUAGCUU | 23 | 11243 |
| BCL11A-9459 | − | GCUCAAAGAUCCCUUCCUUAGCUU | 24 | 11244 |
| BCL11A-9460 | − | CUCGAGAGCCCUUAAGUU | 18 | 11245 |
| BCL11A-9461 | − | GCUCGAGAGCCCUUAAGUU | 19 | 11246 |
| BCL11A-9462 | − | AGCUCGAGAGCCCUUAAGUU | 20 | 11247 |
| BCL11A-9463 | − | AAGCUCGAGAGCCCUUAAGUU | 21 | 11248 |
| BCL11A-9464 | − | GAAGCUCGAGAGCCCUUAAGUU | 22 | 11249 |
| BCL11A-9465 | − | GGAAGCUCGAGAGCCCUUAAGUU | 23 | 11250 |
| BCL11A-9466 | − | UGGAAGCUCGAGAGCCCUUAAGUU | 24 | 11251 |
| BCL11A-9467 | − | GGCAAGACGUUCAAAUUU | 18 | 11252 |
| BCL11A-9468 | − | CGGCAAGACGUUCAAAUUU | 19 | 11253 |
| BCL11A-9469 | − | GCGGCAAGACGUUCAAAUUU | 20 | 11254 |
| BCL11A-9470 | − | UGCGGCAAGACGUUCAAAUUU | 21 | 11255 |
| BCL11A-9471 | − | CUGCGGCAAGACGUUCAAAUUU | 22 | 11256 |
| BCL11A-9472 | − | UCUGCGGCAAGACGUUCAAAUUU | 23 | 11257 |
| BCL11A-9473 | − | UUCUGCGGCAAGACGUUCAAAUUU | 24 | 11258 |

Table 17A provides exemplary targeting domains for knocking out the BCL11A gene selected according to the first tier parameters. The targeting domains bind within the first 500 bp of the coding sequence (e.g., within 500 bp downstream from the start codon) and have a high level of orthogonality. It is contemplated herein that in an embodiment the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 17A

1st Tier

| gRNA Name | DNA Strand | Targeting Domain | Target Site Length | SEQ ID NO: |
|---|---|---|---|---|
| BCL11A-9474 | + | CGAUUGGUGAAGGGGAA | 17 | 11259 |
| BCL11A-9475 | + | AUUGGAUGCUUUUUUCA | 17 | 11260 |
| BCL11A-9476 | − | CAGGUCACGCCAGAGGA | 17 | 11261 |
| BCL11A-9477 | + | CUUACGCGAGAAUUCCC | 17 | 11262 |
| BCL11A-9478 | + | CCUGGAUGCCAACCUCC | 17 | 11263 |
| BCL11A-9479 | − | AACAAUGCAAUGGCAGC | 17 | 11264 |
| BCL11A-9480 | + | GGGGAAGGUGGCUUAUC | 17 | 11265 |
| BCL11A-9481 | + | GGUUCAUCAUCUGUAAG | 17 | 11266 |
| BCL11A-5334 | + | UGCACUCAUCCCAGGCG | 17 | 11267 |

TABLE 17A-continued

1st Tier

| gRNA Name | DNA Strand | Targeting Domain | Target Site Length | SEQ ID NO: |
|---|---|---|---|---|
| BCL11A-9482 | + | UUAAGUGCUGGGGUUUG | 17 | 11268 |
| BCL11A-9483 | + | CCAACCUCCACGGGAUU | 17 | 11269 |
| BCL11A-9484 | + | UCUCGAUUGGUGAAGGGGAA | 20 | 11270 |
| BCL11A-9485 | + | GGGAUUGGAUGCUUUUUUCA | 20 | 11271 |
| BCL11A-9486 | − | AUCCAGGUCACGCCAGAGGA | 20 | 11272 |
| BCL11A-9487 | + | UUACUUACGCGAGAAUUCCC | 20 | 11273 |
| BCL11A-6420 | + | UGACCUGGAUGCCAACCUCC | 20 | 11274 |
| BCL11A-9488 | − | GGAAACAAUGCAAUGGCAGC | 20 | 11275 |
| BCL11A-9489 | + | GAAGGGGAAGGUGGCUUAUC | 20 | 11276 |
| BCL11A-9490 | + | UCUGGUUCAUCAUCUGUAAG | 20 | 11277 |
| BCL11A-5480 | + | UUCUGCACUCAUCCCAGGCG | 20 | 11278 |

TABLE 17A-continued

1st Tier

| gRNA Name | DNA Strand | Targeting Domain | Target Site Length | SEQ ID NO: |
|---|---|---|---|---|
| BCL11A-9491 | + | UGCUUAAGUGCUGGGGUUUG | 20 | 11279 |
| BCL11A-9492 | + | AUGCCAACCUCCACGGGAUU | 20 | 11280 |

Table 17B provides exemplary targeting domains for knocking out the BCL11A gene selected according to the third tier parameters. The targeting domains fall in the coding sequence of the gene, downstream of the first 500 bp of coding sequence (e.g., anywhere from +500 (relative to the start codon) to the stop codon of the gene). It is contemplated herein that in an embodiment the targeting domain hybridizes to the target domain through complementary base pairing. Any of the targeting domains in the table can be used with a *N. meningindis* Cas9 molecule that generates a double stranded break (Cas9 nuclease) or a single-stranded break (Cas9 nickase).

TABLE 17B

3rd Tier

| gRNA Name | DNA Strand | Targeting Domain | Target Site Length | SEQ ID NO: |
|---|---|---|---|---|
| BCL11A-5515 | + | UCCGACGAGGAGGCAAA | 17 | 11281 |
| BCL11A-5520 | − | CUUCCGGCCUGGCAGAA | 17 | 11282 |
| BCL11A-9493 | + | UCCGUGUUCGCUUUCUA | 17 | 11283 |
| BCL11A-9494 | − | AGAGCGAGAGGGUGGAC | 17 | 11284 |
| BCL11A-9495 | + | CGGGAGGCUCCAUAGCC | 17 | 11285 |
| BCL11A-9496 | − | UUCCCAGCCACCUCUCC | 17 | 11286 |
| BCL11A-9497 | + | AGCUGGGGCUGCCCAGC | 17 | 11287 |
| BCL11A-9498 | − | GCUAUGGAGCCUCCCGC | 17 | 11288 |
| BCL11A-9499 | + | CGGCCAGGUGGCCGCGC | 17 | 11289 |
| BCL11A-9500 | + | GCGUCUUCAUGUGGCGC | 17 | 11290 |
| BCL11A-9501 | + | UCAGAACUUAAGGGCUC | 17 | 11291 |
| BCL11A-9502 | − | AGCUCAAAGAUCCCUUC | 17 | 11292 |
| BCL11A-9503 | + | GCAGGUCGAACUCCUUC | 17 | 11293 |
| BCL11A-9504 | + | GGGGCGUCGCCAGGAAG | 17 | 11294 |
| BCL11A-9505 | − | CCAGGAUCAGUAUCGAG | 17 | 11295 |
| BCL11A-9506 | + | GGCUGGGAGGGAGGAGG | 17 | 11296 |
| BCL11A-9507 | + | GACUUGACCGUCAUGGG | 17 | 11297 |
| BCL11A-9508 | + | CGGCCUCGGCCAGGUGG | 17 | 11298 |
| BCL11A-5799 | + | GCAUGUGCGUCUUCAUG | 17 | 11299 |
| BCL11A-9509 | + | CGCACAGGUUGCACUUG | 17 | 11300 |
| BCL11A-9510 | + | ACUCCUUCUCGAGCUUG | 17 | 11301 |

TABLE 17B-continued

3rd Tier

| gRNA Name | DNA Strand | Targeting Domain | Target Site Length | SEQ ID NO: |
|---|---|---|---|---|
| BCL11A-9511 | − | AACACGCACAGAACACU | 17 | 11302 |
| BCL11A-9512 | − | CCUCGGAGAACGGGAGU | 17 | 11303 |
| BCL11A-9513 | + | GGUCAGGGGACUUCCGU | 17 | 11304 |
| BCL11A-5874 | + | UGCUCCGACGAGGAGGCAAA | 20 | 11305 |
| BCL11A-5879 | − | AGGCUUCCGGCCUGGCAGAA | 20 | 11306 |
| BCL11A-9514 | + | ACUUCCGUGUUCGCUUUCUA | 20 | 11307 |
| BCL11A-9515 | − | CGGAGAGCGAGAGGGUGGAC | 20 | 11308 |
| BCL11A-9516 | + | UGGCGGGAGGCUCCAUAGCC | 20 | 11309 |
| BCL11A-8754 | − | UCCUUCCCAGCCACCUCUCC | 20 | 11310 |
| BCL11A-9517 | + | GCGAGCUGGGGCUGCCCAGC | 20 | 11311 |
| BCL11A-9518 | − | AUGGCUAUGGAGCCUCCCGC | 20 | 11312 |
| BCL11A-9519 | + | CCUCGGCCAGGUGGCCGCGC | 20 | 11313 |
| BCL11A-9520 | + | UGUGCGUCUUCAUGUGGCGC | 20 | 11314 |
| BCL11A-7725 | + | UUCUCAGAACUUAAGGGCUC | 20 | 11315 |
| BCL11A-9521 | − | GGCAGCUCAAAGAUCCCUUC | 20 | 11316 |
| BCL11A-7752 | + | GGGGCAGGUCGAACUCCUUC | 20 | 11317 |
| BCL11A-9522 | + | GGGGGGGCGUCGCCAGGAAG | 20 | 11318 |
| BCL11A-9523 | − | AUACCAGGAUCAGUAUCGAG | 20 | 11319 |
| BCL11A-9524 | + | GGGGGCUGGGAGGGAGGAGG | 20 | 11320 |
| BCL11A-9525 | + | UCGGACUUGACCGUCAUGGG | 20 | 11321 |
| BCL11A-9526 | + | CCUCGGCCUCGGCCAGGUGG | 20 | 11322 |
| BCL11A-6165 | + | UGUGCAUGUGCGUCUUCAUG | 20 | 11323 |
| BCL11A-8204 | + | GGUCGCACAGGUUGCACUUG | 20 | 11324 |
| BCL11A-9527 | + | CGAACUCCUUCUCGAGCUUG | 20 | 11325 |
| BCL11A-9528 | − | UGCAACACGCACAGAACACU | 20 | 11326 |
| BCL11A-9529 | − | ACUCCUCGGAGAACGGGAGU | 20 | 11327 |

TABLE 17B-continued

3rd Tier

| gRNA Name | DNA Strand | Targeting Domain | Target Site Length | SEQ ID NO: |
|---|---|---|---|---|
| BCL11A-9530 | + | CGGGGUCAGGGGACUUCCGU | 20 | 11328 |

Table 18A provides exemplary targeting domains for knocking down the BCL11A gene selected according to the first tier parameters. The targeting domains bind within 500 bp (e.g., upstream or downstream) of a transcription start site (TSS) and have a high level of orthogonality. It is contemplated herein that in an embodiment the targeting domain hybridizes to the target domain through complementary base pairing. Any of the targeting domains in the table can be used with a *S. pyogenes* eiCas9 molecule or eiCas9 fusion protein (e.g., an eiCas9 fused to a transcription repressor domain) to alter the BCL11A gene (e.g., reduce or eliminate BCL11A gene expression, BCL11A protein function, or the level of BCL11A protein). One or more gRNA may be used to target an eiCas9 to the promoter region of the BCL11A gene.

TABLE 18A

1st Tier

| gRNA Name | DNA Strand | Targeting Domain | Target Site Length | SEQ ID NO: |
|---|---|---|---|---|
| BCL11A-9531 | + | AAGUGCAUACACGGCAA | 17 | 11329 |
| BCL11A-5319 | + | UUGCUUGCGGCGAGACA | 17 | 11330 |
| BCL11A-5320 | - | AUGUCUCGCCGCAAGCA | 17 | 11331 |
| BCL11A-9532 | - | UGACGUUCAAGUUCGCA | 17 | 11332 |
| BCL11A-9533 | + | UUGUGGGAGAGCCGUCA | 17 | 11333 |
| BCL11A-9534 | + | ACGGCAAUGGUUCCAGA | 17 | 11334 |
| BCL11A-9535 | - | GCGCUCGCUGCGGCCAC | 17 | 11335 |
| BCL11A-4560 | + | ACGCCAGACGCGGCCCC | 17 | 11336 |
| BCL11A-9536 | + | UUCACAUCGGGAGAGCC | 17 | 11337 |
| BCL11A-9537 | + | GUUCACAUCGGGAGAGC | 17 | 11338 |
| BCL11A-9538 | - | UAAUCACGAGAGCGCGC | 17 | 11339 |
| BCL11A-9539 | - | CUGACGUUCAAGUUCGC | 17 | 11340 |
| BCL11A-5327 | + | CCCGUUUGCUUAAGUGC | 17 | 11341 |
| BCL11A-9540 | + | ACGGCUCGGUUCACAUC | 17 | 11342 |
| BCL11A-9541 | + | CUUGAACGUCAGGAGUC | 17 | 11343 |
| BCL11A-9542 | + | CUGCGAACUUGAACGUC | 17 | 11344 |
| BCL11A-9543 | - | CCCCCGGGGCCGCGUC | 17 | 11345 |
| BCL11A-9544 | + | UCCGCGGACGCCAGACG | 17 | 11346 |
| BCL11A-9545 | - | GACUAGAAGCAAAAGCG | 17 | 11347 |
| BCL11A-5335 | + | AGACAUGGUGGGCUGCG | 17 | 11348 |
| BCL11A-9546 | - | AAAACCUCCGAGAGUCG | 17 | 11349 |

TABLE 18A-continued

1st Tier

| gRNA Name | DNA Strand | Targeting Domain | Target Site Length | SEQ ID NO: |
|---|---|---|---|---|
| BCL11A-9547 | + | UUUACCUCGACUCUCGG | 17 | 11350 |
| BCL11A-9548 | - | AGUCCGCGUGUGUGGGG | 17 | 11351 |
| BCL11A-5336 | + | CGUUUGCUUAAGUGCUG | 17 | 11352 |
| BCL11A-9549 | - | UAGAGUCCGCGUGUGUG | 17 | 11353 |
| BCL11A-9550 | + | GACGGCUCGGUUCACAU | 17 | 11354 |
| BCL11A-9551 | - | CUCCCCGCACUGGCCAU | 17 | 11355 |
| BCL11A-9552 | + | CGGCAAUGGUUCCAGAU | 17 | 11356 |
| BCL11A-9553 | + | GCGGGCGGACGACGGCU | 17 | 11357 |
| BCL11A-5338 | + | CCGUUUGCUUAAGUGCU | 17 | 11358 |
| BCL11A-5340 | + | UUGCGGCGAGACAUGGU | 17 | 11359 |
| BCL11A-9554 | + | CGUGGCCGGGAGAGAAGAAA | 20 | 11360 |
| BCL11A-5345 | + | GCCUUGCUUGCGGCGAGACA | 20 | 11361 |
| BCL11A-5346 | - | ACCAUGUCUCGCCGCAAGCA | 20 | 11362 |
| BCL11A-9555 | - | UCCUGACGUUCAAGUUCGCA | 20 | 11363 |
| BCL11A-9556 | + | ACACCAAUGGACACACAUCA | 20 | 11364 |
| BCL11A-9557 | + | UACACGGCAAUGGUUCCAGA | 20 | 11365 |
| BCL11A-9558 | + | GCCAAUGGCCAGUGCGGGGA | 20 | 11366 |
| BCL11A-9559 | + | AAUGGUUCCAGAUGGGAUGA | 20 | 11367 |
| BCL11A-9560 | - | GAGUCUCCUUCUUUCUAACC | 20 | 11368 |
| BCL11A-9561 | + | CGGUUCACAUCGGGAGAGCC | 20 | 11369 |
| BCL11A-9562 | + | UCGGUUCACAUCGGGAGAGC | 20 | 11370 |
| BCL11A-9563 | - | CCGCGUGUGGGGGGGAGC | 20 | 11371 |
| BCL11A-9564 | - | UAAUAAUCACGAGAGCGCGC | 20 | 11372 |
| BCL11A-9565 | + | AAAUAAUACAAAGAUGGCGC | 20 | 11373 |
| BCL11A-9566 | - | CUCCUGACGUUCAAGUUCGC | 20 | 11374 |
| BCL11A-9567 | + | GAGACACACAAAACAUGGGC | 20 | 11375 |
| BCL11A-5352 | + | AUUCCCGUUUGCUUAAGUGC | 20 | 11376 |
| BCL11A-9568 | + | ACGACGGCUCGGUUCACAUC | 20 | 11377 |

TABLE 18A-continued

1st Tier

| gRNA Name | DNA Strand | Targeting Domain | Target Site Length | SEQ ID NO: |
|---|---|---|---|---|
| BCL11A-9569 | − | CGCACUUGAACUUGCAGCUC | 20 | 11378 |
| BCL11A-9570 | + | UCCCUGCGAACUUGAACGUC | 20 | 11379 |
| BCL11A-9571 | − | UCGAGGUAAAAGAGAUAAAG | 20 | 11380 |
| BCL11A-9572 | + | CCAAUGGCCAGUGCGGGGAG | 20 | 11381 |
| BCL11A-4351 | + | GACGCCAGACGCGGCCCCCG | 20 | 11382 |
| BCL11A-9573 | − | UGCGGCCACUGGUGAGCCCG | 20 | 11383 |
| BCL11A-9574 | − | GGGGCCGCGUCUGGCGUCCG | 20 | 11384 |
| BCL11A-5359 | + | GCGAGACAUGGUGGGCUGCG | 20 | 11385 |
| BCL11A-9575 | − | AGAAAAACCUCCGAGAGUCG | 20 | 11386 |
| BCL11A-4561 | + | ACGCCAGACGCGGCCCCCGG | 20 | 11387 |
| BCL11A-9576 | + | UCUUUUACCUCGACUCUCGG | 20 | 11388 |
| BCL11A-9577 | − | UAGAGUCCGCGUGUGUGGGG | 20 | 11389 |
| BCL11A-9578 | − | UUUAGAGUCCGCGUGUGUGG | 20 | 11390 |
| BCL11A-9579 | + | CAAUGGUUCCAGAUGGGAUG | 20 | 11391 |
| BCL11A-5361 | + | CGGCGAGACAUGGUGGGCUG | 20 | 11392 |
| BCL11A-9580 | + | CUGAGCUGCAAGUUCAAGUG | 20 | 11393 |
| BCL11A-9581 | − | CAUUUUAGAGUCCGCGUGUG | 20 | 11394 |
| BCL11A-9582 | + | GACGACGGCUCGGUUCACAU | 20 | 11395 |
| BCL11A-9583 | − | AGCCCCUGAUGUGUGUCCAU | 20 | 11396 |
| BCL11A-9584 | + | GCGGCGGGCGGACGACGGCU | 20 | 11397 |
| BCL11A-9585 | + | AUCUCUUUUACCUCGACUCU | 20 | 11398 |
| BCL11A-5365 | + | UGCUUGCGGCGAGACAUGGU | 20 | 11399 |
| BCL11A-9586 | − | AUUUUAGAGUCCGCGUGUGU | 20 | 11400 |

Table 18B provides exemplary targeting domains for knocking down the BCL11A gene selected according to the second tier parameters. The targeting domains bind within 500 bp (e.g., upstream or downstream) of a transcription start site (TSS). It is contemplated herein that in an embodiment the targeting domain hybridizes to the target domain through complementary base pairing. Any of the targeting domains in the table can be used with a *S. pyogenes* eiCas9 molecule or eiCas9 fusion protein (e.g., an eiCas9 fused to a transcription repressor domain) to alter the BCL11A gene (e.g., reduce or eliminate BCL11A gene expression, BCL11A protein function, or the level of BCL11A protein). One or more gRNA may be used to target an eiCas9 to the promoter region of the BCL11A gene.

TABLE 18B

2nd Tier

| gRNA Name | DNA Strand | Targeting Domain | Target Site Length | SEQ ID NO: |
|---|---|---|---|---|
| BCL11A-9587 | + | GAGAGAGAUGAAAAAAA | 17 | 11401 |
| BCL11A-5369 | − | CCCAGCACUUAAGCAAA | 17 | 11402 |
| BCL11A-9588 | − | UUAUUUUGGAUGUCAAA | 17 | 11403 |
| BCL11A-4473 | + | GGCCGGGAGAGAAGAAA | 17 | 11404 |
| BCL11A-9589 | + | GCAGGGGUGGGAGGAAA | 17 | 11405 |
| BCL11A-9590 | − | GAGGUAAAAGAGAUAAA | 17 | 11406 |
| BCL11A-9591 | + | AAUUAAAUAAAAUUAAA | 17 | 11407 |
| BCL11A-9592 | + | GGGGAAGCUCACACCAA | 17 | 11408 |
| BCL11A-4574 | + | AGACCAGGACAAGCCAA | 17 | 11409 |
| BCL11A-9593 | + | UGGCCGGGAGAGAAGAA | 17 | 11410 |
| BCL11A-4491 | + | GGGCGAGCAGGAGAGAA | 17 | 11411 |

TABLE 18B-continued

2nd Tier

| gRNA Name | DNA Strand | Targeting Domain | Target Site Length | SEQ ID NO: |
|---|---|---|---|---|
| BCL11A-9594 | + | GGCAGGGGUGGGAGGAA | 17 | 11412 |
| BCL11A-4570 | + | AGAAGGGGAGGAGGGAA | 17 | 11413 |
| BCL11A-9595 | - | CGAGGUAAAAGAGAUAA | 17 | 11414 |
| BCL11A-4625 | + | CAGAGACACACAAAACA | 17 | 11415 |
| BCL11A-9596 | + | UCUCAAAAGUGCAUACA | 17 | 11416 |
| BCL11A-9597 | - | GUGUGUGGGGGGGAGCA | 17 | 11417 |
| BCL11A-9598 | + | AAUACAAAGAUGGCGCA | 17 | 11418 |
| BCL11A-9599 | + | CACACAAAACAUGGGCA | 17 | 11419 |
| BCL11A-9600 | + | AGAAGAAAGGGGUGGCA | 17 | 11420 |
| BCL11A-9601 | + | CCAAUGGACACACAUCA | 17 | 11421 |
| BCL11A-9602 | - | CUUGAACUUGCAGCUCA | 17 | 11422 |
| BCL11A-4529 | + | AAAAAAAAAAAAAAGA | 17 | 11423 |
| BCL11A-9603 | + | UAGAAAUAAUACAAAGA | 17 | 11424 |
| BCL11A-9604 | + | GAGCCGGGUUAGAAAGA | 17 | 11425 |
| BCL11A-4592 | + | AGGGCGAGCAGGAGAGA | 17 | 11426 |
| BCL11A-4534 | - | AAAGCGAGGGGAGAGA | 17 | 11427 |
| BCL11A-9605 | + | GAGAGAAGAGAGAUAGA | 17 | 11428 |
| BCL11A-4674 | + | CGGCGGCGGGCGGACGA | 17 | 11429 |
| BCL11A-4494 | + | GGGGAGGGGCGGGCCGA | 17 | 11430 |
| BCL11A-9606 | - | ACUAGAAGCAAAAGCGA | 17 | 11431 |
| BCL11A-4591 | + | AGGAGAGAAGGGGAGGA | 17 | 11432 |
| BCL11A-4399 | + | GAGAAGGGGAGGAGGGA | 17 | 11433 |
| BCL11A-4499 | + | GGGGCGGGCCGAGGGGA | 17 | 11434 |
| BCL11A-9607 | + | AAUGGCCAGUGCGGGGA | 17 | 11435 |
| BCL11A-4562 | + | ACGCGGCCCCGGGGGA | 17 | 11436 |
| BCL11A-9608 | + | AACGUCAGGAGUCUGGA | 17 | 11437 |
| BCL11A-9609 | - | UUAAAAAAAAGCCAUGA | 17 | 11438 |
| BCL11A-9610 | + | GGUUCCAGAUGGGAUGA | 17 | 11439 |
| BCL11A-5383 | - | CCAGCACUUAAGCAAAC | 17 | 11440 |
| BCL11A-9611 | - | CCUCCCCCUCCCCGCAC | 17 | 11441 |
| BCL11A-9612 | - | UCUCCUUCUUUCUAACC | 17 | 11442 |
| BCL11A-9613 | + | GACAUGAAAAGAGACC | 17 | 11443 |
| BCL11A-4662 | + | CGCCAGACGCGGCCCCC | 17 | 11444 |
| BCL11A-9614 | - | CGGCCCGCCCCUCCCCC | 17 | 11445 |
| BCL11A-9615 | - | UCGGCCCGCCCCUCCCC | 17 | 11446 |
| BCL11A-9616 | + | GCGGCGGUGGCGUGGCC | 17 | 11447 |
| BCL11A-9617 | - | ACCCCUUUCUUCUCUCC | 17 | 11448 |

TABLE 18B-continued

2nd Tier

| gRNA Name | DNA Strand | Targeting Domain | Target Site Length | SEQ ID NO: |
|---|---|---|---|---|
| BCL11A-9618 | − | UGGCCAUUGGCUUGUCC | 17 | 11449 |
| BCL11A-9619 | + | ACAUGGGCAGGGCGAGC | 17 | 11450 |
| BCL11A-9620 | − | CGUGUGUGGGGGGGAGC | 17 | 11451 |
| BCL11A-9621 | + | GGGGGCGCUGGGGCCGC | 17 | 11452 |
| BCL11A-4646 | + | CCGAGGGGAGGGGCGC | 17 | 11453 |
| BCL11A-9622 | + | UAAUACAAAGAUGGCGC | 17 | 11454 |
| BCL11A-4441 | + | GCGGCGGCGGCGGCGGC | 17 | 11455 |
| BCL11A-9623 | + | GGACACACAUCAGGGGC | 17 | 11456 |
| BCL11A-4429 | + | GCCCCCGGGGGAGGGGC | 17 | 11457 |
| BCL11A-5392 | + | AUGGUGGGCUGCGGGGC | 17 | 11458 |
| BCL11A-9624 | + | AGGGGGAGGUGCGGGGC | 17 | 11459 |
| BCL11A-9625 | + | ACACACAAAACAUGGGC | 17 | 11460 |
| BCL11A-9626 | + | CGCGGCGGUGGCGUGGC | 17 | 11461 |
| BCL11A-9627 | + | GAGAAGAAAGGGGUGGC | 17 | 11462 |
| BCL11A-5395 | + | GAGACAUGGUGGGCUGC | 17 | 11463 |
| BCL11A-9628 | + | AAGCCAAUGGCCAGUGC | 17 | 11464 |
| BCL11A-9629 | + | CGGGGAGGGGGAGGUGC | 17 | 11465 |
| BCL11A-9630 | + | ACCAAUGGACACACAUC | 17 | 11466 |
| BCL11A-9631 | − | AAAACCCUCAUCCCAUC | 17 | 11467 |
| BCL11A-9632 | − | ACUUGAACUUGCAGCUC | 17 | 11468 |
| BCL11A-9633 | − | GAUGAAGAUAUUUUCUC | 17 | 11469 |
| BCL11A-4528 | + | AAAAAAAAAAAAAAAG | 17 | 11470 |
| BCL11A-4433 | + | GCCGGGAGAGAAGAAAG | 17 | 11471 |
| BCL11A-9634 | − | AGGUAAAAGAGAUAAAG | 17 | 11472 |
| BCL11A-4475 | + | GGCGAGCAGGAGAGAAG | 17 | 11473 |
| BCL11A-4389 | + | GAAGGGGAGGAGGGAAG | 17 | 11474 |
| BCL11A-9635 | + | GGCCGCGGGCUCACCAG | 17 | 11475 |
| BCL11A-9636 | + | GAAGAAAGGGGUGGCAG | 17 | 11476 |
| BCL11A-9637 | + | CAAUGGACACACAUCAG | 17 | 11477 |
| BCL11A-9638 | − | UUGAACUUGCAGCUCAG | 17 | 11478 |
| BCL11A-4543 | − | AAGCGAGGGGAGAGAG | 17 | 11479 |
| BCL11A-4533 | − | AAAAGCGAGGGGAGAG | 17 | 11480 |
| BCL11A-4485 | + | GGGAGGGGCGGGCCGAG | 17 | 11481 |
| BCL11A-9639 | − | CUAGAAGCAAAAGCGAG | 17 | 11482 |
| BCL11A-4492 | + | GGGCGGGCCGAGGGGAG | 17 | 11483 |
| BCL11A-9640 | + | AUGGCCAGUGCGGGGAG | 17 | 11484 |
| BCL11A-4665 | + | CGCGGCCCCCGGGGGAG | 17 | 11485 |
| BCL11A-9641 | + | AGAGAGAAGAGAGAUAG | 17 | 11486 |

TABLE 18B-continued

2nd Tier

| gRNA Name | DNA Strand | Targeting Domain | Target Site Length | SEQ ID NO: |
|---|---|---|---|---|
| BCL11A-9642 | + | GCUCCCCCCCACACACG | 17 | 11487 |
| BCL11A-4427 | + | GCCAGACGCGGCCCCCG | 17 | 11488 |
| BCL11A-9643 | - | GGCCCGCCCCUCCCCCG | 17 | 11489 |
| BCL11A-9644 | - | GGCCACUGGUGAGCCCG | 17 | 11490 |
| BCL11A-4670 | - | CGGCCACGCCACCGCCG | 17 | 11491 |
| BCL11A-4470 | + | GGCCGCAGCGAGCGCCG | 17 | 11492 |
| BCL11A-4502 | + | GGGGGAGGGGCGGGCCG | 17 | 11493 |
| BCL11A-9645 | + | AGGGGGCGCUGGGGCCG | 17 | 11494 |
| BCL11A-9646 | + | CGGGGCGGGGGCUCCG | 17 | 11495 |
| BCL11A-9647 | - | GCCGCGUCUGGCGUCCG | 17 | 11496 |
| BCL11A-9648 | + | GGGGGAGGUGCGGGGCG | 17 | 11497 |
| BCL11A-9649 | + | GCGCCGCGGCGGUGGCG | 17 | 11498 |
| BCL11A-9650 | + | AGCCAAUGGCCAGUGCG | 17 | 11499 |
| BCL11A-9651 | + | GGGGAGGGGGAGGUGCG | 17 | 11500 |
| BCL11A-9652 | - | GGUAAAAGAGAUAAAGG | 17 | 11501 |
| BCL11A-9653 | - | UGAACUUGCAGCUCAGG | 17 | 11502 |
| BCL11A-9654 | - | UAGAAGCAAAAGCGAGG | 17 | 11503 |
| BCL11A-4627 | + | CAGGAGAGAAGGGGAGG | 17 | 11504 |
| BCL11A-4480 | + | GGCGGGCCGAGGGGAGG | 17 | 11505 |
| BCL11A-9655 | + | UGGCCAGUGCGGGGAGG | 17 | 11506 |
| BCL11A-4634 | + | CCAGACGCGGCCCCCGG | 17 | 11507 |
| BCL11A-9656 | - | GCCCGCCCCUCCCCCGG | 17 | 11508 |
| BCL11A-4660 | + | CGCAGCGAGCGCCGCGG | 17 | 11509 |
| BCL11A-4588 | + | AGCGAGCGCCGCGGCGG | 17 | 11510 |
| BCL11A-4478 | + | GGCGGCGGCGGCGGCGG | 17 | 11511 |
| BCL11A-4447 | + | GCGGGCGGCGGCGGCGG | 17 | 11512 |
| BCL11A-4500 | + | GGGGCGGGCGGCGGCGG | 17 | 11513 |
| BCL11A-5409 | + | UGCGGGGCGGGCGGCGG | 17 | 11514 |
| BCL11A-5410 | + | GGCUGCGGGGCGGGCGG | 17 | 11515 |
| BCL11A-9657 | + | GGGGAGGUGCGGGGCGG | 17 | 11516 |
| BCL11A-9658 | + | GGGGUGGGAGGAAAGGG | 17 | 11517 |
| BCL11A-9659 | - | GAACUUGCAGCUCAGGG | 17 | 11518 |
| BCL11A-4444 | + | GCGGCGGCGGCGGCGGG | 17 | 11519 |
| BCL11A-5411 | + | GUGGGCUGCGGGGCGGG | 17 | 11520 |
| BCL11A-9660 | + | GGGAGGUGCGGGGCGGG | 17 | 11521 |
| BCL11A-4483 | + | GGGAGAGAAGAAAGGGG | 17 | 11522 |
| BCL11A-4407 | + | GAGCAGGAGAGAAGGGG | 17 | 11523 |

TABLE 18B-continued

2nd Tier

| gRNA Name | DNA Strand | Targeting Domain | Target Site Length | SEQ ID NO: |
|---|---|---|---|---|
| BCL11A-9661 | + | GAAAGGGUGGCAGGGG | 17 | 11524 |
| BCL11A-4593 | + | AGGGGCGGGCCGAGGGG | 17 | 11525 |
| BCL11A-4467 | + | GGCCCCGGGGAGGGG | 17 | 11526 |
| BCL11A-5413 | + | CAUGGUGGGCUGCGGGG | 17 | 11527 |
| BCL11A-9662 | + | CAAUGGCCAGUGCGGGG | 17 | 11528 |
| BCL11A-9663 | + | GAGGGGAGGUGCGGGG | 17 | 11529 |
| BCL11A-9664 | + | CCAGUGCGGGGAGGGGG | 17 | 11530 |
| BCL11A-4395 | + | GACGCGGCCCCCGGGGG | 17 | 11531 |
| BCL11A-9665 | + | GGGAGGAAAGGGUGGGG | 17 | 11532 |
| BCL11A-9666 | + | UGGGAGGAAAGGGUGGG | 17 | 11533 |
| BCL11A-9667 | + | GGGGUGGCAGGGGUGGG | 17 | 11534 |
| BCL11A-9668 | − | GAGUCCGCGUGUGUGGG | 17 | 11535 |
| BCL11A-5414 | + | CUUGCGGCGAGACAUGG | 17 | 11536 |
| BCL11A-9669 | + | GUGGGAGGAAAGGGUGG | 17 | 11537 |
| BCL11A-9670 | − | AGAGUCCGCGUGUGUGG | 17 | 11538 |
| BCL11A-9671 | + | UGGUUCCAGAUGGGAUG | 17 | 11539 |
| BCL11A-9672 | + | GAGGGGAGGGGGCGCUG | 17 | 11540 |
| BCL11A-9673 | − | CGCCGCGGCGCUCGCUG | 17 | 11541 |
| BCL11A-5422 | + | CGAGACAUGGUGGGCUG | 17 | 11542 |
| BCL11A-9674 | + | AGCUGCAAGUUCAAGUG | 17 | 11543 |
| BCL11A-9675 | + | CAAGCCAAUGGCCAGUG | 17 | 11544 |
| BCL11A-9676 | + | GCGGGGAGGGGAGGUG | 17 | 11545 |
| BCL11A-9677 | + | GGUGGGAGGAAAGGGUG | 17 | 11546 |
| BCL11A-9678 | − | UUUAGAGUCCGCGUGUG | 17 | 11547 |
| BCL11A-9679 | + | GCAGGGAAGAUGAAUUG | 17 | 11548 |
| BCL11A-5426 | + | GGGGUUUGCCUUGCUUG | 17 | 11549 |
| BCL11A-9680 | + | AGAGACACACAAAACAU | 17 | 11550 |
| BCL11A-9681 | − | CCCUGAUGUGUGUCCAU | 17 | 11551 |
| BCL11A-5431 | + | AUUAUUAUUACUAUUAU | 17 | 11552 |
| BCL11A-9682 | − | CCAGCGCCCCUCCCCU | 17 | 11553 |
| BCL11A-9683 | + | CGAGGGGAGGGGGCGCU | 17 | 11554 |
| BCL11A-9684 | + | UCUUUUACCUCGACUCU | 17 | 11555 |
| BCL11A-9685 | + | GGGUGGGAGGAAAGGGU | 17 | 11556 |
| BCL11A-9686 | + | AAAGGGGUGGCAGGGGU | 17 | 11557 |
| BCL11A-9687 | − | UUAGAGUCCGCGUGUGU | 17 | 11558 |
| BCL11A-9688 | + | CAGGGAAGAUGAAUUGU | 17 | 11559 |
| BCL11A-5439 | + | UUAUUAUUACUAUUAUU | 17 | 11560 |
| BCL11A-9689 | − | UUAUUUCUAAUUUAUUU | 17 | 11561 |

TABLE 18B-continued

| | | 2nd Tier | | |
|---|---|---|---|---|
| gRNA Name | DNA Strand | Targeting Domain | Target Site Length | SEQ ID NO: |
| BCL11A-9690 | + | AGAGAGAGAGAUGAAAAAAA | 20 | 11562 |
| BCL11A-5443 | − | AACCCCAGCACUUAAGCAAA | 20 | 11563 |
| BCL11A-9691 | − | AAUUUAUUUUGGAUGUCAAA | 20 | 11564 |
| BCL11A-9692 | + | GUGGCAGGGGUGGGAGGAAA | 20 | 11565 |
| BCL11A-9693 | − | GUCGAGGUAAAAGAGAUAAA | 20 | 11566 |
| BCL11A-9694 | + | UAAAAUUAAAUAAAAUUAAA | 20 | 11567 |
| BCL11A-9695 | + | GAAGGGGAAGCUCACACCAA | 20 | 11568 |
| BCL11A-4541 | + | AAGAGACCAGGACAAGCCAA | 20 | 11569 |
| BCL11A-9696 | + | CAAAAGUGCAUACACGGCAA | 20 | 11570 |
| BCL11A-9697 | + | GCGUGGCCGGGAGAGAAGAA | 20 | 11571 |
| BCL11A-4422 | + | GCAGGGCGAGCAGGAGAGAA | 20 | 11572 |
| BCL11A-9698 | + | GGUGGCAGGGGUGGGAGGAA | 20 | 11573 |
| BCL11A-4404 | + | GAGAGAAGGGGAGGAGGGAA | 20 | 11574 |
| BCL11A-9699 | − | AGUCGAGGUAAAAGAGAUAA | 20 | 11575 |
| BCL11A-4455 | + | GGACAGAGACACACAAAACA | 20 | 11576 |
| BCL11A-9700 | + | CUGUCUCAAAAGUGCAUACA | 20 | 11577 |
| BCL11A-9701 | − | CGCGUGUGUGGGGGGGAGCA | 20 | 11578 |
| BCL11A-9702 | + | AAUAAUACAAAGAUGGCGCA | 20 | 11579 |
| BCL11A-9703 | + | AGACACACAAAACAUGGGCA | 20 | 11580 |
| BCL11A-9704 | + | GAGAGAAGAAAGGGGUGGCA | 20 | 11581 |
| BCL11A-9705 | − | GCACUUGAACUUGCAGCUCA | 20 | 11582 |
| BCL11A-9706 | + | GAAUUGUGGGAGAGCCGUCA | 20 | 11583 |
| BCL11A-4527 | + | AAAAAAAAAAAAAAAAAAGA | 20 | 11584 |
| BCL11A-9707 | + | AAUUAGAAAUAAUACAAAGA | 20 | 11585 |
| BCL11A-9708 | + | GGAGAGCCGGGUUAGAAAGA | 20 | 11586 |
| BCL11A-4464 | + | GGCAGGGCGAGCAGGAGAGA | 20 | 11587 |
| BCL11A-4418 | − | GCAAAAGCGAGGGGGAGAGA | 20 | 11588 |
| BCL11A-9709 | + | AGAGAGAGAAGAGAGAUAGA | 20 | 11589 |
| BCL11A-4673 | + | CGGCGGCGGCGGGCGGACGA | 20 | 11590 |
| BCL11A-4648 | + | CCGGGGAGGGGCGGGCCGA | 20 | 11591 |
| BCL11A-9710 | − | AGGACUAGAAGCAAAAGCGA | 20 | 11592 |
| BCL11A-4584 | + | AGCAGGAGAGAAGGGGAGGA | 20 | 11593 |
| BCL11A-4459 | + | GGAGAGAAGGGGAGGAGGGA | 20 | 11594 |
| BCL11A-4461 | + | GGAGGGGCGGGCCGAGGGA | 20 | 11595 |
| BCL11A-4624 | + | CAGACGCGGCCCCCGGGGGA | 20 | 11596 |
| BCL11A-9711 | + | UUGAACGUCAGGAGUCUGGA | 20 | 11597 |
| BCL11A-9712 | − | UGCUUAAAAAAAAGCCAUGA | 20 | 11598 |

TABLE 18B-continued

2nd Tier

| gRNA Name | DNA Strand | Targeting Domain | Target Site Length | SEQ ID NO: |
|---|---|---|---|---|
| BCL11A-5458 | − | ACCCCAGCACUUAAGCAAAC | 20 | 11599 |
| BCL11A-9713 | − | GCGGCGCUCGCUGCGGCCAC | 20 | 11600 |
| BCL11A-9714 | − | GCACCUCCCCUCCCCGCAC | 20 | 11601 |
| BCL11A-9715 | + | CUGGACAUGAAAAGAGACC | 20 | 11602 |
| BCL11A-4456 | + | GGACGCCAGACGCGGCCCCC | 20 | 11603 |
| BCL11A-9716 | − | CCUCGGCCCGCCCCUCCCCC | 20 | 11604 |
| BCL11A-4362 | + | CGGACGCCAGACGCGGCCCC | 20 | 11605 |
| BCL11A-9717 | − | CCCUCGGCCCGCCCCUCCCC | 20 | 11606 |
| BCL11A-9718 | + | GCCGCGGCGGUGGCGUGGCC | 20 | 11607 |
| BCL11A-9719 | − | GCCACCCCUUUCUUCUCUCC | 20 | 11608 |
| BCL11A-9720 | − | CACUGGCCAUUGGCUUGUCC | 20 | 11609 |
| BCL11A-9721 | + | AAAACAUGGGCAGGGCGAGC | 20 | 11610 |
| BCL11A-9722 | + | GGAGGGGCGCUGGGGCCGC | 20 | 11611 |
| BCL11A-4490 | + | GGGCCGAGGGGAGGGGCGC | 20 | 11612 |
| BCL11A-4442 | + | GCGGCGGCGGCGGCGGCGG | 20 | 11613 |
| BCL11A-9723 | + | AAUGGACACACAUCAGGGGC | 20 | 11614 |
| BCL11A-4439 | + | GCGGCCCCGGGGGAGGGGC | 20 | 11615 |
| BCL11A-5465 | + | GACAUGGUGGGCUGCGGGGC | 20 | 11616 |
| BCL11A-9724 | + | GGGAGGGGGAGGUGCGGGGC | 20 | 11617 |
| BCL11A-9725 | + | CGCCGCGGCGGUGGCGUGGC | 20 | 11618 |
| BCL11A-9726 | + | GGAGAGAAGAAAGGGGUGGC | 20 | 11619 |
| BCL11A-5468 | + | GGCGAGACAUGGUGGGCUGC | 20 | 11620 |
| BCL11A-9727 | + | GACAAGCCAAUGGCCAGUGC | 20 | 11621 |
| BCL11A-9728 | + | GUGCGGGGAGGGGAGGUGC | 20 | 11622 |
| BCL11A-9729 | + | CACACCAAUGGACACACAUC | 20 | 11623 |
| BCL11A-9730 | − | GAAAAAACCCUCAUCCCAUC | 20 | 11624 |
| BCL11A-9731 | − | ACUGAUGAAGAUAUUUCUC | 20 | 11625 |
| BCL11A-9732 | + | GAACUUGAACGUCAGGAGUC | 20 | 11626 |
| BCL11A-9733 | − | CCUCCCCCGGGGCCGCGUC | 20 | 11627 |
| BCL11A-4526 | + | AAAAAAAAAAAAAAAAAAG | 20 | 11628 |
| BCL11A-9734 | + | GUGGCCGGGAGAGAAGAAAG | 20 | 11629 |
| BCL11A-4629 | + | CAGGGCGAGCAGGAGAGAAG | 20 | 11630 |
| BCL11A-4577 | + | AGAGAAGGGGAGGAGGGAAG | 20 | 11631 |
| BCL11A-9735 | + | UGGGGCCGCGGGCUCACCAG | 20 | 11632 |
| BCL11A-9736 | + | AGAGAAGAAAGGGGUGGCAG | 20 | 11633 |
| BCL11A-9737 | + | CACCAAUGGACACACAUCAG | 20 | 11634 |
| BCL11A-9738 | − | CACUUGAACUUGCAGCUCAG | 20 | 11635 |
| BCL11A-4611 | − | CAAAAGCGAGGGGAGAGAG | 20 | 11636 |

TABLE 18B-continued

2nd Tier

| gRNA Name | DNA Strand | Targeting Domain | Target Site Length | SEQ ID NO: |
|---|---|---|---|---|
| BCL11A-4583 | − | AGCAAAAGCGAGGGGAGAG | 20 | 11637 |
| BCL11A-4677 | + | CGGGGGAGGGGCGGGCCGAG | 20 | 11638 |
| BCL11A-9739 | − | GGACUAGAAGCAAAAGCGAG | 20 | 11639 |
| BCL11A-4411 | + | GAGGGGCGGGCCGAGGGGAG | 20 | 11640 |
| BCL11A-4575 | + | AGACGCGGCCCCGGGGGAG | 20 | 11641 |
| BCL11A-9740 | + | GAGAGAGAGAAGAGAGAUAG | 20 | 11642 |
| BCL11A-9741 | + | CCUGCUCCCCCCCACACACG | 20 | 11643 |
| BCL11A-9742 | + | GGCUCCGCGGACGCCAGACG | 20 | 11644 |
| BCL11A-9743 | − | CUCGGCCCGCCCCUCCCCCG | 20 | 11645 |
| BCL11A-9744 | − | UCCCGGCCACGCCACCGCCG | 20 | 11646 |
| BCL11A-9745 | + | AGUGGCCGCAGCGAGCGCCG | 20 | 11647 |
| BCL11A-4642 | + | CCCGGGGGAGGGGCGGGCCG | 20 | 11648 |
| BCL11A-9746 | + | GGGAGGGGGCGCUGGGGCCG | 20 | 11649 |
| BCL11A-9747 | + | GUGCGGGGCGGGGGGCUCCG | 20 | 11650 |
| BCL11A-9748 | − | CAGGACUAGAAGCAAAAGCG | 20 | 11651 |
| BCL11A-9749 | + | GGAGGGGGAGGUGCGGGGCG | 20 | 11652 |
| BCL11A-9750 | + | CGAGCGCCGCGGCGGUGGCG | 20 | 11653 |
| BCL11A-9751 | + | ACAAGCCAAUGGCCAGUGCG | 20 | 11654 |
| BCL11A-9752 | + | UGCGGGGAGGGGGAGGUGCG | 20 | 11655 |
| BCL11A-9753 | − | CGAGGUAAAAGAGAUAAAGG | 20 | 11656 |
| BCL11A-9754 | − | ACUUGAACUUGCAGCUCAGG | 20 | 11657 |
| BCL11A-9755 | − | GACUAGAAGCAAAAGCGAGG | 20 | 11658 |
| BCL11A-4408 | + | GAGCAGGAGAGAAGGGGAGG | 20 | 11659 |
| BCL11A-4594 | + | AGGGGCGGGCCGAGGGGAGG | 20 | 11660 |
| BCL11A-9756 | + | CAAUGGCCAGUGCGGGGAGG | 20 | 11661 |
| BCL11A-9757 | − | UCGGCCCGCCCCUCCCCCGG | 20 | 11662 |
| BCL11A-4471 | + | GGCCGCAGCGAGCGCCGCGG | 20 | 11663 |
| BCL11A-4661 | + | CGCAGCGAGCGCCGCGGCGG | 20 | 11664 |
| BCL11A-4479 | + | GGCGGCGGCGGCGGCGGCGG | 20 | 11665 |
| BCL11A-4448 | + | GCGGGCGGCGCGGCGGCGG | 20 | 11666 |
| BCL11A-4501 | + | GGGGCGGGCGGCGGCGGCGG | 20 | 11667 |
| BCL11A-5484 | + | UGCGGGCGGGCGGCGGCGG | 20 | 11668 |
| BCL11A-5485 | + | GGCUGCGGGGCGGGCGGCGG | 20 | 11669 |
| BCL11A-5486 | + | GUGGGCUGCGGGGCGGGCGG | 20 | 11670 |
| BCL11A-9758 | + | GAGGGGGAGGUGCGGGGCGG | 20 | 11671 |
| BCL11A-9759 | + | GCAGGGGUGGGAGGAAAGGG | 20 | 11672 |
| BCL11A-9760 | − | CUUGAACUUGCAGCUCAGGG | 20 | 11673 |
| BCL11A-4443 | + | GCGGCGGCGGCGGCGGCGGG | 20 | 11674 |

TABLE 18B-continued

2nd Tier

| gRNA Name | DNA Strand | Targeting Domain | Target Site Length | SEQ ID NO: |
|---|---|---|---|---|
| BCL11A-5487 | + | AUGGUGGGCUGCGGGGCGGG | 20 | 11675 |
| BCL11A-9761 | + | AGGGGGAGGUGCGGGGCGGG | 20 | 11676 |
| BCL11A-4434 | + | GCCGGGAGAGAAGAAAGGGG | 20 | 11677 |
| BCL11A-4476 | + | GGCGAGCAGGAGAGAAGGGG | 20 | 11678 |
| BCL11A-9762 | + | GAAGAAAGGGGUGGCAGGGG | 20 | 11679 |
| BCL11A-4486 | + | GGGAGGGGCGGGCCGAGGGG | 20 | 11680 |
| BCL11A-4666 | + | CGCGGCCCCCGGGGAGGGG | 20 | 11681 |
| BCL11A-5489 | + | AGACAUGGUGGGCUGCGGGG | 20 | 11682 |
| BCL11A-9763 | + | AGCCAAUGGCCAGUGCGGGG | 20 | 11683 |
| BCL11A-9764 | + | GGGGAGGGGGAGGUGCGGGG | 20 | 11684 |
| BCL11A-9765 | + | UGGCCAGUGCGGGGAGGGGG | 20 | 11685 |
| BCL11A-4635 | + | CCAGACGCGGCCCCCGGGGG | 20 | 11686 |
| BCL11A-9766 | + | GGUGGGAGGAAAGGGUGGGG | 20 | 11687 |
| BCL11A-9767 | + | GGGUGGGAGGAAAGGGUGGG | 20 | 11688 |
| BCL11A-9768 | + | AAAGGGGUGGCAGGGGUGGG | 20 | 11689 |
| BCL11A-9769 | − | UUAGAGUCCGCGUGUGUGGG | 20 | 11690 |
| BCL11A-5490 | + | UUGCUUGCGGCGAGACAUGG | 20 | 11691 |
| BCL11A-9770 | + | GGGGUGGGAGGAAAGGGUGG | 20 | 11692 |
| BCL11A-9771 | + | GCCGAGGGGAGGGGGCGCUG | 20 | 11693 |
| BCL11A-9772 | − | CACCGCCGCGGCGCUCGCUG | 20 | 11694 |
| BCL11A-5497 | + | UCCCGUUUGCUUAAGUGCUG | 20 | 11695 |
| BCL11A-9773 | + | GGACAAGCCAAUGGCCAGUG | 20 | 11696 |
| BCL11A-9774 | + | AGUGCGGGGAGGGGGAGGUG | 20 | 11697 |
| BCL11A-9775 | + | AGGGGUGGGAGGAAAGGGUG | 20 | 11698 |
| BCL11A-9776 | − | UUUUAGAGUCCGCGUGUGUG | 20 | 11699 |
| BCL11A-9777 | + | GGCGCAGGGAAGAUGAAUUG | 20 | 11700 |
| BCL11A-5500 | + | GCUGGGGUUUGCCUUGCUUG | 20 | 11701 |
| BCL11A-9778 | + | GACAGAGACACACAAAACAU | 20 | 11702 |
| BCL11A-9779 | − | CCCCUCCCCGCACUGGCCAU | 20 | 11703 |
| BCL11A-9780 | + | ACACGGCAAUGGUUCCAGAU | 20 | 11704 |
| BCL11A-9781 | + | AUAAUUAUUAUUACUAUUAU | 20 | 11705 |
| BCL11A-9782 | − | GCCCCAGCGCCCCCUCCCCU | 20 | 11706 |
| BCL11A-9783 | + | GGCCGAGGGGAGGGGCGCU | 20 | 11707 |
| BCL11A-5509 | + | UUCCCGUUUGCUUAAGUGCU | 20 | 11708 |
| BCL11A-9784 | + | CAGGGGUGGGAGGAAAGGGU | 20 | 11709 |
| BCL11A-9785 | + | AAGAAAGGGGUGGCAGGGGU | 20 | 11710 |
| BCL11A-9786 | + | GCGCAGGGAAGAUGAAUUGU | 20 | 11711 |

TABLE 18B-continued

2nd Tier

| gRNA Name | DNA Strand | Targeting Domain | Target Site Length | SEQ ID NO: |
|---|---|---|---|---|
| BCL11A-9787 | + | UAAUUAUUAUUACUAUUAUU | 20 | 11712 |
| BCL11A-9788 | − | GUAUUAUUUCUAAUUUAUUU | 20 | 11713 |

Table 18C provides exemplary targeting domains for knocking down the BCL11A gene selected according to the third tier parameters. The targeting domains binds within the additional 500 bp (e.g., upstream or downstream) of a transcription start site (TSS), e.g., extending to 1 kb upstream and downstream of a TSS. It is contemplated herein that in an embodiment the targeting domain hybridizes to the target domain through complementary base pairing. Any of the targeting domains in the table can be used with a *S. pyogenes* eiCas9 molecule or eiCas9 fusion protein (e.g., an eiCas9 fused to a transcription repressor domain) to alter the BCL11A gene (e.g., reduce or eliminate BCL11A gene expression, BCL11A protein function, or the level of BCL11A protein). One or more gRNA may be used to target an eiCas9 to the promoter region of the BCL11A gene.

TABLE 18C

| gRNA Name | DNA Strand | Targeting Domain | Target Site Length | SEQ ID NO: |
|---|---|---|---|---|
| BCL11A-9789 | − | CACUCACCGUAAGAAAA | 17 | 11714 |
| BCL11A-9790 | + | CCUCUGGCCGGAACAAA | 17 | 11715 |
| BCL11A-9791 | + | CGAGGAGCCGGCACAAA | 17 | 11716 |
| BCL11A-9792 | − | UAUUUCUCUUUUCGAAA | 17 | 11717 |
| BCL11A-9793 | − | GGGAGCUGGUGGGGAAA | 17 | 11718 |
| BCL11A-9794 | − | AAGUGGCACUGUGGAAA | 17 | 11719 |
| BCL11A-9795 | + | GGGCUGCGGGUCCGAA | 17 | 11720 |
| BCL11A-9796 | + | GAAAUAAAGCGGCGGAA | 17 | 11721 |
| BCL11A-9797 | − | UGGGAGCUGGUGGGGAA | 17 | 11722 |
| BCL11A-9798 | − | AAAGUGGCACUGUGGAA | 17 | 11723 |
| BCL11A-9799 | + | GCCCGAGGGCGCCCCCA | 17 | 11724 |
| BCL11A-9800 | + | CGUCCUUCCCGGUCCCA | 17 | 11725 |
| BCL11A-9801 | + | CCCCCAAGGCCGAGCCA | 17 | 11726 |
| BCL11A-9802 | + | CCCGCGUGUGGACGCCA | 17 | 11727 |
| BCL11A-9597 | − | GUGUGUGGGGGGGAGCA | 17 | 11728 |
| BCL11A-9803 | + | AGGUGGGAGGGAGCGCA | 17 | 11729 |
| BCL11A-9804 | − | GGACACCAGCGCGCUCA | 17 | 11730 |
| BCL11A-9805 | + | CGCGCGGCCUGGAAAGA | 17 | 11731 |
| BCL11A-9806 | − | UCCGCGGAGUCGGGAGA | 17 | 11732 |
| BCL11A-9807 | + | CGCAGGCCGGGGCCCGA | 17 | 11733 |
| BCL11A-9808 | − | GAGAGGGCCGCGGCGA | 17 | 11734 |
| BCL11A-9809 | + | AGCUCCGCAGCGGGCGA | 17 | 11735 |
| BCL11A-9810 | − | CGUGGGACCGGGAAGGA | 17 | 11736 |
| BCL11A-9811 | − | GGUGUGCGUACGGAGGA | 17 | 11737 |
| BCL11A-9812 | + | AGGGCUGCGGGUCCGGA | 17 | 11738 |
| BCL11A-9813 | + | GGGGAAGCGCGGGCGGA | 17 | 11739 |
| BCL11A-9814 | − | AAAUGGGGGGGUAGGGA | 17 | 11740 |

TABLE 18C-continued

| gRNA Name | DNA Strand | Targeting Domain | Target Site Length | SEQ ID NO: |
|---|---|---|---|---|
| BCL11A-9815 | − | GAGCCGUGGGACCGGGA | 17 | 11741 |
| BCL11A-9816 | − | CGCGGCGGCGGCGGGGA | 17 | 11742 |
| BCL11A-9817 | + | GGCGAGGGGAGGUGGGA | 17 | 11743 |
| BCL11A-9818 | + | UCCAGCCUAAGUUUGGA | 17 | 11744 |
| BCL11A-9819 | − | AAUAAUGAACAAUGCUA | 17 | 11745 |
| BCL11A-9820 | − | GGAAGUGGGUGUGCGUA | 17 | 11746 |
| BCL11A-9821 | − | AAGAAAAUGGGGGGGUA | 17 | 11747 |
| BCL11A-9822 | + | ACCCCCCCAUUUUCUUA | 17 | 11748 |
| BCL11A-9823 | + | UCAUUAUUUUGCAAAAC | 17 | 11749 |
| BCL11A-9824 | + | AUAGAGCGAGAGUGCAC | 17 | 11750 |
| BCL11A-9825 | − | GAGAAAAGAGGUGAGAC | 17 | 11751 |
| BCL11A-9826 | − | AGAGGGCCGCGGCGAC | 17 | 11752 |
| BCL11A-9827 | − | GUGGGACCGGGAAGGAC | 17 | 11753 |
| BCL11A-9828 | + | AAGGCCGAGCCAGGGAC | 17 | 11754 |
| BCL11A-9829 | + | GCCUGGAAAGAGGGGAC | 17 | 11755 |
| BCL11A-9830 | − | GGGGAGAGCCGUGGGAC | 17 | 11756 |
| BCL11A-9831 | − | CAACUCACAUGCAAACC | 17 | 11757 |
| BCL11A-9832 | + | UAGAGCGAGAGUGCACC | 17 | 11758 |
| BCL11A-9833 | + | AGGCCGAGCCAGGGACC | 17 | 11759 |
| BCL11A-9834 | + | CCUGGAAAGAGGGGACC | 17 | 11760 |
| BCL11A-9835 | − | GGGAGAGCCGUGGGACC | 17 | 11761 |
| BCL11A-9836 | − | CCGGGAGCAACUCUACC | 17 | 11762 |
| BCL11A-9837 | + | CACCAGCUCCCACCCCC | 17 | 11763 |
| BCL11A-9838 | + | CGGGAGGCUGCAGCCCC | 17 | 11764 |
| BCL11A-9839 | − | GCUUUACUUCGGCCCC | 17 | 11765 |
| BCL11A-9840 | − | CUGUGGAAAGGGGCCCC | 17 | 11766 |
| BCL11A-9841 | + | UCACCUCUUUUCUCCCC | 17 | 11767 |
| BCL11A-9842 | − | CCGCGCUUCCCCAGCCC | 17 | 11768 |
| BCL11A-9843 | + | CCGGGAGGCUGCAGCCC | 17 | 11769 |
| BCL11A-9844 | − | GGGGCGCCCUCGGGCCC | 17 | 11770 |
| BCL11A-9845 | − | CGCCGCCUGCCUCUCCC | 17 | 11771 |
| BCL11A-9846 | + | CUCACCUCUUUUCUCCC | 17 | 11772 |
| BCL11A-9847 | − | UCUAAAAACGAUUCCC | 17 | 11773 |
| BCL11A-9848 | + | GCGGGCGGAGGGAAGCC | 17 | 11774 |
| BCL11A-9849 | − | CCCGCGCUUCCCCAGCC | 17 | 11775 |
| BCL11A-9850 | + | GCCCCCAAGGCCGAGCC | 17 | 11776 |
| BCL11A-9851 | + | CCCCGCGUGUGGACGCC | 17 | 11777 |
| BCL11A-9852 | + | GCGGACUCAGGAGCGCC | 17 | 11778 |

TABLE 18C-continued

| gRNA Name | DNA Strand | Targeting Domain | Target Site Length | SEQ ID NO: |
|---|---|---|---|---|
| BCL11A-9853 | + | GGCAGGCGGCGCAGGCC | 17 | 11779 |
| BCL11A-9854 | + | CAGGAGCCCGCGCGGCC | 17 | 11780 |
| BCL11A-9855 | - | CCGGGGCUGCAGCCUCC | 17 | 11781 |
| BCL11A-9856 | - | CAGGCCGCGCGGGCUCC | 17 | 11782 |
| BCL11A-9857 | + | CCAGGUAGAGUUGCUCC | 17 | 11783 |
| BCL11A-9858 | + | GCAGCGCCCAAGUCUCC | 17 | 11784 |
| BCL11A-9859 | - | UACGGAGGAGGGUGUCC | 17 | 11785 |
| BCL11A-9860 | - | GUCUAAAAAACGAUUCC | 17 | 11786 |
| BCL11A-9861 | + | GCGUCUCCCGUCCUUCC | 17 | 11787 |
| BCL11A-9862 | - | CCCGGUCCCCUCUUUCC | 17 | 11788 |
| BCL11A-9863 | + | AGUUACAGCUCCGCAGC | 17 | 11789 |
| BCL11A-9864 | + | CCGGCACAAAAGGCAGC | 17 | 11790 |
| BCL11A-9865 | - | ACGGUCAAGUGUGCAGC | 17 | 11791 |
| BCL11A-9866 | + | GGGCAAGCGCGAGGAGC | 17 | 11792 |
| BCL11A-9620 | - | CGUGUGUGGGGGGGAGC | 17 | 11793 |
| BCL11A-9867 | - | AACCUGGGGUGGGAGC | 17 | 11794 |
| BCL11A-9868 | - | CCCUGGCGUCCACACGC | 17 | 11795 |
| BCL11A-9869 | - | UUCCCGAGCGCAGCCGC | 17 | 11796 |
| BCL11A-9870 | + | CCGGGCUGGGGAAGCGC | 17 | 11797 |
| BCL11A-9871 | + | CGCGGACUCAGGAGCGC | 17 | 11798 |
| BCL11A-9872 | - | CUCUUUCCAGGCCGCGC | 17 | 11799 |
| BCL11A-9873 | + | CUUGACCGUGAGCGCGC | 17 | 11800 |
| BCL11A-9874 | + | GGAGAGGCAGGCGGCGC | 17 | 11801 |
| BCL11A-9875 | + | AGGCAGGCGGCGCAGGC | 17 | 11802 |
| BCL11A-9876 | + | GGGGACCGGGGAGAGGC | 17 | 11803 |
| BCL11A-9877 | - | GCCCUCCAAACUUAGGC | 17 | 11804 |
| BCL11A-9878 | - | AGGACGGGAGACGCGGC | 17 | 11805 |
| BCL11A-9879 | - | GCGAGCGCGGCGGCGGC | 17 | 11806 |
| BCL11A-9880 | + | AGGCUGCAGCCCCGGGC | 17 | 11807 |
| BCL11A-9881 | + | UGCAAAACUGGCGGGGC | 17 | 11808 |
| BCL11A-9882 | + | UAUUUUGCAAAACUGGC | 17 | 11809 |
| BCL11A-9883 | + | AAACACCCACCUCUGGC | 17 | 11810 |
| BCL11A-9884 | + | UAAGUUUGGAGGGCUGC | 17 | 11811 |
| BCL11A-9885 | + | ACAAAAGGCGGCAGUGC | 17 | 11812 |
| BCL11A-9886 | - | CCCGCUGCCUUUUGUGC | 17 | 11813 |
| BCL11A-9887 | + | CCCGACUCCGCGGACUC | 17 | 11814 |
| BCL11A-9888 | + | GGACAAACACCCACCUC | 17 | 11815 |
| BCL11A-9889 | - | GCCUUGGGGGCGCCCUC | 17 | 11816 |
| BCL11A-9890 | - | UUUGCUGUCCUCUCCUC | 17 | 11817 |

TABLE 18C-continued

| gRNA Name | DNA Strand | Targeting Domain | Target Site Length | SEQ ID NO: |
|---|---|---|---|---|
| BCL11A-9891 | + | AGCCCGCGGCUGCGCUC | 17 | 11818 |
| BCL11A-9892 | - | AGCGCAGCCGCGGGCUC | 17 | 11819 |
| BCL11A-9893 | - | CCUGAGUCCGCGGAGUC | 17 | 11820 |
| BCL11A-9894 | + | UUGGAGGGCUGCGGGUC | 17 | 11821 |
| BCL11A-9895 | - | GUACGGAGGAGGGUGUC | 17 | 11822 |
| BCL11A-9896 | - | GCUCAGCUCUCAACUUC | 17 | 11823 |
| BCL11A-9897 | - | CUUGGGCGCUGCCCUUC | 17 | 11824 |
| BCL11A-9898 | - | ACUGCCGCCUUUUGUUC | 17 | 11825 |
| BCL11A-9899 | - | AUUCCCGGGGAGAAAAG | 17 | 11826 |
| BCL11A-9900 | - | CCACAAUAGUGAGAAAG | 17 | 11827 |
| BCL11A-9901 | + | GGCGGAAAGGAGGAAAG | 17 | 11828 |
| BCL11A-9902 | + | CCGCGCGGCCUGGAAAG | 17 | 11829 |
| BCL11A-9903 | - | AGUGGCACUGUGGAAAG | 17 | 11830 |
| BCL11A-9904 | + | CGAAAAGAGAAAUAAAG | 17 | 11831 |
| BCL11A-9905 | - | GCGGCGGGGAGGGGAAG | 17 | 11832 |
| BCL11A-9906 | + | CCGCGUGUGGACGCCAG | 17 | 11833 |
| BCL11A-9907 | - | CCUUUUGUUCCGGCCAG | 17 | 11834 |
| BCL11A-9908 | + | AAGUUACAGCUCCGCAG | 17 | 11835 |
| BCL11A-9909 | + | GCCGGCACAAAAGGCAG | 17 | 11836 |
| BCL11A-9910 | - | CACGGUCAAGUGUGCAG | 17 | 11837 |
| BCL11A-9911 | + | GCGCGGCCUGGAAAGAG | 17 | 11838 |
| BCL11A-9912 | - | CCGCGGAGUCGGGAGAG | 17 | 11839 |
| BCL11A-9913 | + | GCUCCGCAGCGGGCGAG | 17 | 11840 |
| BCL11A-9914 | + | AAACUUUGCCCGAGGAG | 17 | 11841 |
| BCL11A-9915 | - | GUCCGCGGAGUCGGGAG | 17 | 11842 |
| BCL11A-9916 | + | AAGAGGGGACCGGGGAG | 17 | 11843 |
| BCL11A-9917 | - | GCGGCGGCGGCGGGGAG | 17 | 11844 |
| BCL11A-9918 | + | GCGGGGCGGGGGGGGAG | 17 | 11845 |
| BCL11A-9919 | + | CAUUUCUUACGGUGAG | 17 | 11846 |
| BCL11A-9920 | + | GGGAGCGCACGGCAACG | 17 | 11847 |
| BCL11A-9642 | + | GCUCCCCCCACACACG | 17 | 11848 |
| BCL11A-9921 | - | CCCCUGGCGUCCACACG | 17 | 11849 |
| BCL11A-9922 | - | GGGAAGGACGGGAGACG | 17 | 11850 |
| BCL11A-9923 | - | GAGGGGCCGCGGCGACG | 17 | 11851 |
| BCL11A-9924 | + | CUGGAAAGAGGGGACCG | 17 | 11852 |
| BCL11A-9925 | - | CGCGCUUCCCCAGCCCG | 17 | 11853 |
| BCL11A-9926 | + | UAAAAGCCCCGAGCCCG | 17 | 11854 |
| BCL11A-9927 | + | GCGCAGGCCGGGGCCCG | 17 | 11855 |

TABLE 18C-continued

| gRNA Name | DNA Strand | Targeting Domain | Target Site Length | SEQ ID NO: |
|---|---|---|---|---|
| BCL11A-9928 | + | UCGGGAAACUUUGCCCG | 17 | 11856 |
| BCL11A-9929 | - | CUAAAAAACGAUUCCCG | 17 | 11857 |
| BCL11A-9930 | - | UUUCCCGAGCGCAGCCG | 17 | 11858 |
| BCL11A-9931 | - | GGCGACGGGGAGAGCCG | 17 | 11859 |
| BCL11A-9932 | + | CGGACUCAGGAGCGCCG | 17 | 11860 |
| BCL11A-9933 | + | GGCUCUCCCCGUCGCCG | 17 | 11861 |
| BCL11A-9934 | + | GCAGGCGGCGCAGGCCG | 17 | 11862 |
| BCL11A-9935 | - | AGUCGGGAGAGGGGCCG | 17 | 11863 |
| BCL11A-9936 | + | CCCCUCUCCCGACUCCG | 17 | 11864 |
| BCL11A-9937 | - | CGGCGCUCCUGAGUCCG | 17 | 11865 |
| BCL11A-9938 | + | CCCGGGCUGGGGAAGCG | 17 | 11866 |
| BCL11A-9939 | - | CACGCGGGGAGCGAGCG | 17 | 11867 |
| BCL11A-9940 | - | CCUGGCGUCCACACGCG | 17 | 11868 |
| BCL11A-9941 | + | GUCUCCAGGAGCCCGCG | 17 | 11869 |
| BCL11A-9942 | - | CCUCUUUCCAGGCCGCG | 17 | 11870 |
| BCL11A-9943 | + | GCGGGAGGGCAAGCGCG | 17 | 11871 |
| BCL11A-9944 | - | CGAGCGCGGCGGCGGCG | 17 | 11872 |
| BCL11A-9945 | + | CAGCUCCGCAGCGGGCG | 17 | 11873 |
| BCL11A-9946 | + | GCAAAACUGGCGGGGCG | 17 | 11874 |
| BCL11A-9947 | + | AUUUUGCAAAACUGGCG | 17 | 11875 |
| BCL11A-9948 | - | GCGCAGCCGCGGGCUCG | 17 | 11876 |
| BCL11A-9949 | + | CUGGCCGGAACAAAAGG | 17 | 11877 |
| BCL11A-9950 | + | AUAAAGCGGCGGAAAGG | 17 | 11878 |
| BCL11A-9951 | + | GACCGGGGAGAGGCAGG | 17 | 11879 |
| BCL11A-9952 | + | GGAAAGGAGGAAAGAGG | 17 | 11880 |
| BCL11A-9953 | - | UUUGUUCCGGCCAGAGG | 17 | 11881 |
| BCL11A-9954 | - | GGGUGUGCGUACGGAGG | 17 | 11882 |
| BCL11A-9955 | + | CAGCGGGCGAGGGGAGG | 17 | 11883 |
| BCL11A-9956 | - | AGUGGGUGUGCGUACGG | 17 | 11884 |
| BCL11A-9957 | + | GGACUCAGGAGCGCCGG | 17 | 11885 |
| BCL11A-9958 | + | AAAGAGAAAUAAAGCGG | 17 | 11886 |
| BCL11A-9959 | - | GCGGGGAGCGAGCGCGG | 17 | 11887 |
| BCL11A-9960 | - | GGGAGCGAGCGCGGCGG | 17 | 11888 |
| BCL11A-9961 | - | AGCGAGCGCGGCGGCGG | 17 | 11889 |
| BCL11A-9962 | + | UGGGGAAGCGCGGGCGG | 17 | 11890 |
| BCL11A-9963 | + | CAAAACUGGCGGGGCGG | 17 | 11891 |
| BCL11A-9964 | - | AGCUGGUGGGGAAAGGG | 17 | 11892 |
| BCL11A-9965 | - | AAAAUGGGGGGGUAGGG | 17 | 11893 |
| BCL11A-9966 | + | AGCGAGAGUGCACCGGG | 17 | 11894 |

TABLE 18C-continued

| gRNA Name | DNA Strand | Targeting Domain | Target Site Length | SEQ ID NO: |
|---|---|---|---|---|
| BCL11A-9967 | - | GUCAAGUGUGCAGCGGG | 17 | 11895 |
| BCL11A-9968 | + | GGCUGGGGAAGCGCGGG | 17 | 11896 |
| BCL11A-9969 | + | AAAACUGGCGGGGCGGG | 17 | 11897 |
| BCL11A-9970 | + | CCGCAGCGGGCGAGGGG | 17 | 11898 |
| BCL11A-9971 | - | GCGCGGCGGCGGCGGGG | 17 | 11899 |
| BCL11A-9972 | + | AAACUGGCGGGGCGGGG | 17 | 11900 |
| BCL11A-9973 | + | UUGCAAAACUGGCGGGG | 17 | 11901 |
| BCL11A-9974 | + | AACUGGCGGGGCGGGGG | 17 | 11902 |
| BCL11A-9975 | - | ACAUGCAAACCUGGGGG | 17 | 11903 |
| BCL11A-9976 | - | ACCGUAAGAAAAUGGGG | 17 | 11904 |
| BCL11A-9548 | - | AGUCCGCGUGUGUGGGG | 17 | 11905 |
| BCL11A-9977 | - | CACCGUAAGAAAAUGGG | 17 | 11906 |
| BCL11A-9978 | + | GGGCGAGGGGAGGUGGG | 17 | 11907 |
| BCL11A-9668 | - | GAGUCCGCGUGUGUGGG | 17 | 11908 |
| BCL11A-9979 | - | UCACCGUAAGAAAAUGG | 17 | 11909 |
| BCL11A-9980 | + | UUAUUUGCAAAACUGG | 17 | 11910 |
| BCL11A-9981 | - | CUCACAUGCAAACCUGG | 17 | 11911 |
| BCL11A-9982 | - | CUGGGGGUGGGAGCUGG | 17 | 11912 |
| BCL11A-9670 | - | AGAGUCCGCGUGUGUGG | 17 | 11913 |
| BCL11A-9983 | - | GCGGAGCUGUAACUUGG | 17 | 11914 |
| BCL11A-9984 | - | CCCUGGCUCGGCCUUGG | 17 | 11915 |
| BCL11A-9985 | + | AUCCAGCCUAAGUUUGG | 17 | 11916 |
| BCL11A-9986 | - | CUCACCGUAAGAAAAUG | 17 | 11917 |
| BCL11A-9987 | - | GUGAGAAAGUGGCACUG | 17 | 11918 |
| BCL11A-9988 | - | ACUCACAUGCAAACCUG | 17 | 11919 |
| BCL11A-9989 | - | CCUCCCCUCGCCCGCUG | 17 | 11920 |
| BCL11A-9990 | + | CUAAGUUUGGAGGGCUG | 17 | 11921 |
| BCL11A-9991 | + | GCUGCAGCCCCGGGCUG | 17 | 11922 |
| BCL11A-9992 | + | CGCUCGCUCCCCGCGUG | 17 | 11923 |
| BCL11A-9993 | - | GGGGGUGGGAGCUGGUG | 17 | 11924 |
| BCL11A-9678 | - | UUUAGAGUCCGCGUGUG | 17 | 11925 |
| BCL11A-9549 | - | UAGAGUCCGCGUGUGUG | 17 | 11926 |
| BCL11A-9994 | + | ACUUCUCACUAUUGUG | 17 | 11927 |
| BCL11A-9995 | + | CCACUUUCUCACUAUUG | 17 | 11928 |
| BCL11A-9996 | - | UCCCUGGCUCGGCCUUG | 17 | 11929 |
| BCL11A-9997 | - | ACUCACCGUAAGAAAAU | 17 | 11930 |
| BCL11A-9998 | - | GCUGCGGAGCUGUAACU | 17 | 11931 |
| BCL11A-9999 | - | GCGGGCUCCUGGAGACU | 17 | 11932 |

TABLE 18C-continued

| gRNA Name | DNA Strand | Targeting Domain | Target Site Length | SEQ ID NO: |
|---|---|---|---|---|
| BCL11A-10000 | - | AACUCACAUGCAAACCU | 17 | 11933 |
| BCL11A-10001 | - | GGCCUUGGGGGCGCCCU | 17 | 11934 |
| BCL11A-10002 | - | GGUCCCUGGCUCGGCCU | 17 | 11935 |
| BCL11A-10003 | - | CUUUGCUGUCCUCUCCU | 17 | 11936 |
| BCL11A-10004 | + | GAGCCCGCGGCUGCGCU | 17 | 11937 |
| BCL11A-10005 | + | GGCUGCAGCCCCGGGCU | 17 | 11938 |
| BCL11A-10006 | - | GAGCGCAGCCGCGGGCU | 17 | 11939 |
| BCL11A-10007 | - | CGGCGGGGAGGGGAAGU | 17 | 11940 |
| BCL11A-10008 | - | UCCUGAGUCCGCGGAGU | 17 | 11941 |
| BCL11A-10009 | + | AUUUUCUUACGGUGAGU | 17 | 11942 |
| BCL11A-10010 | - | GCGACGGGGAGAGCCGU | 17 | 11943 |
| BCL11A-10011 | - | UUGUUCCGGCCAGAGGU | 17 | 11944 |
| BCL11A-10012 | + | AGCGGGCGAGGGGAGGU | 17 | 11945 |
| BCL11A-10013 | - | UAAGAAAAUGGGGGGGU | 17 | 11946 |
| BCL11A-10014 | - | CAUGCAAACCUGGGGGU | 17 | 11947 |
| BCL11A-10015 | - | UGGGGGUGGGAGCUGGU | 17 | 11948 |
| BCL11A-9687 | - | UUAGAGUCCGCGUGUGU | 17 | 11949 |
| BCL11A-10016 | + | CACUUUCUCACUAUUGU | 17 | 11950 |
| BCL11A-10017 | - | CGCAGCCCUCCAAACUU | 17 | 11951 |
| BCL11A-10018 | - | GGCUCAGCUCUCAACUU | 17 | 11952 |
| BCL11A-10019 | - | CGGGCUCCUGGAGACUU | 17 | 11953 |
| BCL11A-10020 | - | GCUCGGGGCUUUUACUU | 17 | 11954 |
| BCL11A-10021 | - | GUCCCUGGCUCGGCCUU | 17 | 11955 |
| BCL11A-10022 | + | GGAAUCCAGCCUAAGUU | 17 | 11956 |
| BCL11A-10023 | - | GAGGUGAGACUGGCUUU | 17 | 11957 |
| BCL11A-10024 | - | UCCCACUCACCGUAAGAAAA | 20 | 11958 |
| BCL11A-10025 | + | CCACCUCUGGCCGGAACAAA | 20 | 11959 |
| BCL11A-10026 | + | GCGCGAGGAGCCGGCACAAA | 20 | 11960 |
| BCL11A-10027 | - | CUUUAUUUCUCUUUUCGAAA | 20 | 11961 |
| BCL11A-10028 | - | GGUGGGAGCUGGUGGGGAAA | 20 | 11962 |
| BCL11A-10029 | - | AGAAAGUGGCACUGUGGAAA | 20 | 11963 |
| BCL11A-10030 | + | GGAGGGCUGCGGGUCCGGAA | 20 | 11964 |
| BCL11A-10031 | + | AGAGAAAUAAAGCGGCGGAA | 20 | 11965 |
| BCL11A-10032 | - | GGGUGGGAGCUGGUGGGGAA | 20 | 11966 |
| BCL11A-10033 | - | GAGAAAGUGGCACUGUGGAA | 20 | 11967 |
| BCL11A-10034 | + | GGGGCCCGAGGGCGCCCCA | 20 | 11968 |
| BCL11A-10035 | + | UCCCGUCCUUCCCGGUCCA | 20 | 11969 |
| BCL11A-10036 | + | GCGCCCCAAGGCCGAGCCA | 20 | 11970 |
| BCL11A-10037 | + | CUCCCCGCGUGUGGACGCCA | 20 | 11971 |

TABLE 18C-continued

| gRNA Name | DNA Strand | Targeting Domain | Target Site Length | SEQ ID NO: |
|---|---|---|---|---|
| BCL11A-9701 | - | CGCGUGUGUGGGGGGGAGCA | 20 | 11972 |
| BCL11A-10038 | + | GGGAGGUGGGAGGGAGCGCA | 20 | 11973 |
| BCL11A-10039 | - | UUUGGACACCAGCGCGCUCA | 20 | 11974 |
| BCL11A-10040 | + | GCCCGCGCGGCCUGGAAAGA | 20 | 11975 |
| BCL11A-10041 | - | GAGUCCGCGGAGUCGGGAGA | 20 | 11976 |
| BCL11A-10042 | + | CGGCGCAGGCCGGGGCCCGA | 20 | 11977 |
| BCL11A-10043 | - | CGGGAGAGGGGCCGCGGCGA | 20 | 11978 |
| BCL11A-10044 | + | UACAGCUCCGCAGCGGGCGA | 20 | 11979 |
| BCL11A-10045 | - | AGCCGUGGGACCGGGAAGGA | 20 | 11980 |
| BCL11A-10046 | - | GUGGGUGUGCGUACGGAGGA | 20 | 11981 |
| BCL11A-10047 | + | UGGAGGGCUGCGGGUCCGGA | 20 | 11982 |
| BCL11A-10048 | + | GCUGGGGAAGCGCGGGCGGA | 20 | 11983 |
| BCL11A-10049 | - | AGAAAAUGGGGGGGUAGGGA | 20 | 11984 |
| BCL11A-10050 | - | GGAGAGCCGUGGGACCGGGA | 20 | 11985 |
| BCL11A-10051 | - | GAGCGCGGCGGCGGCGGGGA | 20 | 11986 |
| BCL11A-10052 | + | GCGGGCGAGGGGAGGUGGGA | 20 | 11987 |
| BCL11A-10053 | + | GAAUCCAGCCUAAGUUUGGA | 20 | 11988 |
| BCL11A-10054 | - | CAAAAUAAUGAACAAUGCUA | 20 | 11989 |
| BCL11A-10055 | - | AGGGGAAGUGGGUGUGCGUA | 20 | 11990 |
| BCL11A-10056 | - | CGUAAGAAAAUGGGGGGGUA | 20 | 11991 |
| BCL11A-10057 | + | CCUACCCCCCCAUUUUCUUA | 20 | 11992 |
| BCL11A-10058 | + | UGUUCAUUAUUUUGCAAAAC | 20 | 11993 |
| BCL11A-10059 | + | AAAAUAGAGCGAGAGUGCAC | 20 | 11994 |
| BCL11A-10060 | - | GGGGAGAAAAGAGGUGAGAC | 20 | 11995 |
| BCL11A-10061 | - | GGGAGAGGGGCCGCGGCGAC | 20 | 11996 |
| BCL11A-10062 | - | GCCGUGGGACCGGGAAGGAC | 20 | 11997 |
| BCL11A-10063 | + | CCCAAGGCCGAGCCAGGGAC | 20 | 11998 |
| BCL11A-10064 | + | GCGGCCUGGAAAGAGGGGAC | 20 | 11999 |
| BCL11A-10065 | - | GACGGGGAGAGCCGUGGGAC | 20 | 12000 |
| BCL11A-10066 | - | GAACAACUCACAUGCAAACC | 20 | 12001 |
| BCL11A-10067 | + | AAAUAGAGCGAGAGUGCACC | 20 | 12002 |
| BCL11A-10068 | + | CCAAGGCCGAGCCAGGGACC | 20 | 12003 |
| BCL11A-10069 | + | CGGCCUGGAAAGAGGGGACC | 20 | 12004 |
| BCL11A-10070 | - | ACGGGGAGAGCCGUGGGACC | 20 | 12005 |
| BCL11A-10071 | - | UGUCCGGGAGCAACUCUACC | 20 | 12006 |
| BCL11A-10072 | + | CCCCACCAGCUCCCACCCCC | 20 | 12007 |
| BCL11A-10073 | + | CACCGGGAGGCUGCAGCCCC | 20 | 12008 |
| BCL11A-10074 | - | GGGGCUUUUACUUCGGCCCC | 20 | 12009 |

TABLE 18C-continued

| gRNA Name | DNA Strand | Targeting Domain | Target Site Length | SEQ ID NO: |
|---|---|---|---|---|
| BCL11A-10075 | - | GCACUGUGGAAAGGGGCCCC | 20 | 12010 |
| BCL11A-10076 | + | GUCUCACCUCUUUUCUCCCC | 20 | 12011 |
| BCL11A-10077 | - | CGCCCGCGCUUCCCCAGCCC | 20 | 12012 |
| BCL11A-10078 | + | GCACCGGGAGGCUGCAGCCC | 20 | 12013 |
| BCL11A-10079 | - | UUGGGGGCGCCCUCGGGCCC | 20 | 12014 |
| BCL11A-10080 | - | CUGCGCCGCCUGCCUCUCCC | 20 | 12015 |
| BCL11A-10081 | + | AGUCUCACCUCUUUUCUCCC | 20 | 12016 |
| BCL11A-10082 | - | AAGUCUAAAAAACGAUUCCC | 20 | 12017 |
| BCL11A-10083 | + | AGCGCGGGCGGAGGGAAGCC | 20 | 12018 |
| BCL11A-10084 | - | CCGCCCGCGCUUCCCCAGCC | 20 | 12019 |
| BCL11A-10085 | + | GGCGCCCCAAGGCCGAGCC | 20 | 12020 |
| BCL11A-10086 | + | GCUCCCCGCGUGUGGACGCC | 20 | 12021 |
| BCL11A-10087 | + | UCCGCGGACUCAGGAGCGCC | 20 | 12022 |
| BCL11A-10088 | + | AGAGGCAGGCGGCGCAGGCC | 20 | 12023 |
| BCL11A-10089 | + | CUCCAGGAGCCCGCGCGGCC | 20 | 12024 |
| BCL11A-10090 | - | AGCCCGGGGCUGCAGCCUCC | 20 | 12025 |
| BCL11A-10091 | - | UUCCAGGCCGCGCGGGCUCC | 20 | 12026 |
| BCL11A-10092 | + | AAGCCAGGUAGAGUUGCUCC | 20 | 12027 |
| BCL11A-10093 | + | AGGGCAGCGCCCAAGUCUCC | 20 | 12028 |
| BCL11A-10094 | - | GCGUACGGAGGAGGGUGUCC | 20 | 12029 |
| BCL11A-10095 | - | CAAGUCUAAAAAACGAUUCC | 20 | 12030 |
| BCL11A-10096 | + | GCCGCGUCUCCCGUCCUUCC | 20 | 12031 |
| BCL11A-10097 | - | CUCCCCGGUCCCCUCUUUCC | 20 | 12032 |
| BCL11A-10098 | + | CCAAGUUACAGCUCCGCAGC | 20 | 12033 |
| BCL11A-10099 | + | GAGCCGGCACAAAAGGCAGC | 20 | 12034 |
| BCL11A-10100 | - | CUCACGGUCAAGUGUGCAGC | 20 | 12035 |
| BCL11A-10101 | + | GGAGGGCAAGCGCGAGGAGC | 20 | 12036 |
| BCL11A-9563 | - | CCGCGUGUGUGGGGGGGAGC | 20 | 12037 |
| BCL11A-10102 | - | GCAAACCUGGGGGUGGGAGC | 20 | 12038 |
| BCL11A-10103 | - | GGCCCCUGGCGUCCACACGC | 20 | 12039 |
| BCL11A-10104 | - | AGUUUCCCGAGCGCAGCCGC | 20 | 12040 |
| BCL11A-10105 | + | GCCCCGGGCUGGGGAAGCGC | 20 | 12041 |
| BCL11A-10106 | + | CUCCGCGGACUCAGGAGCGC | 20 | 12042 |
| BCL11A-10107 | - | CCCCUCUUUCCAGGCCGCGC | 20 | 12043 |
| BCL11A-10108 | + | ACACUUGACCGUGAGCGCGC | 20 | 12044 |
| BCL11A-10109 | + | CGGGGAGAGGCAGGCGGCGC | 20 | 12045 |
| BCL11A-10110 | + | GAGAGGCAGGCGGCGCAGGC | 20 | 12046 |
| BCL11A-10111 | + | AGAGGGGACCGGGGAGAGGC | 20 | 12047 |
| BCL11A-10112 | - | GCAGCCCUCCAAACUUAGGC | 20 | 12048 |

TABLE 18C-continued

| gRNA Name | DNA Strand | Targeting Domain | Target Site Length | SEQ ID NO: |
|---|---|---|---|---|
| BCL11A-10113 | - | GGAAGGACGGGAGACGCGGC | 20 | 12049 |
| BCL11A-10114 | - | GGAGCGAGCGCGGCGGCGGC | 20 | 12050 |
| BCL11A-10115 | + | GGGAGGCUGCAGCCCCGGGC | 20 | 12051 |
| BCL11A-10116 | + | UUUUGCAAAACUGGCGGGGC | 20 | 12052 |
| BCL11A-10117 | + | CAUUAUUUGCAAAACUGGC | 20 | 12053 |
| BCL11A-10118 | + | GACAAACACCCACCUCUGGC | 20 | 12054 |
| BCL11A-10119 | + | GCCUAAGUUUGGAGGGCUGC | 20 | 12055 |
| BCL11A-10120 | + | GGAACAAAAGGCGGCAGUGC | 20 | 12056 |
| BCL11A-10121 | - | UGUCCCGCUGCCUUUUGUGC | 20 | 12057 |
| BCL11A-10122 | + | UCUCCCGACUCCGCGGACUC | 20 | 12058 |
| BCL11A-10123 | + | GCGGGACAAACACCCACCUC | 20 | 12059 |
| BCL11A-10124 | - | UCGGCCUUGGGGGCGCCCUC | 20 | 12060 |
| BCL11A-10125 | - | UUCUUUGCUGUCCUCUCCUC | 20 | 12061 |
| BCL11A-10126 | + | CCGAGCCCGCGGCUGCGCUC | 20 | 12062 |
| BCL11A-10127 | - | CCGAGCGCAGCCGCGGGCUC | 20 | 12063 |
| BCL11A-10128 | - | GCUCCUGAGUCCGCGGAGUC | 20 | 12064 |
| BCL11A-10129 | + | AGUUUGGAGGGCUGCGGGUC | 20 | 12065 |
| BCL11A-10130 | - | UGCGUACGGAGGAGGGUGUC | 20 | 12066 |
| BCL11A-10131 | - | GAGGCUCAGCUCUCAACUUC | 20 | 12067 |
| BCL11A-10132 | - | AGACUUGGGCGCUGCCCUUC | 20 | 12068 |
| BCL11A-10133 | - | GGCACUGCCGCCUUUUGUUC | 20 | 12069 |
| BCL11A-10134 | - | ACGAUUCCCGGGGAGAAAAG | 20 | 12070 |
| BCL11A-10135 | - | UCCCCACAAUAGUGAGAAAG | 20 | 12071 |
| BCL11A-10136 | + | AGCGGCGGAAAGGAGGAAAG | 20 | 12072 |
| BCL11A-10137 | + | AGCCCGCGCGGCCUGGAAAG | 20 | 12073 |
| BCL11A-10138 | - | GAAAGUGGCACUGUGGAAAG | 20 | 12074 |
| BCL11A-10139 | + | UUUCGAAAAGAGAAAUAAAG | 20 | 12075 |
| BCL11A-10140 | - | GCGGCGGCGGGGAGGGGAAG | 20 | 12076 |
| BCL11A-10141 | + | UCCCCGCGUGUGGACGCCAG | 20 | 12077 |
| BCL11A-10142 | - | CCGCCUUUUGUUCCGGCCAG | 20 | 12078 |
| BCL11A-10143 | + | UCCAAGUUACAGCUCCGCAG | 20 | 12079 |
| BCL11A-10144 | + | GGAGCCGGCACAAAAGGCAG | 20 | 12080 |
| BCL11A-10145 | - | GCUCACGGUCAAGUGUGCAG | 20 | 12081 |
| BCL11A-10146 | + | CCCGCGCGGCCUGGAAAGAG | 20 | 12082 |
| BCL11A-10147 | - | AGUCCGCGGAGUCGGGAGAG | 20 | 12083 |
| BCL11A-10148 | + | ACAGCUCCGCAGCGGGCGAG | 20 | 12084 |
| BCL11A-10149 | + | GGGAAACUUUGCCCGAGGAG | 20 | 12085 |
| BCL11A-10150 | - | UGAGUCCGCGGAGUCGGGAG | 20 | 12086 |

TABLE 18C-continued

| gRNA Name | DNA Strand | Targeting Domain | Target Site Length | SEQ ID NO: |
|---|---|---|---|---|
| BCL11A-10151 | + | GGAAAGAGGGGACCGGGGAG | 20 | 12087 |
| BCL11A-10152 | - | AGCGCGGCGGCGGCGGGGAG | 20 | 12088 |
| BCL11A-10153 | + | CUGGCGGGGCGGGGGGGGAG | 20 | 12089 |
| BCL11A-10154 | + | CCCCAUUUCUUACGGUGAG | 20 | 12090 |
| BCL11A-10155 | + | GGAGGGAGCGCACGGCAACG | 20 | 12091 |
| BCL11A-9741 | + | CCUGCUCCCCCCCACACACG | 20 | 12092 |
| BCL11A-10156 | - | CGGCCCCUGGCGUCCACACG | 20 | 12093 |
| BCL11A-10157 | - | ACCGGGAAGGACGGGAGACG | 20 | 12094 |
| BCL11A-10158 | - | GGAGAGGGGCCGCGGCGACG | 20 | 12095 |
| BCL11A-10159 | + | GGCCUGGAAAGAGGGGACCG | 20 | 12096 |
| BCL11A-10160 | - | GCCCGCGCUUCCCCAGCCCG | 20 | 12097 |
| BCL11A-10161 | + | AAGUAAAAGCCCCGAGCCCG | 20 | 12098 |
| BCL11A-10162 | + | GCGGCGCAGGCCGGGGCCCG | 20 | 12099 |
| BCL11A-10163 | + | CGCUCGGGAAACUUUGCCCG | 20 | 12100 |
| BCL11A-10164 | - | AGUCUAAAAAACGAUUCCCG | 20 | 12101 |
| BCL11A-10165 | - | AAGUUUCCCGAGCGCAGCCG | 20 | 12102 |
| BCL11A-10166 | - | CGCGGCGACGGGGAGAGCCG | 20 | 12103 |
| BCL11A-10167 | + | CCGCGGACUCAGGAGCGCCG | 20 | 12104 |
| BCL11A-10168 | + | CACGGCUCUCCCCGUCGCCG | 20 | 12105 |
| BCL11A-10169 | + | GAGGCAGGCGGCGCAGGCCG | 20 | 12106 |
| BCL11A-10170 | - | CGGAGUCGGGAGAGGGGCCG | 20 | 12107 |
| BCL11A-10171 | + | CGGCCCCUCUCCCGACUCCG | 20 | 12108 |
| BCL11A-10172 | - | CCCCGGCGCUCCUGAGUCCG | 20 | 12109 |
| BCL11A-10173 | + | AGCCCCGGGCUGGGGAAGCG | 20 | 12110 |
| BCL11A-10174 | - | CCACACGCGGGGAGCGAGCG | 20 | 12111 |
| BCL11A-10175 | - | GCCCUGGCGUCCACACGCG | 20 | 12112 |
| BCL11A-10176 | + | CAAGUCUCCAGGAGCCCGCG | 20 | 12113 |
| BCL11A-10177 | - | UCCCCUCUUUCCAGGCCGCG | 20 | 12114 |
| BCL11A-10178 | + | GGCGCGGGAGGGCAAGCGCG | 20 | 12115 |
| BCL11A-10179 | - | GAGCGAGCGCGGCGGCGGCG | 20 | 12116 |
| BCL11A-10180 | + | UUACAGCUCCGCAGCGGGCG | 20 | 12117 |
| BCL11A-10181 | + | UUUGCAAAACUGGCGGGGCG | 20 | 12118 |
| BCL11A-10182 | + | AUUAUUUUGCAAAACUGGCG | 20 | 12119 |
| BCL11A-10183 | - | CGAGCGCAGCCGCGGGCUCG | 20 | 12120 |
| BCL11A-10184 | + | CCUCUGGCCGGAACAAAAGG | 20 | 12121 |
| BCL11A-10185 | + | GAAAUAAAGCGGCGGAAAGG | 20 | 12122 |
| BCL11A-10186 | + | GGGGACCGGGGAGAGGCAGG | 20 | 12123 |
| BCL11A-10187 | + | GGCGGAAAGGAGGAAAGAGG | 20 | 12124 |
| BCL11A-10188 | - | CCUUUUGUUCCGGCCAGAGG | 20 | 12125 |

TABLE 18C-continued

| gRNA Name | DNA Strand | Targeting Domain | Target Site Length | SEQ ID NO: |
|---|---|---|---|---|
| BCL11A-10189 | - | AGUGGGUGUGCGUACGGAGG | 20 | 12126 |
| BCL11A-10190 | + | CCGCAGCGGGCGAGGGGAGG | 20 | 12127 |
| BCL11A-10191 | - | GGAAGUGGGUGUGCGUACGG | 20 | 12128 |
| BCL11A-10192 | + | CGCGGACUCAGGAGCGCCGG | 20 | 12129 |
| BCL11A-10193 | + | CGAAAAGAGAAAUAAAGCGG | 20 | 12130 |
| BCL11A-10194 | - | CACGCGGGGAGCGAGCGCGG | 20 | 12131 |
| BCL11A-10195 | - | GCGGGGAGCGAGCGCGGCGG | 20 | 12132 |
| BCL11A-10196 | - | GGGAGCGAGCGCGGCGGCGG | 20 | 12133 |
| BCL11A-10197 | + | GGCUGGGGAAGCGCGGGCGG | 20 | 12134 |
| BCL11A-10198 | + | UUGCAAAACUGGCGGGGCGG | 20 | 12135 |
| BCL11A-10199 | - | GGGAGCUGGUGGGGAAAGGG | 20 | 12136 |
| BCL11A-10200 | - | AAGAAAAUGGGGGGUAGGG | 20 | 12137 |
| BCL11A-10201 | + | UAGAGCGAGAGUGCACCGGG | 20 | 12138 |
| BCL11A-10202 | - | ACGGUCAAGUGUGCAGCGGG | 20 | 12139 |
| BCL11A-10203 | + | CCGGGCUGGGGAAGCGCGGG | 20 | 12140 |
| BCL11A-10204 | + | UGCAAAACUGGCGGGGCGGG | 20 | 12141 |
| BCL11A-10205 | + | GCUCCGCAGCGGGCGAGGGG | 20 | 12142 |
| BCL11A-10206 | - | CGAGCGCGGCGGCGGCGGGG | 20 | 12143 |
| BCL11A-10207 | + | GCAAAACUGGCGGGGCGGGG | 20 | 12144 |
| BCL11A-10208 | + | AUUUUGCAAAACUGGCGGGG | 20 | 12145 |
| BCL11A-10209 | + | CAAAACUGGCGGGGCGGGGG | 20 | 12146 |
| BCL11A-10210 | - | CUCACAUGCAAACCUGGGGG | 20 | 12147 |
| BCL11A-10211 | - | CUCACCGUAAGAAAAUGGGG | 20 | 12148 |
| BCL11A-9577 | - | UAGAGUCCGCGUGUGUGGGG | 20 | 12149 |
| BCL11A-10212 | - | ACUCACCGUAAGAAAAUGGG | 20 | 12150 |
| BCL11A-10213 | + | AGCGGGCGAGGGGAGGUGGG | 20 | 12151 |
| BCL11A-9769 | - | UUAGAGUCCGCGUGUGUGGG | 20 | 12152 |
| BCL11A-10214 | - | CACUCACCGUAAGAAAAUGG | 20 | 12153 |
| BCL11A-10215 | + | UCAUUAUUUUGCAAAACUGG | 20 | 12154 |
| BCL11A-10216 | - | CAACUCACAUGCAAACCUGG | 20 | 12155 |
| BCL11A-10217 | - | AACCUGGGGUGGGAGCUGG | 20 | 12156 |
| BCL11A-9578 | - | UUUAGAGUCCGCGUGUGUGG | 20 | 12157 |
| BCL11A-10218 | - | GCUGCGGAGCUGUAACUUGG | 20 | 12158 |
| BCL11A-10219 | - | GGUCCCUGGCUCGGCCUUGG | 20 | 12159 |
| BCL11A-10220 | + | GGAAUCCAGCCUAAGUUUGG | 20 | 12160 |
| BCL11A-10221 | - | CCACUCACCGUAAGAAAAUG | 20 | 12161 |
| BCL11A-10222 | - | AUAGUGAGAAAGUGGCACUG | 20 | 12162 |
| BCL11A-10223 | - | ACAACUCACAUGCAAACCUG | 20 | 12163 |

TABLE 18C-continued

| gRNA Name | DNA Strand | Targeting Domain | Target Site Length | SEQ ID NO: |
|---|---|---|---|---|
| BCL11A-10224 | - | CCACCUCCCCUCGCCCGCUG | 20 | 12164 |
| BCL11A-10225 | + | AGCCUAAGUUUGGAGGGCUG | 20 | 12165 |
| BCL11A-10226 | + | GAGGCUGCAGCCCCGGGCUG | 20 | 12166 |
| BCL11A-10227 | + | CCGCGCUCGCUCCCCGCGUG | 20 | 12167 |
| BCL11A-10228 | - | CCUGGGGGUGGGAGCUGGUG | 20 | 12168 |
| BCL11A-9581 | - | CAUUUUAGAGUCCGCGUGUG | 20 | 12169 |
| BCL11A-9776 | - | UUUUAGAGUCCGCGUGUGUG | 20 | 12170 |
| BCL11A-10229 | + | GCCACUUUCUCACUAUUGUG | 20 | 12171 |
| BCL11A-10230 | + | GUGCCACUUUCUCACUAUUG | 20 | 12172 |
| BCL11A-10231 | - | CGGUCCCUGGCUCGGCCUUG | 20 | 12173 |
| BCL11A-10232 | - | CCCACUCACCGUAAGAAAAU | 20 | 12174 |
| BCL11A-10233 | - | CCCGCUGCGGAGCUGUAACU | 20 | 12175 |
| BCL11A-10234 | - | CGCGCGGGCUCCUGGAGACU | 20 | 12176 |
| BCL11A-10235 | - | AACAACUCACAUGCAAACCU | 20 | 12177 |
| BCL11A-10236 | - | CUCGGCCUUGGGGCGCCCU | 20 | 12178 |
| BCL11A-10237 | - | CCCGGUCCCUGGCUCGGCCU | 20 | 12179 |
| BCL11A-10238 | - | UUUCUUUGCUGUCCUCUCCU | 20 | 12180 |
| BCL11A-10239 | + | CCCGAGCCCGCGGCUGCGCU | 20 | 12181 |
| BCL11A-10240 | + | GGAGGCUGCAGCCCCGGGCU | 20 | 12182 |
| BCL11A-10241 | - | CCCGAGCGCAGCCGCGGGCU | 20 | 12183 |
| BCL11A-10242 | - | CGGCGGCGGGGAGGGGAAGU | 20 | 12184 |
| BCL11A-10243 | - | CGCUCCUGAGUCCGCGGAGU | 20 | 12185 |
| BCL11A-10244 | + | CCCAUUUUCUUACGGUGAGU | 20 | 12186 |
| BCL11A-10245 | - | GCGGCGACGGGGAGAGCCGU | 20 | 12187 |
| BCL11A-10246 | - | CUUUUGUUCCGGCCAGAGGU | 20 | 12188 |
| BCL11A-10247 | + | CGCAGCGGGCGAGGGGAGGU | 20 | 12189 |
| BCL11A-10248 | - | CCGUAAGAAAAUGGGGGGGU | 20 | 12190 |
| BCL11A-10249 | - | UCACAUGCAAACCUGGGGGU | 20 | 12191 |
| BCL11A-10250 | - | ACCUGGGGGUGGGAGCUGGU | 20 | 12192 |
| BCL11A-9586 | - | AUUUUAGAGUCCGCGUGUGU | 20 | 12193 |
| BCL11A-10251 | + | UGCCACUUUCUCACUAUUGU | 20 | 12194 |
| BCL11A-10252 | - | ACCCGCAGCCCUCCAAACUU | 20 | 12195 |
| BCL11A-10253 | - | GGAGGCUCAGCUCUCAACUU | 20 | 12196 |
| BCL11A-10254 | - | GCGCGGGCUCCUGGAGACUU | 20 | 12197 |
| BCL11A-10255 | - | CGGGCUCGGGGCUUUUACUU | 20 | 12198 |
| BCL11A-10256 | - | CCGGUCCCUGGCUCGGCCUU | 20 | 12199 |
| BCL11A-10257 | + | CGCGGAAUCCAGCCUAAGUU | 20 | 12200 |
| BCL11A-10258 | - | AAAGAGGUGAGACUGGCUUU | 20 | 12201 |

Table 19A provides exemplary targeting domains for knocking down the BCL11A gene selected according to the first tier parameters. The targeting domains bind within 500 bp (e.g., upstream or downstream) of a transcription start site (TSS) and have a high level of orthogonality, and the PAM is NNGRRT. It is contemplated herein that in an embodiment the targeting domain hybridizes to the target domain through complementary base pairing. Any of the targeting domains in the table can be used with a *S. aureus* eiCas9 molecule or eiCas9 fusion protein (e.g., an eiCas9 fused to a transcription repressor domain) to alter the BCL11A gene (e.g., reduce or eliminate BCL11A gene expression, BCL11A protein function, or the level of BCL11A protein). One or more gRNA may be used to target an eiCas9 to the promoter region of the BCL11A gene.

TABLE 19A

1st Tier

| gRNA Name | DNA Strand | Targeting Domain | Target Site Length | SEQ ID NO: |
|---|---|---|---|---|
| BCL11A-10259 | + | GGCGUGGCCGGGAGAGAAGAA | 21 | 12202 |
| BCL11A-10260 | + | UGGCGUGGCCGGGAGAGAAGAA | 22 | 12203 |
| BCL11A-10261 | + | GUGGCGUGGCCGGGAGAGAAGAA | 23 | 12204 |
| BCL11A-10262 | + | GGUGGCGUGGCCGGGAGAGAAGAA | 24 | 12205 |
| BCL11A-10263 | + | CACGGCAAUGGUUCCAGA | 18 | 12206 |
| BCL11A-10264 | + | ACACGGCAAUGGUUCCAGA | 19 | 12207 |
| BCL11A-9557 | + | UACACGGCAAUGGUUCCAGA | 20 | 12208 |
| BCL11A-10265 | + | AUACACGGCAAUGGUUCCAGA | 21 | 12209 |
| BCL11A-10266 | + | CAUACACGGCAAUGGUUCCAGA | 22 | 12210 |
| BCL11A-10267 | + | GCAUACACGGCAAUGGUUCCAGA | 23 | 12211 |
| BCL11A-10268 | + | UGCAUACACGGCAAUGGUUCCAGA | 24 | 12212 |
| BCL11A-6258 | + | UUAUUGGGUUACUUACGC | 18 | 12213 |
| BCL11A-6259 | + | AUUAUUGGGUUACUUACGC | 19 | 12214 |
| BCL11A-6260 | + | UAUUAUUGGGUUACUUACGC | 20 | 12215 |
| BCL11A-6261 | + | CUAUUAUUGGGUUACUUACGC | 21 | 12216 |
| BCL11A-6262 | + | ACUAUUAUUGGGUUACUUACGC | 22 | 12217 |
| BCL11A-6263 | + | UACUAUUAUUGGGUUACUUACGC | 23 | 12218 |
| BCL11A-6264 | + | UUACUAUUAUUGGGUUACUUACGC | 24 | 12219 |
| BCL11A-10269 | + | GGGAGAGAAGAAAGGGGUGGC | 21 | 12220 |
| BCL11A-10270 | + | CGGGAGAGAAGAAAGGGGUGGC | 22 | 12221 |
| BCL11A-10271 | + | CCGGGAGAGAAGAAAGGGGUGGC | 23 | 12222 |
| BCL11A-10272 | + | GCCGGGAGAGAAGAAAGGGGUGGC | 24 | 12223 |
| BCL11A-6265 | + | UCCCGUUUGCUUAAGUGC | 18 | 12224 |
| BCL11A-6266 | + | UUCCCGUUUGCUUAAGUGC | 19 | 12225 |
| BCL11A-5352 | + | AUUCCCGUUUGCUUAAGUGC | 20 | 12226 |
| BCL11A-6267 | + | AAUUCCCGUUUGCUUAAGUGC | 21 | 12227 |
| BCL11A-6268 | + | GAAUUCCCGUUUGCUUAAGUGC | 22 | 12228 |
| BCL11A-6269 | + | AGAAUUCCCGUUUGCUUAAGUGC | 23 | 12229 |
| BCL11A-6270 | + | GAGAAUUCCCGUUUGCUUAAGUGC | 24 | 12230 |
| BCL11A-10273 | + | CCUGCGAACUUGAACGUC | 18 | 12231 |
| BCL11A-10274 | + | CCCUGCGAACUUGAACGUC | 19 | 12232 |
| BCL11A-9570 | + | UCCCUGCGAACUUGAACGUC | 20 | 12233 |

TABLE 19A-continued

| | 1st Tier | | | |
|---|---|---|---|---|
| gRNA Name | DNA Strand | Targeting Domain | Target Site Length | SEQ ID NO: |
| BCL11A-10275 | + | GUCCCUGCGAACUUGAACGUC | 21 | 12234 |
| BCL11A-10276 | + | CGUCCCUGCGAACUUGAACGUC | 22 | 12235 |
| BCL11A-10277 | + | ACGUCCCUGCGAACUUGAACGUC | 23 | 12236 |
| BCL11A-10278 | + | GACGUCCCUGCGAACUUGAACGUC | 24 | 12237 |
| BCL11A-10279 | + | UACAAAGAUGGCGCAGGGAAG | 21 | 12238 |
| BCL11A-10280 | + | AUACAAAGAUGGCGCAGGGAAG | 22 | 12239 |
| BCL11A-10281 | + | AAUACAAAGAUGGCGCAGGGAAG | 23 | 12240 |
| BCL11A-10282 | + | UAAUACAAAGAUGGCGCAGGGAAG | 24 | 12241 |
| BCL11A-10283 | + | CGGUUCACAUCGGGAGAG | 18 | 12242 |
| BCL11A-10284 | + | UCGGUUCACAUCGGGAGAG | 19 | 12243 |
| BCL11A-10285 | + | CUCGGUUCACAUCGGGAGAG | 20 | 12244 |
| BCL11A-10286 | + | GCUCGGUUCACAUCGGGAGAG | 21 | 12245 |
| BCL11A-10287 | + | GGCUCGGUUCACAUCGGGAGAG | 22 | 12246 |
| BCL11A-10288 | + | CGGCUCGGUUCACAUCGGGAGAG | 23 | 12247 |
| BCL11A-10289 | + | ACGGCUCGGUUCACAUCGGGAGAG | 24 | 12248 |
| BCL11A-10290 | + | AAUGGUUCCAGAUGGGAU | 18 | 12249 |
| BCL11A-10291 | + | CAAUGGUUCCAGAUGGGAU | 19 | 12250 |
| BCL11A-10292 | + | GCAAUGGUUCCAGAUGGGAU | 20 | 12251 |
| BCL11A-10293 | + | GGCAAUGGUUCCAGAUGGGAU | 21 | 12252 |
| BCL11A-10294 | + | CGGCAAUGGUUCCAGAUGGGAU | 22 | 12253 |
| BCL11A-10295 | + | ACGGCAAUGGUUCCAGAUGGGAU | 23 | 12254 |
| BCL11A-10296 | + | CACGGCAAUGGUUCCAGAUGGGAU | 24 | 12255 |
| BCL11A-10297 | + | AACUUGAACGUCAGGAGU | 18 | 12256 |
| BCL11A-10298 | + | GAACUUGAACGUCAGGAGU | 19 | 12257 |
| BCL11A-10299 | + | CGAACUUGAACGUCAGGAGU | 20 | 12258 |
| BCL11A-10300 | + | GCGAACUUGAACGUCAGGAGU | 21 | 12259 |
| BCL11A-10301 | + | UGCGAACUUGAACGUCAGGAGU | 22 | 12260 |
| BCL11A-10302 | + | CUGCGAACUUGAACGUCAGGAGU | 23 | 12261 |
| BCL11A-10303 | + | CCUGCGAACUUGAACGUCAGGAGU | 24 | 12262 |
| BCL11A-6304 | − | AACCCCAGCACUUAAGCAAAC | 21 | 12263 |
| BCL11A-6305 | − | AAACCCCAGCACUUAAGCAAAC | 22 | 12264 |
| BCL11A-6306 | − | CAAACCCCAGCACUUAAGCAAAC | 23 | 12265 |
| BCL11A-6307 | − | GCAAACCCCAGCACUUAAGCAAAC | 24 | 12266 |
| BCL11A-10304 | − | AAGCAAAAGCGAGGGGGAGAG | 21 | 12267 |
| BCL11A-10305 | − | GAAGCAAAAGCGAGGGGGAGAG | 22 | 12268 |
| BCL11A-10306 | − | AGAAGCAAAAGCGAGGGGGAGAG | 23 | 12269 |
| BCL11A-10307 | − | UAGAAGCAAAAGCGAGGGGGAGAG | 24 | 12270 |

Table 19B provides exemplary targeting domains for knocking down the BCL11A gene selected according to the second tier parameters. The targeting domains bind within 500 bp (e.g., upstream or downstream) of a transcription start site (TSS), and PAM is NNGRRT. It is contemplated herein that in an embodiment the targeting domain hybridizes to the target domain through complementary base pairing. Any of the targeting domains in the table can be used with a *S. aureus* eiCas9 molecule or eiCas9 fusion protein (e.g., an eiCas9 fused to a transcription repressor domain) to alter the BCL11A gene (e.g., reduce or eliminate BCL11A gene expression, BCL11A protein function, or the level of BCL11A protein). One or more gRNA may be used to target an eiCas9 to the promoter region of the BCL11A gene.

TABLE 19B

2nd Tier

| gRNA Name | DNA Strand | Targeting Domain | Target Site Length | SEQ ID NO: |
|---|---|---|---|---|
| BCL11A-10308 | + | GUGGCCGGGAGAGAAGAA | 18 | 12271 |
| BCL11A-10309 | + | CGUGGCCGGGAGAGAAGAA | 19 | 12272 |
| BCL11A-9697 | + | GCGUGGCCGGGAGAGAAGAA | 20 | 12273 |
| BCL11A-10310 | + | GUGGCAGGGGUGGGAGGA | 18 | 12274 |
| BCL11A-10311 | + | GGUGGCAGGGGUGGGAGGA | 19 | 12275 |
| BCL11A-10312 | + | GGGUGGCAGGGGUGGGAGGA | 20 | 12276 |
| BCL11A-10313 | + | GGGGUGGCAGGGGUGGGAGGA | 21 | 12277 |
| BCL11A-10314 | + | AGGGGUGGCAGGGGUGGGAGGA | 22 | 12278 |
| BCL11A-10315 | + | AAGGGGUGGCAGGGGUGGGAGGA | 23 | 12279 |
| BCL11A-10316 | + | AAAGGGGUGGCAGGGGUGGGAGGA | 24 | 12280 |
| BCL11A-10317 | + | UAAUUAUUAUUACUAUUA | 18 | 12281 |
| BCL11A-10318 | + | AUAAUUAUUAUUACUAUUA | 19 | 12282 |
| BCL11A-10319 | + | AAUAAUUAUUAUUACUAUUA | 20 | 12283 |
| BCL11A-10320 | + | UAAUAAUUAUUAUUACUAUUA | 21 | 12284 |
| BCL11A-10321 | + | UUAAUAAUUAUUAUUACUAUUA | 22 | 12285 |
| BCL11A-10322 | + | AUUAAUAAUUAUUAUUACUAUUA | 23 | 12286 |
| BCL11A-10323 | + | UAUUAAUAAUUAUUAUUACUAUUA | 24 | 12287 |
| BCL11A-10324 | + | AGAGAAGAAAGGGGUGGC | 18 | 12288 |
| BCL11A-10325 | + | GAGAGAAGAAAGGGGUGGC | 19 | 12289 |
| BCL11A-9726 | + | GGAGAGAAGAAAGGGGUGGC | 20 | 12290 |
| BCL11A-10326 | + | AAAGAUGGCGCAGGGAAG | 18 | 12291 |
| BCL11A-10327 | + | CAAAGAUGGCGCAGGGAAG | 19 | 12292 |
| BCL11A-10328 | + | ACAAAGAUGGCGCAGGGAAG | 20 | 12293 |
| BCL11A-6350 | − | CCCAGCACUUAAGCAAAC | 18 | 12294 |
| BCL11A-6351 | − | CCCCAGCACUUAAGCAAAC | 19 | 12295 |
| BCL11A-5458 | − | ACCCCAGCACUUAAGCAAAC | 20 | 12296 |
| BCL11A-10329 | − | UUCACGAGAAAACCUCC | 18 | 12297 |
| BCL11A-10330 | − | UUUCACGAGAAAACCUCC | 19 | 12298 |
| BCL11A-10331 | − | UUUUCACGAGAAAACCUCC | 20 | 12299 |
| BCL11A-10332 | − | UUUUUCACGAGAAAACCUCC | 21 | 12300 |
| BCL11A-10333 | − | AUUUUUCACGAGAAAACCUCC | 22 | 12301 |
| BCL11A-10334 | − | AAUUUUUCACGAGAAAACCUCC | 23 | 12302 |

TABLE 19B-continued

2nd Tier

| gRNA Name | DNA Strand | Targeting Domain | Target Site Length | SEQ ID NO: |
|---|---|---|---|---|
| BCL11A-10335 | − | AAAUUUUCACGAGAAAACCUCC | 24 | 12303 |
| BCL11A-10336 | − | UGAUGAAGAUAUUUUCUC | 18 | 12304 |
| BCL11A-10337 | − | CUGAUGAAGAUAUUUUCUC | 19 | 12305 |
| BCL11A-9731 | − | ACUGAUGAAGAUAUUUUCUC | 20 | 12306 |
| BCL11A-10338 | − | CACUGAUGAAGAUAUUUUCUC | 21 | 12307 |
| BCL11A-10339 | − | GCACUGAUGAAGAUAUUUUCUC | 22 | 12308 |
| BCL11A-10340 | − | GGCACUGAUGAAGAUAUUUUCUC | 23 | 12309 |
| BCL11A-10341 | − | AGGCACUGAUGAAGAUAUUUUCUC | 24 | 12310 |
| BCL11A-10342 | − | CAAAAGCGAGGGGGAGAG | 18 | 12311 |
| BCL11A-10343 | − | GCAAAAGCGAGGGGGAGAG | 19 | 12312 |
| BCL11A-4583 | − | AGCAAAAGCGAGGGGGAGAG | 20 | 12313 |
| BCL11A-10344 | − | UAUUAUUUCUAAUUUAUU | 18 | 12314 |
| BCL11A-10345 | − | GUAUUAUUUCUAAUUUAUU | 19 | 12315 |
| BCL11A-10346 | − | UGUAUUAUUUCUAAUUUAUU | 20 | 12316 |
| BCL11A-10347 | − | UUGUAUUAUUUCUAAUUUAUU | 21 | 12317 |
| BCL11A-10348 | − | UUUGUAUUAUUUCUAAUUUAUU | 22 | 12318 |
| BCL11A-10349 | − | CUUUGUAUUAUUUCUAAUUUAUU | 23 | 12319 |
| BCL11A-10350 | − | UCUUUGUAUUAUUUCUAAUUUAUU | 24 | 12320 |
| BCL11A-10351 | − | UUGAAUAAUCUUUCAUUU | 18 | 12321 |
| BCL11A-10352 | − | UUUGAAUAAUCUUUCAUUU | 19 | 12322 |
| BCL11A-10353 | − | UUUUGAAUAAUCUUUCAUUU | 20 | 12323 |
| BCL11A-10354 | − | UUUUUGAAUAAUCUUUCAUUU | 21 | 12324 |
| BCL11A-10355 | − | UUUUUUGAAUAAUCUUUCAUUU | 22 | 12325 |
| BCL11A-10356 | − | CUUUUUUGAAUAAUCUUUCAUUU | 23 | 12326 |
| BCL11A-10357 | − | UCUUUUUUGAAUAAUCUUUCAUUU | 24 | 12327 |

Table 19C provides exemplary targeting domains for knocking down the BCL11A gene selected according to the third tier parameters. The targeting domains bind within 500 bp (e.g., upstream or downstream) of a transcription start site (TSS), and the PAM is NNGRRV. It is contemplated herein that in an embodiment the targeting domain hybridizes to the target domain through complementary base pairing. Any of the targeting domains in the table can be used with a S. aureus eiCas9 molecule or eiCas9 fusion protein (e.g., an eiCas9 fused to a transcription repressor domain) to alter the BCL11A gene (e.g., reduce or eliminate BCL11A gene expression, BCL11A protein function, or the level of BCL11A protein). One or more gRNA may be used

TABLE 19C

3rd Tier

| gRNA Name | DNA Strand | Targeting Domain | Target Site Length | SEQ ID NO: |
|---|---|---|---|---|
| BCL11A-10358 | + | AAAAAAAAAAAAAAAAAA | 18 | 12328 |
| BCL11A-10359 | + | AAAAAAAAAAAAAAAAAAA | 19 | 12329 |
| BCL11A-4899 | + | AAAAAAAAAAAAAAAAAAAA | 20 | 12330 |

TABLE 19C-continued

| | | 3rd Tier | | |
|---|---|---|---|---|
| gRNA Name | DNA Strand | Targeting Domain | Target Site Length | SEQ ID NO: |
| BCL11A-10360 | + | AAAAAAAAAAAAAAAAAAAAA | 21 | 12331 |
| BCL11A-10361 | + | AAAAAAAAAAAAAAAAAAAAAA | 22 | 12332 |
| BCL11A-10362 | + | AAAAAAAAAAAAAAAAAAAAAAA | 23 | 12333 |
| BCL11A-10363 | + | AAAAAAAAAAAAAAAAAAAAAAAA | 24 | 12334 |
| BCL11A-10364 | + | CAGGGGCUGGACAUGAAA | 18 | 12335 |
| BCL11A-10365 | + | UCAGGGGCUGGACAUGAAA | 19 | 12336 |
| BCL11A-10366 | + | AUCAGGGGCUGGACAUGAAA | 20 | 12337 |
| BCL11A-10367 | + | CAUCAGGGGCUGGACAUGAAA | 21 | 12338 |
| BCL11A-10368 | + | ACAUCAGGGGCUGGACAUGAAA | 22 | 12339 |
| BCL11A-10369 | + | CACAUCAGGGGCUGGACAUGAAA | 23 | 12340 |
| BCL11A-10370 | + | ACACAUCAGGGGCUGGACAUGAAA | 24 | 12341 |
| BCL11A-10371 | + | ACACACGCGGACUCUAAA | 18 | 12342 |
| BCL11A-10372 | + | CACACACGCGGACUCUAAA | 19 | 12343 |
| BCL11A-10373 | + | CCACACACGCGGACUCUAAA | 20 | 12344 |
| BCL11A-10374 | + | CCCACACACGCGGACUCUAAA | 21 | 12345 |
| BCL11A-10375 | + | CCCCACACACGCGGACUCUAAA | 22 | 12346 |
| BCL11A-10376 | + | CCCCCACACACGCGGACUCUAAA | 23 | 12347 |
| BCL11A-10377 | + | CCCCCCACACACGCGGACUCUAAA | 24 | 12348 |
| BCL11A-10378 | + | AGAGGGAGAGAGAGAA | 18 | 12349 |
| BCL11A-10379 | + | AAGAGGGAGAGAGAGAA | 19 | 12350 |
| BCL11A-4921 | + | AAAGAGGGAGAGAGAGAA | 20 | 12351 |
| BCL11A-10380 | + | AAAAGAGGGAGAGAGAGAA | 21 | 12352 |
| BCL11A-10381 | + | AAAAAGAGGGAGAGAGAGAA | 22 | 12353 |
| BCL11A-10382 | + | AAAAAAGAGGGAGAGAGAGAA | 23 | 12354 |
| BCL11A-10383 | + | AAAAAAAGAGGGAGAGAGAGAA | 24 | 12355 |
| BCL11A-10384 | + | AGGGCGAGCAGGAGAGAA | 18 | 12356 |
| BCL11A-10385 | + | CAGGGCGAGCAGGAGAGAA | 19 | 12357 |
| BCL11A-4422 | + | GCAGGGCGAGCAGGAGAGAA | 20 | 12358 |
| BCL11A-10386 | + | GGCAGGGCGAGCAGGAGAGAA | 21 | 12359 |
| BCL11A-10387 | + | GGGCAGGGCGAGCAGGAGAGAA | 22 | 12360 |
| BCL11A-10388 | + | UGGGCAGGGCGAGCAGGAGAGAA | 23 | 12361 |
| BCL11A-10389 | + | AUGGGCAGGGCGAGCAGGAGAGAA | 24 | 12362 |
| BCL11A-10390 | + | GAGAAGGGGAGGAGGGAA | 18 | 12363 |
| BCL11A-10391 | + | AGAGAAGGGGAGGAGGGAA | 19 | 12364 |
| BCL11A-4404 | + | GAGAGAAGGGGAGGAGGGAA | 20 | 12365 |
| BCL11A-10392 | + | GGAGAGAAGGGGAGGAGGGAA | 21 | 12366 |
| BCL11A-10393 | + | AGGAGAGAAGGGGAGGAGGGAA | 22 | 12367 |
| BCL11A-10394 | + | CAGGAGAGAAGGGGAGGAGGGAA | 23 | 12368 |

TABLE 19C-continued

3rd Tier

| gRNA Name | DNA Strand | Targeting Domain | Target Site Length | SEQ ID NO: |
|---|---|---|---|---|
| BCL11A-10395 | + | GCAGGAGAGAAGGGGAGGAGGGAA | 24 | 12369 |
| BCL11A-10396 | + | ACGACGGCUCGGUUCACA | 18 | 12370 |
| BCL11A-10397 | + | GACGACGGCUCGGUUCACA | 19 | 12371 |
| BCL11A-10398 | + | GGACGACGGCUCGGUUCACA | 20 | 12372 |
| BCL11A-10399 | + | CGGACGACGGCUCGGUUCACA | 21 | 12373 |
| BCL11A-10400 | + | GCGGACGACGGCUCGGUUCACA | 22 | 12374 |
| BCL11A-10401 | + | GGCGGACGACGGCUCGGUUCACA | 23 | 12375 |
| BCL11A-10402 | + | GGGCGGACGACGGCUCGGUUCACA | 24 | 12376 |
| BCL11A-10403 | + | AAGGGGAAGCUCACACCA | 18 | 12377 |
| BCL11A-10404 | + | GAAGGGGAAGCUCACACCA | 19 | 12378 |
| BCL11A-10405 | + | GGAAGGGGAAGCUCACACCA | 20 | 12379 |
| BCL11A-10406 | + | GGGAAGGGGAAGCUCACACCA | 21 | 12380 |
| BCL11A-10407 | + | AGGGAAGGGGAAGCUCACACCA | 22 | 12381 |
| BCL11A-10408 | + | GAGGGAAGGGGAAGCUCACACCA | 23 | 12382 |
| BCL11A-10409 | + | GGAGGGAAGGGGAAGCUCACACCA | 24 | 12383 |
| BCL11A-10410 | + | AGAAAGAAGGAGACUCCA | 18 | 12384 |
| BCL11A-10411 | + | UAGAAAGAAGGAGACUCCA | 19 | 12385 |
| BCL11A-10412 | + | UUAGAAAGAAGGAGACUCCA | 20 | 12386 |
| BCL11A-10413 | + | GUUAGAAAGAAGGAGACUCCA | 21 | 12387 |
| BCL11A-10414 | + | GGUUAGAAAGAAGGAGACUCCA | 22 | 12388 |
| BCL11A-10415 | + | GGGUUAGAAAGAAGGAGACUCCA | 23 | 12389 |
| BCL11A-10416 | + | CGGGUUAGAAAGAAGGAGACUCCA | 24 | 12390 |
| BCL11A-10417 | + | GGCUCACCAGUGGCCGCA | 18 | 12391 |
| BCL11A-10418 | + | GGGCUCACCAGUGGCCGCA | 19 | 12392 |
| BCL11A-10419 | + | CGGGCUCACCAGUGGCCGCA | 20 | 12393 |
| BCL11A-10420 | + | GCGGGCUCACCAGUGGCCGCA | 21 | 12394 |
| BCL11A-10421 | + | CGCGGGCUCACCAGUGGCCGCA | 22 | 12395 |
| BCL11A-10422 | + | CCGCGGGCUCACCAGUGGCCGCA | 23 | 12396 |
| BCL11A-10423 | + | GCCGCGGGCUCACCAGUGGCCGCA | 24 | 12397 |
| BCL11A-10424 | + | UAAUACAAAGAUGGCGCA | 18 | 12398 |
| BCL11A-10425 | + | AUAAUACAAAGAUGGCGCA | 19 | 12399 |
| BCL11A-9702 | + | AAUAAUACAAAGAUGGCGCA | 20 | 12400 |
| BCL11A-10426 | + | AAAUAAUACAAAGAUGGCGCA | 21 | 12401 |
| BCL11A-10427 | + | GAAAUAAUACAAAGAUGGCGCA | 22 | 12402 |
| BCL11A-10428 | + | AGAAAUAAUACAAAGAUGGCGCA | 23 | 12403 |
| BCL11A-10429 | + | UAGAAAUAAUACAAAGAUGGCGCA | 24 | 12404 |
| BCL11A-10430 | + | AAAAAAAAAAAAAAGA | 18 | 12405 |

TABLE 19C-continued

3rd Tier

| gRNA Name | DNA Strand | Targeting Domain | Target Site Length | SEQ ID NO: |
|---|---|---|---|---|
| BCL11A-10431 | + | AAAAAAAAAAAAAAAAAGA | 19 | 12406 |
| BCL11A-4527 | + | AAAAAAAAAAAAAAAAAAGA | 20 | 12407 |
| BCL11A-10432 | + | AAAAAAAAAAAAAAAAAAAGA | 21 | 12408 |
| BCL11A-10433 | + | AAAAAAAAAAAAAAAAAAAAGA | 22 | 12409 |
| BCL11A-10434 | + | AAAAAAAAAAAAAAAAAAAAAGA | 23 | 12410 |
| BCL11A-10435 | + | AAAAAAAAAAAAAAAAAAAAAAGA | 24 | 12411 |
| BCL11A-10436 | + | AGAGCCGGGUUAGAAAGA | 18 | 12412 |
| BCL11A-10437 | + | GAGAGCCGGGUUAGAAAGA | 19 | 12413 |
| BCL11A-9708 | + | GGAGAGCCGGGUUAGAAAGA | 20 | 12414 |
| BCL11A-10438 | + | GGGAGAGCCGGGUUAGAAAGA | 21 | 12415 |
| BCL11A-10439 | + | CGGGAGAGCCGGGUUAGAAAGA | 22 | 12416 |
| BCL11A-10440 | + | UCGGGAGAGCCGGGUUAGAAAGA | 23 | 12417 |
| BCL11A-10441 | + | AUCGGGAGAGCCGGGUUAGAAAGA | 24 | 12418 |
| BCL11A-10442 | + | CGUGGCCGGGAGAGAAGA | 18 | 12419 |
| BCL11A-10443 | + | GCGUGGCCGGGAGAGAAGA | 19 | 12420 |
| BCL11A-10444 | + | GGCGUGGCCGGGAGAGAAGA | 20 | 12421 |
| BCL11A-10445 | + | UGGCGUGGCCGGGAGAGAAGA | 21 | 12422 |
| BCL11A-10446 | + | GUGGCGUGGCCGGGAGAGAAGA | 22 | 12423 |
| BCL11A-10447 | + | GGUGGCGUGGCCGGGAGAGAAGA | 23 | 12424 |
| BCL11A-10448 | + | CGGUGGCGUGGCCGGGAGAGAAGA | 24 | 12425 |
| BCL11A-10449 | + | AGAGAGAGAAGAGAGA | 18 | 12426 |
| BCL11A-10450 | + | GAGAGAGAGAAGAGAGA | 19 | 12427 |
| BCL11A-4845 | + | GGAGAGAGAGAAGAGAGA | 20 | 12428 |
| BCL11A-10451 | + | GGGAGAGAGAGAAGAGAGA | 21 | 12429 |
| BCL11A-10452 | + | AGGGAGAGAGAGAAGAGAGA | 22 | 12430 |
| BCL11A-10453 | + | GAGGGAGAGAGAGAAGAGAGA | 23 | 12431 |
| BCL11A-10454 | + | AGAGGGAGAGAGAGAAGAGAGA | 24 | 12432 |
| BCL11A-10455 | + | UAGAGGGAGAGAGAGAGA | 18 | 12433 |
| BCL11A-10456 | + | AUAGAGGGAGAGAGAGAGA | 19 | 12434 |
| BCL11A-10457 | + | GAUAGAGGGAGAGAGAGAGA | 20 | 12435 |
| BCL11A-10458 | + | AGAUAGAGGGAGAGAGAGAGA | 21 | 12436 |
| BCL11A-10459 | + | GAGAUAGAGGGAGAGAGAGAGA | 22 | 12437 |
| BCL11A-10460 | + | AGAGAUAGAGGGAGAGAGAGAGA | 23 | 12438 |
| BCL11A-10461 | + | GAGAGAUAGAGGGAGAGAGAGAGA | 24 | 12439 |
| BCL11A-10462 | + | GAUAGAGGGAGAGAGAGA | 18 | 12440 |
| BCL11A-10463 | + | AGAUAGAGGGAGAGAGAGA | 19 | 12441 |
| BCL11A-10464 | + | GAGAUAGAGGGAGAGAGAGA | 20 | 12442 |
| BCL11A-10465 | + | AGAGAUAGAGGGAGAGAGAGA | 21 | 12443 |

TABLE 19C-continued

3rd Tier

| gRNA Name | DNA Strand | Targeting Domain | Target Site Length | SEQ ID NO: |
|---|---|---|---|---|
| BCL11A-10466 | + | GAGAGAUAGAGGGAGAGAGAGA | 22 | 12444 |
| BCL11A-10467 | + | AGAGAGAUAGAGGGAGAGAGAGA | 23 | 12445 |
| BCL11A-10468 | + | AAGAGAGAUAGAGGGAGAGAGAGA | 24 | 12446 |
| BCL11A-10469 | + | AAAAAAGAGGGAGAGAGA | 18 | 12447 |
| BCL11A-10470 | + | AAAAAAAGAGGGAGAGAGA | 19 | 12448 |
| BCL11A-4911 | + | AAAAAAAAGAGGGAGAGAGA | 20 | 12449 |
| BCL11A-10471 | + | AAAAAAAAAGAGGGAGAGAGA | 21 | 12450 |
| BCL11A-10472 | + | AAAAAAAAAAGAGGGAGAGAGA | 22 | 12451 |
| BCL11A-10473 | + | AAAAAAAAAAAGAGGGAGAGAGA | 23 | 12452 |
| BCL11A-10474 | + | AAAAAAAAAAAAGAGGGAGAGAGA | 24 | 12453 |
| BCL11A-10475 | + | GAGAUAGAGGGAGAGAGA | 18 | 12454 |
| BCL11A-10476 | + | AGAGAUAGAGGGAGAGAGA | 19 | 12455 |
| BCL11A-10477 | + | GAGAGAUAGAGGGAGAGAGA | 20 | 12456 |
| BCL11A-10478 | + | AGAGAGAUAGAGGGAGAGAGA | 21 | 12457 |
| BCL11A-10479 | + | AAGAGAGAUAGAGGGAGAGAGA | 22 | 12458 |
| BCL11A-10480 | + | GAAGAGAGAUAGAGGGAGAGAGA | 23 | 12459 |
| BCL11A-10481 | + | AGAAGAGAGAUAGAGGGAGAGAGA | 24 | 12460 |
| BCL11A-10482 | + | CAGGGCGAGCAGGAGAGA | 18 | 12461 |
| BCL11A-10483 | + | GCAGGGCGAGCAGGAGAGA | 19 | 12462 |
| BCL11A-4464 | + | GGCAGGGCGAGCAGGAGAGA | 20 | 12463 |
| BCL11A-10484 | + | GGGCAGGGCGAGCAGGAGAGA | 21 | 12464 |
| BCL11A-10485 | + | UGGGCAGGGCGAGCAGGAGAGA | 22 | 12465 |
| BCL11A-10486 | + | AUGGGCAGGGCGAGCAGGAGAGA | 23 | 12466 |
| BCL11A-10487 | + | CAUGGGCAGGGCGAGCAGGAGAGA | 24 | 12467 |
| BCL11A-10488 | + | AAAAAAAGAGGGAGAGA | 18 | 12468 |
| BCL11A-10489 | + | AAAAAAAAGAGGGAGAGA | 19 | 12469 |
| BCL11A-4909 | + | AAAAAAAAAGAGGGAGAGA | 20 | 12470 |
| BCL11A-10490 | + | AAAAAAAAAAGAGGGAGAGA | 21 | 12471 |
| BCL11A-10491 | + | AAAAAAAAAAAGAGGGAGAGA | 22 | 12472 |
| BCL11A-10492 | + | AAAAAAAAAAAAGAGGGAGAGA | 23 | 12473 |
| BCL11A-10493 | + | AAAAAAAAAAAAAGAGGGAGAGA | 24 | 12474 |
| BCL11A-10494 | + | GAGAGAUAGAGGGAGAGA | 18 | 12475 |
| BCL11A-10495 | + | AGAGAGAUAGAGGGAGAGA | 19 | 12476 |
| BCL11A-10496 | + | AAGAGAGAUAGAGGGAGAGA | 20 | 12477 |
| BCL11A-10497 | + | GAAGAGAGAUAGAGGGAGAGA | 21 | 12478 |
| BCL11A-10498 | + | AGAAGAGAGAUAGAGGGAGAGA | 22 | 12479 |
| BCL11A-10499 | + | GAGAAGAGAGAUAGAGGGAGAGA | 23 | 12480 |

TABLE 19C-continued

3rd Tier

| gRNA Name | DNA Strand | Targeting Domain | Target Site Length | SEQ ID NO: |
|---|---|---|---|---|
| BCL11A-10500 | + | AGAGAAGAGAGAUAGAGGGAGAGA | 24 | 12481 |
| BCL11A-10501 | + | AAAAAAAAAAGAGGGAGA | 18 | 12482 |
| BCL11A-10502 | + | AAAAAAAAAAAGAGGGAGA | 19 | 12483 |
| BCL11A-4907 | + | AAAAAAAAAAAAGAGGGAGA | 20 | 12484 |
| BCL11A-10503 | + | AAAAAAAAAAAAAGAGGGAGA | 21 | 12485 |
| BCL11A-10504 | + | AAAAAAAAAAAAAAGAGGGAGA | 22 | 12486 |
| BCL11A-10505 | + | AAAAAAAAAAAAAAAGAGGGAGA | 23 | 12487 |
| BCL11A-10506 | + | AAAAAAAAAAAAAAAAGAGGGAGA | 24 | 12488 |
| BCL11A-10507 | + | AAGAGAGAUAGAGGGAGA | 18 | 12489 |
| BCL11A-10508 | + | GAAGAGAGAUAGAGGGAGA | 19 | 12490 |
| BCL11A-10509 | + | AGAAGAGAGAUAGAGGGAGA | 20 | 12491 |
| BCL11A-10510 | + | GAGAAGAGAGAUAGAGGGAGA | 21 | 12492 |
| BCL11A-10511 | + | AGAGAAGAGAGAUAGAGGGAGA | 22 | 12493 |
| BCL11A-10512 | + | GAGAGAAGAGAGAUAGAGGGAGA | 23 | 12494 |
| BCL11A-10513 | + | AGAGAGAAGAGAGAUAGAGGGAGA | 24 | 12495 |
| BCL11A-10514 | + | AGAGAGAAGAGAGAUAGA | 18 | 12496 |
| BCL11A-10515 | + | GAGAGAGAAGAGAGAUAGA | 19 | 12497 |
| BCL11A-9709 | + | AGAGAGAGAAGAGAGAUAGA | 20 | 12498 |
| BCL11A-10516 | + | GAGAGAGAGAAGAGAGAUAGA | 21 | 12499 |
| BCL11A-10517 | + | AGAGAGAGAGAAGAGAGAUAGA | 22 | 12500 |
| BCL11A-10518 | + | GAGAGAGAGAGAAGAGAGAUAGA | 23 | 12501 |
| BCL11A-10519 | + | GGAGAGAGAGAGAAGAGAGAUAGA | 24 | 12502 |
| BCL11A-10520 | + | CGGGAGAGCCGGGUUAGA | 18 | 12503 |
| BCL11A-10521 | + | UCGGGAGAGCCGGGUUAGA | 19 | 12504 |
| BCL11A-10522 | + | AUCGGGAGAGCCGGGUUAGA | 20 | 12505 |
| BCL11A-10523 | + | CAUCGGGAGAGCCGGGUUAGA | 21 | 12506 |
| BCL11A-10524 | + | ACAUCGGGAGAGCCGGGUUAGA | 22 | 12507 |
| BCL11A-10525 | + | CACAUCGGGAGAGCCGGGUUAGA | 23 | 12508 |
| BCL11A-10526 | + | UCACAUCGGGAGAGCCGGGUUAGA | 24 | 12509 |
| BCL11A-10527 | + | GGGGGAGGGGCGGGCCGA | 18 | 12510 |
| BCL11A-10528 | + | CGGGGGAGGGGCGGGCCGA | 19 | 12511 |
| BCL11A-4648 | + | CCGGGGGAGGGGCGGGCCGA | 20 | 12512 |
| BCL11A-10529 | + | CCCGGGGGAGGGGCGGGCCGA | 21 | 12513 |
| BCL11A-10530 | + | CCCCGGGGGAGGGGCGGGCCGA | 22 | 12514 |
| BCL11A-10531 | + | CCCCCGGGGGAGGGGCGGGCCGA | 23 | 12515 |
| BCL11A-10532 | + | GCCCCCGGGGGAGGGGCGGGCCGA | 24 | 12516 |
| BCL11A-10533 | + | UGGGCAGGGCGAGCAGGA | 18 | 12517 |
| BCL11A-10534 | + | AUGGGCAGGGCGAGCAGGA | 19 | 12518 |

TABLE 19C-continued

3rd Tier

| gRNA Name | DNA Strand | Targeting Domain | Target Site Length | SEQ ID NO: |
|---|---|---|---|---|
| BCL11A-10535 | + | CAUGGGCAGGGCGAGCAGGA | 20 | 12519 |
| BCL11A-10536 | + | ACAUGGGCAGGGCGAGCAGGA | 21 | 12520 |
| BCL11A-10537 | + | AACAUGGGCAGGGCGAGCAGGA | 22 | 12521 |
| BCL11A-10538 | + | AAACAUGGGCAGGGCGAGCAGGA | 23 | 12522 |
| BCL11A-10539 | + | AAAACAUGGGCAGGGCGAGCAGGA | 24 | 12523 |
| BCL11A-10540 | + | CAGGAGAGAAGGGGAGGA | 18 | 12524 |
| BCL11A-10541 | + | GCAGGAGAGAAGGGGAGGA | 19 | 12525 |
| BCL11A-4584 | + | AGCAGGAGAGAAGGGGAGGA | 20 | 12526 |
| BCL11A-10542 | + | GAGCAGGAGAGAAGGGGAGGA | 21 | 12527 |
| BCL11A-10543 | + | CGAGCAGGAGAGAAGGGGAGGA | 22 | 12528 |
| BCL11A-10544 | + | GCGAGCAGGAGAGAAGGGGAGGA | 23 | 12529 |
| BCL11A-10545 | + | GGCGAGCAGGAGAGAAGGGGAGGA | 24 | 12530 |
| BCL11A-10546 | + | AAAAAAAAAAAAGAGGGA | 18 | 12531 |
| BCL11A-10547 | + | AAAAAAAAAAAAAGAGGGA | 19 | 12532 |
| BCL11A-4905 | + | AAAAAAAAAAAAAAGAGGGA | 20 | 12533 |
| BCL11A-10548 | + | AAAAAAAAAAAAAAAGAGGGA | 21 | 12534 |
| BCL11A-10549 | + | AAAAAAAAAAAAAAAAGAGGGA | 22 | 12535 |
| BCL11A-10550 | + | AAAAAAAAAAAAAAAAAGAGGGA | 23 | 12536 |
| BCL11A-10551 | + | AAAAAAAAAAAAAAAAAAGAGGGA | 24 | 12537 |
| BCL11A-10552 | + | AGAAGAGAGAUAGAGGGA | 18 | 12538 |
| BCL11A-10553 | + | GAGAAGAGAGAUAGAGGGA | 19 | 12539 |
| BCL11A-10554 | + | AGAGAAGAGAGAUAGAGGGA | 20 | 12540 |
| BCL11A-10555 | + | GAGAGAAGAGAGAUAGAGGGA | 21 | 12541 |
| BCL11A-10556 | + | AGAGAGAAGAGAGAUAGAGGGA | 22 | 12542 |
| BCL11A-10557 | + | GAGAGAGAAGAGAGAUAGAGGGA | 23 | 12543 |
| BCL11A-10558 | + | AGAGAGAGAAGAGAGAUAGAGGGA | 24 | 12544 |
| BCL11A-10559 | + | AGAGAAGGGGAGGAGGGA | 18 | 12545 |
| BCL11A-10560 | + | GAGAGAAGGGGAGGAGGGA | 19 | 12546 |
| BCL11A-4459 | + | GGAGAGAAGGGGAGGAGGGA | 20 | 12547 |
| BCL11A-10561 | + | AGGAGAGAAGGGGAGGAGGGA | 21 | 12548 |
| BCL11A-10562 | + | CAGGAGAGAAGGGGAGGAGGGA | 22 | 12549 |
| BCL11A-10563 | + | GCAGGAGAGAAGGGGAGGAGGGA | 23 | 12550 |
| BCL11A-10564 | + | AGCAGGAGAGAAGGGGAGGAGGGA | 24 | 12551 |
| BCL11A-10565 | + | GCGGUGGCGUGGCCGGGA | 18 | 12552 |
| BCL11A-10566 | + | GGCGGUGGCGUGGCCGGGA | 19 | 12553 |
| BCL11A-10567 | + | CGGCGGUGGCGUGGCCGGGA | 20 | 12554 |
| BCL11A-10568 | + | GCGGCGGUGGCGUGGCCGGGA | 21 | 12555 |

TABLE 19C-continued

3rd Tier

| gRNA Name | DNA Strand | Targeting Domain | Target Site Length | SEQ ID NO: |
|---|---|---|---|---|
| BCL11A-10569 | + | CGCGGCGGUGGCGUGGCCGGGA | 22 | 12556 |
| BCL11A-10570 | + | CCGCGGCGGUGGCGUGGCCGGGA | 23 | 12557 |
| BCL11A-10571 | + | GCCGCGGCGGUGGCGUGGCCGGGA | 24 | 12558 |
| BCL11A-10572 | + | AGGGGCGGGCCGAGGGGA | 18 | 12559 |
| BCL11A-10573 | + | GAGGGGCGGGCCGAGGGGA | 19 | 12560 |
| BCL11A-4461 | + | GGAGGGGCGGGCCGAGGGGA | 20 | 12561 |
| BCL11A-10574 | + | GGGAGGGGCGGGCCGAGGGGA | 21 | 12562 |
| BCL11A-10575 | + | GGGGAGGGGCGGGCCGAGGGGA | 22 | 12563 |
| BCL11A-10576 | + | GGGGGAGGGGCGGGCCGAGGGGA | 23 | 12564 |
| BCL11A-10577 | + | CGGGGGAGGGGCGGGCCGAGGGGA | 24 | 12565 |
| BCL11A-10578 | + | CAAUGGCCAGUGCGGGA | 18 | 12566 |
| BCL11A-10579 | + | CCAAUGGCCAGUGCGGGA | 19 | 12567 |
| BCL11A-9558 | + | GCCAAUGGCCAGUGCGGGA | 20 | 12568 |
| BCL11A-10580 | + | AGCCAAUGGCCAGUGCGGGA | 21 | 12569 |
| BCL11A-10581 | + | AAGCCAAUGGCCAGUGCGGGA | 22 | 12570 |
| BCL11A-10582 | + | CAAGCCAAUGGCCAGUGCGGGA | 23 | 12571 |
| BCL11A-10583 | + | ACAAGCCAAUGGCCAGUGCGGGA | 24 | 12572 |
| BCL11A-10584 | + | GUCAGGAGUCUGGAUGGA | 18 | 12573 |
| BCL11A-10585 | + | CGUCAGGAGUCUGGAUGGA | 19 | 12574 |
| BCL11A-10586 | + | ACGUCAGGAGUCUGGAUGGA | 20 | 12575 |
| BCL11A-10587 | + | AACGUCAGGAGUCUGGAUGGA | 21 | 12576 |
| BCL11A-10588 | + | GAACGUCAGGAGUCUGGAUGGA | 22 | 12577 |
| BCL11A-10589 | + | UGAACGUCAGGAGUCUGGAUGGA | 23 | 12578 |
| BCL11A-10590 | + | UUGAACGUCAGGAGUCUGGAUGGA | 24 | 12579 |
| BCL11A-10591 | + | AGAGAGAGAAGAGAGAUA | 18 | 12580 |
| BCL11A-10592 | + | GAGAGAGAGAAGAGAGAUA | 19 | 12581 |
| BCL11A-10593 | + | AGAGAGAGAGAAGAGAGAUA | 20 | 12582 |
| BCL11A-10594 | + | GAGAGAGAGAGAAGAGAGAUA | 21 | 12583 |
| BCL11A-10595 | + | GGAGAGAGAGAGAAGAGAGAUA | 22 | 12584 |
| BCL11A-10596 | + | GGGAGAGAGAGAGAAGAGAGAUA | 23 | 12585 |
| BCL11A-10597 | + | AGGGAGAGAGAGAGAAGAGAGAUA | 24 | 12586 |
| BCL11A-10598 | + | GACAGAGACACACAAAAC | 18 | 12587 |
| BCL11A-10599 | + | GGACAGAGACACACAAAAC | 19 | 12588 |
| BCL11A-10600 | + | UGGACAGAGACACACAAAAC | 20 | 12589 |
| BCL11A-10601 | + | AUGGACAGAGACACACAAAAC | 21 | 12590 |
| BCL11A-10602 | + | GAUGGACAGAGACACACAAAAC | 22 | 12591 |
| BCL11A-10603 | + | GGAUGGACAGAGACACACAAAAC | 23 | 12592 |
| BCL11A-10604 | + | UGGAUGGACAGAGACACACAAAAC | 24 | 12593 |

TABLE 19C-continued

3rd Tier

| gRNA Name | DNA Strand | Targeting Domain | Target Site Length | SEQ ID NO: |
|---|---|---|---|---|
| BCL11A-10605 | + | CGUGACGUCCCUGCGAAC | 18 | 12594 |
| BCL11A-10606 | + | ACGUGACGUCCCUGCGAAC | 19 | 12595 |
| BCL11A-10607 | + | GACGUGACGUCCCUGCGAAC | 20 | 12596 |
| BCL11A-10608 | + | GGACGUGACGUCCCUGCGAAC | 21 | 12597 |
| BCL11A-10609 | + | CGGACGUGACGUCCCUGCGAAC | 22 | 12598 |
| BCL11A-10610 | + | GCGGACGUGACGUCCCUGCGAAC | 23 | 12599 |
| BCL11A-10611 | + | UGCGGACGUGACGUCCCUGCGAAC | 24 | 12600 |
| BCL11A-10612 | + | CUGCUCCCCCCCACACAC | 18 | 12601 |
| BCL11A-10613 | + | CCUGCUCCCCCCCACACAC | 19 | 12602 |
| BCL11A-10614 | + | CCCUGCUCCCCCCCACACAC | 20 | 12603 |
| BCL11A-10615 | + | GCCCUGCUCCCCCCCACACAC | 21 | 12604 |
| BCL11A-10616 | + | CGCCCUGCUCCCCCCCACACAC | 22 | 12605 |
| BCL11A-10617 | + | GCGCCCUGCUCCCCCCCACACAC | 23 | 12606 |
| BCL11A-10618 | + | UGCGCCCUGCUCCCCCCCACACAC | 24 | 12607 |
| BCL11A-10619 | + | UGGACAUGAAAAAGAGAC | 18 | 12608 |
| BCL11A-10620 | + | CUGGACAUGAAAAAGAGAC | 19 | 12609 |
| BCL11A-10621 | + | GCUGGACAUGAAAAAGAGAC | 20 | 12610 |
| BCL11A-10622 | + | GGCUGGACAUGAAAAAGAGAC | 21 | 12611 |
| BCL11A-10623 | + | GGGCUGGACAUGAAAAAGAGAC | 22 | 12612 |
| BCL11A-10624 | + | GGGGCUGGACAUGAAAAAGAGAC | 23 | 12613 |
| BCL11A-10625 | + | AGGGGCUGGACAUGAAAAAGAGAC | 24 | 12614 |
| BCL11A-10626 | + | ACACAUCAGGGGCUGGAC | 18 | 12615 |
| BCL11A-10627 | + | CACACAUCAGGGGCUGGAC | 19 | 12616 |
| BCL11A-10628 | + | ACACACAUCAGGGGCUGGAC | 20 | 12617 |
| BCL11A-10629 | + | GACACACAUCAGGGGCUGGAC | 21 | 12618 |
| BCL11A-10630 | + | GGACACACAUCAGGGGCUGGAC | 22 | 12619 |
| BCL11A-10631 | + | UGGACACACAUCAGGGGCUGGAC | 23 | 12620 |
| BCL11A-10632 | + | AUGGACACACAUCAGGGGCUGGAC | 24 | 12621 |
| BCL11A-6411 | + | UAUUAUGGGUUACUUAC | 18 | 12622 |
| BCL11A-6412 | + | CUAUUAUGGGUUACUUAC | 19 | 12623 |
| BCL11A-6413 | + | ACUAUUAUGGGUUACUUAC | 20 | 12624 |
| BCL11A-6414 | + | UACUAUUAUGGGUUACUUAC | 21 | 12625 |
| BCL11A-6415 | + | UUACUAUUAUGGGUUACUUAC | 22 | 12626 |
| BCL11A-6416 | + | AUUACUAUUAUGGGUUACUUAC | 23 | 12627 |
| BCL11A-6417 | + | UAUUACUAUUAUGGGUUACUUAC | 24 | 12628 |
| BCL11A-10633 | + | AAAAUGGCAAAAGCCCCC | 18 | 12629 |
| BCL11A-10634 | + | AAAAAUGGCAAAAGCCCCC | 19 | 12630 |

TABLE 19C-continued

3rd Tier

| gRNA Name | DNA Strand | Targeting Domain | Target Site Length | SEQ ID NO: |
|---|---|---|---|---|
| BCL11A-10635 | + | AAAAAAUGGCAAAAGCCCCC | 20 | 12631 |
| BCL11A-10636 | + | AAAAAAAUGGCAAAAGCCCCC | 21 | 12632 |
| BCL11A-10637 | + | GAAAAAAAUGGCAAAAGCCCCC | 22 | 12633 |
| BCL11A-10638 | + | UGAAAAAAAUGGCAAAAGCCCCC | 23 | 12634 |
| BCL11A-10639 | + | AUGAAAAAAAUGGCAAAAGCCCCC | 24 | 12635 |
| BCL11A-10640 | + | ACGCCAGACGCGGCCCCC | 18 | 12636 |
| BCL11A-10641 | + | GACGCCAGACGCGGCCCCC | 19 | 12637 |
| BCL11A-4456 | + | GGACGCCAGACGCGGCCCCC | 20 | 12638 |
| BCL11A-10642 | + | CGGACGCCAGACGCGGCCCCC | 21 | 12639 |
| BCL11A-10643 | + | GCGGACGCCAGACGCGGCCCCC | 22 | 12640 |
| BCL11A-10644 | + | CGCGGACGCCAGACGCGGCCCCC | 23 | 12641 |
| BCL11A-10645 | + | CCGCGGACGCCAGACGCGGCCCCC | 24 | 12642 |
| BCL11A-10646 | + | GACGCCAGACGCGGCCCC | 18 | 12643 |
| BCL11A-10647 | + | GGACGCCAGACGCGGCCCC | 19 | 12644 |
| BCL11A-4362 | + | CGGACGCCAGACGCGGCCCC | 20 | 12645 |
| BCL11A-10648 | + | GCGGACGCCAGACGCGGCCCC | 21 | 12646 |
| BCL11A-10649 | + | CGCGGACGCCAGACGCGGCCCC | 22 | 12647 |
| BCL11A-10650 | + | CCGCGGACGCCAGACGCGGCCCC | 23 | 12648 |
| BCL11A-10651 | + | UCCGCGGACGCCAGACGCGGCCCC | 24 | 12649 |
| BCL11A-10652 | + | GGACGCCAGACGCGGCCC | 18 | 12650 |
| BCL11A-10653 | + | CGGACGCCAGACGCGGCCC | 19 | 12651 |
| BCL11A-4825 | + | GCGGACGCCAGACGCGGCCC | 20 | 12652 |
| BCL11A-10654 | + | CGCGGACGCCAGACGCGGCCC | 21 | 12653 |
| BCL11A-10655 | + | CCGCGGACGCCAGACGCGGCCC | 22 | 12654 |
| BCL11A-10656 | + | UCCGCGGACGCCAGACGCGGCCC | 23 | 12655 |
| BCL11A-10657 | + | CUCCGCGGACGCCAGACGCGGCCC | 24 | 12656 |
| BCL11A-10658 | + | CCGGGGGAGGGGCGGGCC | 18 | 12657 |
| BCL11A-10659 | + | CCCGGGGGAGGGGCGGGCC | 19 | 12658 |
| BCL11A-5064 | + | CCCCGGGGGAGGGGCGGGCC | 20 | 12659 |
| BCL11A-10660 | + | CCCCCGGGGGAGGGGCGGGCC | 21 | 12660 |
| BCL11A-10661 | + | GCCCCCGGGGGAGGGGCGGGCC | 22 | 12661 |
| BCL11A-10662 | + | GGCCCCCGGGGGAGGGGCGGGCC | 23 | 12662 |
| BCL11A-10663 | + | CGGCCCCCGGGGGAGGGGCGGGCC | 24 | 12663 |
| BCL11A-10664 | + | GGAGGGGGCGCUGGGGCC | 18 | 12664 |
| BCL11A-10665 | + | GGGAGGGGGCGCUGGGGCC | 19 | 12665 |
| BCL11A-10666 | + | GGGGAGGGGGCGCUGGGGCC | 20 | 12666 |
| BCL11A-10667 | + | AGGGGAGGGGGCGCUGGGGCC | 21 | 12667 |
| BCL11A-10668 | + | GAGGGGAGGGGGCGCUGGGGCC | 22 | 12668 |

TABLE 19C-continued

3rd Tier

| gRNA Name | DNA Strand | Targeting Domain | Target Site Length | SEQ ID NO: |
|---|---|---|---|---|
| BCL11A-10669 | + | CGAGGGGAGGGGCGCUGGGGCC | 23 | 12669 |
| BCL11A-10670 | + | CCGAGGGGAGGGGCGCUGGGGCC | 24 | 12670 |
| BCL11A-10671 | + | CGCGGCGGUGGCGUGGCC | 18 | 12671 |
| BCL11A-10672 | + | CCGCGGCGGUGGCGUGGCC | 19 | 12672 |
| BCL11A-9718 | + | GCCGCGGCGGUGGCGUGGCC | 20 | 12673 |
| BCL11A-10673 | + | CGCCGCGGCGGUGGCGUGGCC | 21 | 12674 |
| BCL11A-10674 | + | GCGCCGCGGCGGUGGCGUGGCC | 22 | 12675 |
| BCL11A-10675 | + | AGCGCCGCGGCGGUGGCGUGGCC | 23 | 12676 |
| BCL11A-10676 | + | GAGCGCCGCGGCGGUGGCGUGGCC | 24 | 12677 |
| BCL11A-10677 | + | UGCGGGGCGGGGGCUCC | 18 | 12678 |
| BCL11A-10678 | + | GUGCGGGGCGGGGGCUCC | 19 | 12679 |
| BCL11A-10679 | + | GGUGCGGGGCGGGGGCUCC | 20 | 12680 |
| BCL11A-10680 | + | AGGUGCGGGGCGGGGGCUCC | 21 | 12681 |
| BCL11A-10681 | + | GAGGUGCGGGGCGGGGGCUCC | 22 | 12682 |
| BCL11A-10682 | + | GGAGGUGCGGGGCGGGGGCUCC | 23 | 12683 |
| BCL11A-10683 | + | GGGAGGUGCGGGGCGGGGGCUCC | 24 | 12684 |
| BCL11A-10684 | + | AACAUGGGCAGGGCGAGC | 18 | 12685 |
| BCL11A-10685 | + | AAACAUGGGCAGGGCGAGC | 19 | 12686 |
| BCL11A-9721 | + | AAAACAUGGGCAGGGCGAGC | 20 | 12687 |
| BCL11A-10686 | + | CAAAACAUGGGCAGGGCGAGC | 21 | 12688 |
| BCL11A-10687 | + | ACAAAACAUGGGCAGGGCGAGC | 22 | 12689 |
| BCL11A-10688 | + | CACAAAACAUGGGCAGGGCGAGC | 23 | 12690 |
| BCL11A-10689 | + | ACACAAAACAUGGGCAGGGCGAGC | 24 | 12691 |
| BCL11A-10690 | + | GCCGAGGGGAGGGGCGC | 18 | 12692 |
| BCL11A-10691 | + | GGCCGAGGGGAGGGGCGC | 19 | 12693 |
| BCL11A-4490 | + | GGGCCGAGGGGAGGGGCGC | 20 | 12694 |
| BCL11A-10692 | + | CGGGCCGAGGGGAGGGGCGC | 21 | 12695 |
| BCL11A-10693 | + | GCGGGCCGAGGGGAGGGGCGC | 22 | 12696 |
| BCL11A-10694 | + | GGCGGGCCGAGGGGAGGGGCGC | 23 | 12697 |
| BCL11A-10695 | + | GGGCGGGCCGAGGGGAGGGGCGC | 24 | 12698 |
| BCL11A-10696 | + | AUAAUACAAAGAUGGCGC | 18 | 12699 |
| BCL11A-10697 | + | AAUAAUACAAAGAUGGCGC | 19 | 12700 |
| BCL11A-9565 | + | AAAUAAUACAAAGAUGGCGC | 20 | 12701 |
| BCL11A-10698 | + | GAAAUAAUACAAAGAUGGCGC | 21 | 12702 |
| BCL11A-10699 | + | AGAAAUAAUACAAAGAUGGCGC | 22 | 12703 |
| BCL11A-10700 | + | UAGAAAUAAUACAAAGAUGGCGC | 23 | 12704 |
| BCL11A-10701 | + | UUAGAAAUAAUACAAAGAUGGCGC | 24 | 12705 |

TABLE 19C-continued

3rd Tier

| gRNA Name | DNA Strand | Targeting Domain | Target Site Length | SEQ ID NO: |
|---|---|---|---|---|
| BCL11A-10702 | + | GAGGGGGAGGUGCGGGGC | 18 | 12706 |
| BCL11A-10703 | + | GGAGGGGGAGGUGCGGGGC | 19 | 12707 |
| BCL11A-9724 | + | GGGAGGGGGAGGUGCGGGGC | 20 | 12708 |
| BCL11A-10704 | + | GGGGAGGGGGAGGUGCGGGGC | 21 | 12709 |
| BCL11A-10705 | + | CGGGGAGGGGGAGGUGCGGGGC | 22 | 12710 |
| BCL11A-10706 | + | GCGGGGAGGGGGAGGUGCGGGGC | 23 | 12711 |
| BCL11A-10707 | + | UGCGGGGAGGGGGAGGUGCGGGGC | 24 | 12712 |
| BCL11A-10708 | + | CCGCGGCGGUGGCGUGGC | 18 | 12713 |
| BCL11A-10709 | + | GCCGCGGCGGUGGCGUGGC | 19 | 12714 |
| BCL11A-9725 | + | CGCCGCGGCGGUGGCGUGGC | 20 | 12715 |
| BCL11A-10710 | + | GCGCCGCGGCGGUGGCGUGGC | 21 | 12716 |
| BCL11A-10711 | + | AGCGCCGCGGCGGUGGCGUGGC | 22 | 12717 |
| BCL11A-10712 | + | GAGCGCCGCGGCGGUGGCGUGGC | 23 | 12718 |
| BCL11A-10713 | + | CGAGCGCCGCGGCGGUGGCGUGGC | 24 | 12719 |
| BCL11A-10714 | + | CAAGCCAUGGCCAGUGC | 18 | 12720 |
| BCL11A-10715 | + | ACAAGCCAUGGCCAGUGC | 19 | 12721 |
| BCL11A-9727 | + | GACAAGCCAUGGCCAGUGC | 20 | 12722 |
| BCL11A-10716 | + | GGACAAGCCAUGGCCAGUGC | 21 | 12723 |
| BCL11A-10717 | + | AGGACAAGCCAUGGCCAGUGC | 22 | 12724 |
| BCL11A-10718 | + | CAGGACAAGCCAUGGCCAGUGC | 23 | 12725 |
| BCL11A-10719 | + | CCAGGACAAGCCAUGGCCAGUGC | 24 | 12726 |
| BCL11A-10720 | + | CACCAAUGGACACACAUC | 18 | 12727 |
| BCL11A-10721 | + | ACACCAAUGGACACACAUC | 19 | 12728 |
| BCL11A-9729 | + | CACACCAAUGGACACACAUC | 20 | 12729 |
| BCL11A-10722 | + | UCACACCAAUGGACACACAUC | 21 | 12730 |
| BCL11A-10723 | + | CUCACACCAAUGGACACACAUC | 22 | 12731 |
| BCL11A-10724 | + | GCUCACACCAAUGGACACACAUC | 23 | 12732 |
| BCL11A-10725 | + | AGCUCACACCAAUGGACACACAUC | 24 | 12733 |
| BCL11A-10726 | + | GACGGCUCGGUUCACAUC | 18 | 12734 |
| BCL11A-10727 | + | CGACGGCUCGGUUCACAUC | 19 | 12735 |
| BCL11A-9568 | + | ACGACGGCUCGGUUCACAUC | 20 | 12736 |
| BCL11A-10728 | + | GACGACGGCUCGGUUCACAUC | 21 | 12737 |
| BCL11A-10729 | + | GGACGACGGCUCGGUUCACAUC | 22 | 12738 |
| BCL11A-10730 | + | CGGACGACGGCUCGGUUCACAUC | 23 | 12739 |
| BCL11A-10731 | + | GCGGACGACGGCUCGGUUCACAUC | 24 | 12740 |
| BCL11A-10732 | + | UUAGAAAGAAGGAGACUC | 18 | 12741 |
| BCL11A-10733 | + | GUUAGAAAGAAGGAGACUC | 19 | 12742 |
| BCL11A-10734 | + | GGUUAGAAAGAAGGAGACUC | 20 | 12743 |

TABLE 19C-continued

3rd Tier

| gRNA Name | DNA Strand | Targeting Domain | Target Site Length | SEQ ID NO: |
|---|---|---|---|---|
| BCL11A-10735 | + | GGGUUAGAAAGAAGGAGACUC | 21 | 12744 |
| BCL11A-10736 | + | CGGGUUAGAAAGAAGGAGACUC | 22 | 12745 |
| BCL11A-10737 | + | CCGGGUUAGAAAGAAGGAGACUC | 23 | 12746 |
| BCL11A-10738 | + | GCCGGGUUAGAAAGAAGGAGACUC | 24 | 12747 |
| BCL11A-10739 | + | UCUCUUUUACCUCGACUC | 18 | 12748 |
| BCL11A-10740 | + | AUCUCUUUUACCUCGACUC | 19 | 12749 |
| BCL11A-10741 | + | UAUCUCUUUUACCUCGACUC | 20 | 12750 |
| BCL11A-10742 | + | UUAUCUCUUUUACCUCGACUC | 21 | 12751 |
| BCL11A-10743 | + | UUUAUCUCUUUUACCUCGACUC | 22 | 12752 |
| BCL11A-10744 | + | CUUUAUCUCUUUUACCUCGACUC | 23 | 12753 |
| BCL11A-10745 | + | CCUUUAUCUCUUUUACCUCGACUC | 24 | 12754 |
| BCL11A-10746 | + | CUCUCGGAGGUUUUUCUC | 18 | 12755 |
| BCL11A-10747 | + | ACUCUCGGAGGUUUUUCUC | 19 | 12756 |
| BCL11A-10748 | + | GACUCUCGGAGGUUUUUCUC | 20 | 12757 |
| BCL11A-10749 | + | CGACUCUCGGAGGUUUUUCUC | 21 | 12758 |
| BCL11A-10750 | + | UCGACUCUCGGAGGUUUUUCUC | 22 | 12759 |
| BCL11A-10751 | + | CUCGACUCUCGGAGGUUUUUCUC | 23 | 12760 |
| BCL11A-10752 | + | CCUCGACUCUCGGAGGUUUUUCUC | 24 | 12761 |
| BCL11A-10753 | + | AAAAAAAAAAAAAAAAG | 18 | 12762 |
| BCL11A-10754 | + | AAAAAAAAAAAAAAAAAG | 19 | 12763 |
| BCL11A-4526 | + | AAAAAAAAAAAAAAAAAAG | 20 | 12764 |
| BCL11A-10755 | + | AAAAAAAAAAAAAAAAAAAG | 21 | 12765 |
| BCL11A-10756 | + | AAAAAAAAAAAAAAAAAAAAG | 22 | 12766 |
| BCL11A-10757 | + | AAAAAAAAAAAAAAAAAAAAAG | 23 | 12767 |
| BCL11A-10758 | + | AAAAAAAAAAAAAAAAAAAAAAG | 24 | 12768 |
| BCL11A-10759 | + | GAGAGCCGGGUUAGAAAG | 18 | 12769 |
| BCL11A-10760 | + | GGAGAGCCGGGUUAGAAAG | 19 | 12770 |
| BCL11A-10761 | + | GGGAGAGCCGGGUUAGAAAG | 20 | 12771 |
| BCL11A-10762 | + | CGGGAGAGCCGGGUUAGAAAG | 21 | 12772 |
| BCL11A-10763 | + | UCGGGAGAGCCGGGUUAGAAAG | 22 | 12773 |
| BCL11A-10764 | + | AUCGGGAGAGCCGGGUUAGAAAG | 23 | 12774 |
| BCL11A-10765 | + | CAUCGGGAGAGCCGGGUUAGAAAG | 24 | 12775 |
| BCL11A-10766 | + | GGGCGAGCAGGAGAGAAG | 18 | 12776 |
| BCL11A-10767 | + | AGGGCGAGCAGGAGAGAAG | 19 | 12777 |
| BCL11A-4629 | + | CAGGGCGAGCAGGAGAGAAG | 20 | 12778 |
| BCL11A-10768 | + | GCAGGGCGAGCAGGAGAGAAG | 21 | 12779 |
| BCL11A-10769 | + | GGCAGGGCGAGCAGGAGAGAAG | 22 | 12780 |

TABLE 19C-continued

| 3rd Tier | | | | |
|---|---|---|---|---|
| gRNA Name | DNA Strand | Targeting Domain | Target Site Length | SEQ ID NO: |
| BCL11A-10770 | + | GGGCAGGGCGAGCAGGAGAGAAG | 23 | 12781 |
| BCL11A-10771 | + | UGGGCAGGGCGAGCAGGAGAGAAG | 24 | 12782 |
| BCL11A-10772 | + | AGAAGGGGAGGAGGGAAG | 18 | 12783 |
| BCL11A-10773 | + | GAGAAGGGGAGGAGGGAAG | 19 | 12784 |
| BCL11A-4577 | + | AGAGAAGGGGAGGAGGGAAG | 20 | 12785 |
| BCL11A-10774 | + | GAGAGAAGGGGAGGAGGGAAG | 21 | 12786 |
| BCL11A-10775 | + | GGAGAGAAGGGGAGGAGGGAAG | 22 | 12787 |
| BCL11A-10776 | + | AGGAGAGAAGGGGAGGAGGGAAG | 23 | 12788 |
| BCL11A-10777 | + | CAGGAGAGAAGGGGAGGAGGGAAG | 24 | 12789 |
| BCL11A-10778 | + | ACACGGCAAUGGUUCCAG | 18 | 12790 |
| BCL11A-10779 | + | UACACGGCAAUGGUUCCAG | 19 | 12791 |
| BCL11A-10780 | + | AUACACGGCAAUGGUUCCAG | 20 | 12792 |
| BCL11A-10781 | + | CAUACACGGCAAUGGUUCCAG | 21 | 12793 |
| BCL11A-10782 | + | GCAUACACGGCAAUGGUUCCAG | 22 | 12794 |
| BCL11A-10783 | + | UGCAUACACGGCAAUGGUUCCAG | 23 | 12795 |
| BCL11A-10784 | + | GUGCAUACACGGCAAUGGUUCCAG | 24 | 12796 |
| BCL11A-10785 | + | CAUGGGCAGGGCGAGCAG | 18 | 12797 |
| BCL11A-10786 | + | ACAUGGGCAGGGCGAGCAG | 19 | 12798 |
| BCL11A-10787 | + | AACAUGGGCAGGGCGAGCAG | 20 | 12799 |
| BCL11A-10788 | + | AAACAUGGGCAGGGCGAGCAG | 21 | 12800 |
| BCL11A-10789 | + | AAAACAUGGGCAGGGCGAGCAG | 22 | 12801 |
| BCL11A-10790 | + | CAAAACAUGGGCAGGGCGAGCAG | 23 | 12802 |
| BCL11A-10791 | + | ACAAAACAUGGGCAGGGCGAGCAG | 24 | 12803 |
| BCL11A-10792 | + | GGAGAGAGAGAGAGAGAG | 18 | 12804 |
| BCL11A-10793 | + | GGGAGAGAGAGAGAGAGAG | 19 | 12805 |
| BCL11A-4999 | + | AGGGAGAGAGAGAGAGAGAG | 20 | 12806 |
| BCL11A-10794 | + | GAGGGAGAGAGAGAGAGAGAG | 21 | 12807 |
| BCL11A-10795 | + | AGAGGGAGAGAGAGAGAGAGAG | 22 | 12808 |
| BCL11A-10796 | + | UAGAGGGAGAGAGAGAGAGAGAG | 23 | 12809 |
| BCL11A-10797 | + | AUAGAGGGAGAGAGAGAGAGAGAG | 24 | 12810 |
| BCL11A-10798 | + | AAAGAGGGAGAGAGAGAG | 18 | 12811 |
| BCL11A-10799 | + | AAAAGAGGGAGAGAGAGAG | 19 | 12812 |
| BCL11A-4916 | + | AAAAAGAGGGAGAGAGAGAG | 20 | 12813 |
| BCL11A-10800 | + | AAAAAAGAGGGAGAGAGAGAG | 21 | 12814 |
| BCL11A-10801 | + | AAAAAAAGAGGGAGAGAGAGAG | 22 | 12815 |
| BCL11A-10802 | + | AAAAAAAAGAGGGAGAGAGAGAG | 23 | 12816 |
| BCL11A-10803 | + | AAAAAAAAAGAGGGAGAGAGAGAG | 24 | 12817 |
| BCL11A-10804 | + | GCAGGGCGAGCAGGAGAG | 18 | 12818 |

TABLE 19C-continued

3rd Tier

| gRNA Name | DNA Strand | Targeting Domain | Target Site Length | SEQ ID NO: |
|---|---|---|---|---|
| BCL11A-10805 | + | GGCAGGGCGAGCAGGAGAG | 19 | 12819 |
| BCL11A-4870 | + | GGGCAGGGCGAGCAGGAGAG | 20 | 12820 |
| BCL11A-10806 | + | UGGGCAGGGCGAGCAGGAGAG | 21 | 12821 |
| BCL11A-10807 | + | AUGGGCAGGGCGAGCAGGAGAG | 22 | 12822 |
| BCL11A-10808 | + | CAUGGGCAGGGCGAGCAGGAGAG | 23 | 12823 |
| BCL11A-10809 | + | ACAUGGGCAGGGCGAGCAGGAGAG | 24 | 12824 |
| BCL11A-10810 | + | GUGGCGUGGCCGGGAGAG | 18 | 12825 |
| BCL11A-10811 | + | GGUGGCGUGGCCGGGAGAG | 19 | 12826 |
| BCL11A-10812 | + | CGGUGGCGUGGCCGGGAGAG | 20 | 12827 |
| BCL11A-10813 | + | GCGGUGGCGUGGCCGGGAGAG | 21 | 12828 |
| BCL11A-10814 | + | GGCGGUGGCGUGGCCGGGAGAG | 22 | 12829 |
| BCL11A-10815 | + | CGGCGGUGGCGUGGCCGGGAGAG | 23 | 12830 |
| BCL11A-10816 | + | GCGGCGGUGGCGUGGCCGGGAGAG | 24 | 12831 |
| BCL11A-10817 | + | GGGGAGGGGCGGGCCGAG | 18 | 12832 |
| BCL11A-10818 | + | GGGGGAGGGGCGGGCCGAG | 19 | 12833 |
| BCL11A-4677 | + | CGGGGGAGGGGCGGGCCGAG | 20 | 12834 |
| BCL11A-10819 | + | CCGGGGGAGGGGCGGGCCGAG | 21 | 12835 |
| BCL11A-10820 | + | CCCGGGGGAGGGGCGGGCCGAG | 22 | 12836 |
| BCL11A-10821 | + | CCCCGGGGGAGGGGCGGGCCGAG | 23 | 12837 |
| BCL11A-10822 | + | CCCCCGGGGGAGGGGCGGGCCGAG | 24 | 12838 |
| BCL11A-10823 | + | AAACAUGGGCAGGGCGAG | 18 | 12839 |
| BCL11A-10824 | + | AAAACAUGGGCAGGGCGAG | 19 | 12840 |
| BCL11A-10825 | + | CAAAACAUGGGCAGGGCGAG | 20 | 12841 |
| BCL11A-10826 | + | ACAAAACAUGGGCAGGGCGAG | 21 | 12842 |
| BCL11A-10827 | + | CACAAAACAUGGGCAGGGCGAG | 22 | 12843 |
| BCL11A-10828 | + | ACACAAAACAUGGGCAGGGCGAG | 23 | 12844 |
| BCL11A-10829 | + | CACACAAAACAUGGGCAGGGCGAG | 24 | 12845 |
| BCL11A-10830 | + | AGCAGGAGAGAAGGGGAG | 18 | 12846 |
| BCL11A-10831 | + | GAGCAGGAGAGAAGGGGAG | 19 | 12847 |
| BCL11A-5082 | + | CGAGCAGGAGAGAAGGGGAG | 20 | 12848 |
| BCL11A-10832 | + | GCGAGCAGGAGAGAAGGGGAG | 21 | 12849 |
| BCL11A-10833 | + | GGCGAGCAGGAGAGAAGGGGAG | 22 | 12850 |
| BCL11A-10834 | + | GGGCGAGCAGGAGAGAAGGGGAG | 23 | 12851 |
| BCL11A-10835 | + | AGGGCGAGCAGGAGAGAAGGGGAG | 24 | 12852 |
| BCL11A-10836 | + | AAUGGCCAGUGCGGGGAG | 18 | 12853 |
| BCL11A-10837 | + | CAAUGGCCAGUGCGGGGAG | 19 | 12854 |
| BCL11A-9572 | + | CCAAUGGCCAGUGCGGGGAG | 20 | 12855 |

TABLE 19C-continued

3rd Tier

| gRNA Name | DNA Strand | Targeting Domain | Target Site Length | SEQ ID NO: |
|---|---|---|---|---|
| BCL11A-10838 | + | GCCAAUGGCCAGUGCGGGAG | 21 | 12856 |
| BCL11A-10839 | + | AGCCAAUGGCCAGUGCGGGAG | 22 | 12857 |
| BCL11A-10840 | + | AAGCCAAUGGCCAGUGCGGGAG | 23 | 12858 |
| BCL11A-10841 | + | CAAGCCAAUGGCCAGUGCGGGAG | 24 | 12859 |
| BCL11A-10842 | + | GAGAGAGAAGAGAGAUAG | 18 | 12860 |
| BCL11A-10843 | + | AGAGAGAGAAGAGAGAUAG | 19 | 12861 |
| BCL11A-9740 | + | GAGAGAGAGAAGAGAGAUAG | 20 | 12862 |
| BCL11A-10844 | + | AGAGAGAGAGAAGAGAGAUAG | 21 | 12863 |
| BCL11A-10845 | + | GAGAGAGAGAGAAGAGAGAUAG | 22 | 12864 |
| BCL11A-10846 | + | GGAGAGAGAGAGAAGAGAGAUAG | 23 | 12865 |
| BCL11A-10847 | + | GGGAGAGAGAGAGAAGAGAGAUAG | 24 | 12866 |
| BCL11A-10848 | + | CGCCAGACGCGGCCCCCG | 18 | 12867 |
| BCL11A-10849 | + | ACGCCAGACGCGGCCCCCG | 19 | 12868 |
| BCL11A-4351 | + | GACGCCAGACGCGGCCCCCG | 20 | 12869 |
| BCL11A-10850 | + | GGACGCCAGACGCGGCCCCCG | 21 | 12870 |
| BCL11A-10851 | + | CGGACGCCAGACGCGGCCCCCG | 22 | 12871 |
| BCL11A-10852 | + | GCGGACGCCAGACGCGGCCCCCG | 23 | 12872 |
| BCL11A-10853 | + | CGCGGACGCCAGACGCGGCCCCCG | 24 | 12873 |
| BCL11A-10854 | + | CGGGGGAGGGGCGGGCCG | 18 | 12874 |
| BCL11A-10855 | + | CCGGGGGAGGGGCGGGCCG | 19 | 12875 |
| BCL11A-4642 | + | CCCGGGGGAGGGGCGGGCCG | 20 | 12876 |
| BCL11A-10856 | + | CCCCGGGGGAGGGGCGGGCCG | 21 | 12877 |
| BCL11A-10857 | + | CCCCCGGGGGAGGGGCGGGCCG | 22 | 12878 |
| BCL11A-10858 | + | GCCCCCGGGGGAGGGGCGGGCCG | 23 | 12879 |
| BCL11A-10859 | + | GGCCCCCGGGGGAGGGGCGGGCCG | 24 | 12880 |
| BCL11A-10860 | + | GCGGCGGCGGCGGCGGCG | 18 | 12881 |
| BCL11A-10861 | + | GGCGGCGGCGGCGGCGGCG | 19 | 12882 |
| BCL11A-5097 | + | CGGCGGCGGCGGCGGCGGCG | 20 | 12883 |
| BCL11A-10862 | + | GCGGCGGCGGCGGCGGCGGCG | 21 | 12884 |
| BCL11A-10863 | + | GGCGGCGGCGGCGGCGGCGGCG | 22 | 12885 |
| BCL11A-10864 | + | CGGCGGCGGCGGCGGCGGCGGCG | 23 | 12886 |
| BCL11A-10865 | + | GCGGCGGCGGCGGCGGCGGCGGCG | 24 | 12887 |
| BCL11A-10866 | + | AGGGGGAGGUGCGGGGCG | 18 | 12888 |
| BCL11A-10867 | + | GAGGGGGAGGUGCGGGGCG | 19 | 12889 |
| BCL11A-9749 | + | GGAGGGGGAGGUGCGGGGCG | 20 | 12890 |
| BCL11A-10868 | + | GGGAGGGGGAGGUGCGGGGCG | 21 | 12891 |
| BCL11A-10869 | + | GGGGAGGGGGAGGUGCGGGGCG | 22 | 12892 |
| BCL11A-10870 | + | CGGGGAGGGGGAGGUGCGGGGCG | 23 | 12893 |

TABLE 19C-continued

3rd Tier

| gRNA Name | DNA Strand | Targeting Domain | Target Site Length | SEQ ID NO: |
|---|---|---|---|---|
| BCL11A-10871 | + | GCGGGGAGGGGGAGGUGCGGGGCG | 24 | 12894 |
| BCL11A-10872 | + | GGCCGAGGGGAGGGGCG | 18 | 12895 |
| BCL11A-10873 | + | GGGCCGAGGGGAGGGGCG | 19 | 12896 |
| BCL11A-5099 | + | CGGGCCGAGGGGAGGGGCG | 20 | 12897 |
| BCL11A-10874 | + | GCGGGCCGAGGGGAGGGGCG | 21 | 12898 |
| BCL11A-10875 | + | GGCGGGCCGAGGGGAGGGGCG | 22 | 12899 |
| BCL11A-10876 | + | GGGCGGGCCGAGGGGAGGGGCG | 23 | 12900 |
| BCL11A-10877 | + | GGGGCGGGCCGAGGGGAGGGGCG | 24 | 12901 |
| BCL11A-10878 | + | AAUAAUACAAAGAUGGCG | 18 | 12902 |
| BCL11A-10879 | + | AAAUAAUACAAAGAUGGCG | 19 | 12903 |
| BCL11A-10880 | + | GAAAUAAUACAAAGAUGGCG | 20 | 12904 |
| BCL11A-10881 | + | AGAAAUAAUACAAAGAUGGCG | 21 | 12905 |
| BCL11A-10882 | + | UAGAAAUAAUACAAAGAUGGCG | 22 | 12906 |
| BCL11A-10883 | + | UUAGAAAUAAUACAAAGAUGGCG | 23 | 12907 |
| BCL11A-10884 | + | AUUAGAAAUAAUACAAAGAUGGCG | 24 | 12908 |
| BCL11A-10885 | + | AAGCCAAUGGCCAGUGCG | 18 | 12909 |
| BCL11A-10886 | + | CAAGCCAAUGGCCAGUGCG | 19 | 12910 |
| BCL11A-9751 | + | ACAAGCCAAUGGCCAGUGCG | 20 | 12911 |
| BCL11A-10887 | + | GACAAGCCAAUGGCCAGUGCG | 21 | 12912 |
| BCL11A-10888 | + | GGACAAGCCAAUGGCCAGUGCG | 22 | 12913 |
| BCL11A-10889 | + | AGGACAAGCCAAUGGCCAGUGCG | 23 | 12914 |
| BCL11A-10890 | + | CAGGACAAGCCAAUGGCCAGUGCG | 24 | 12915 |
| BCL11A-6490 | + | GGGUUUGCCUUGCUUGCG | 18 | 12916 |
| BCL11A-6491 | + | GGGGUUUGCCUUGCUUGCG | 19 | 12917 |
| BCL11A-6492 | + | UGGGGUUUGCCUUGCUUGCG | 20 | 12918 |
| BCL11A-6493 | + | CUGGGGUUUGCCUUGCUUGCG | 21 | 12919 |
| BCL11A-6494 | + | GCUGGGGUUUGCCUUGCUUGCG | 22 | 12920 |
| BCL11A-6495 | + | UGCUGGGGUUUGCCUUGCUUGCG | 23 | 12921 |
| BCL11A-6496 | + | GUGCUGGGGUUUGCCUUGCUUGCG | 24 | 12922 |
| BCL11A-10891 | + | CAGGGGUGGGAGGAAAGG | 18 | 12923 |
| BCL11A-10892 | + | GCAGGGGUGGGAGGAAAGG | 19 | 12924 |
| BCL11A-10893 | + | GGCAGGGGUGGGAGGAAAGG | 20 | 12925 |
| BCL11A-10894 | + | UGGCAGGGGUGGGAGGAAAGG | 21 | 12926 |
| BCL11A-10895 | + | GUGGCAGGGGUGGGAGGAAAGG | 22 | 12927 |
| BCL11A-10896 | + | GGUGGCAGGGGUGGGAGGAAAGG | 23 | 12928 |
| BCL11A-10897 | + | GGGUGGCAGGGGUGGGAGGAAAGG | 24 | 12929 |
| BCL11A-10898 | + | ACACAAAACAUGGGCAGG | 18 | 12930 |

TABLE 19C-continued

3rd Tier

| gRNA Name | DNA Strand | Targeting Domain | Target Site Length | SEQ ID NO: |
|---|---|---|---|---|
| BCL11A-10899 | + | CACACAAAACAUGGGCAGG | 19 | 12931 |
| BCL11A-10900 | + | ACACACAAAACAUGGGCAGG | 20 | 12932 |
| BCL11A-10901 | + | GACACACAAAACAUGGGCAGG | 21 | 12933 |
| BCL11A-10902 | + | AGACACACAAAACAUGGGCAGG | 22 | 12934 |
| BCL11A-10903 | + | GAGACACACAAAACAUGGGCAGG | 23 | 12935 |
| BCL11A-10904 | + | AGAGACACACAAAACAUGGGCAGG | 24 | 12936 |
| BCL11A-10905 | + | AAAAAAAAAAAAAGAGG | 18 | 12937 |
| BCL11A-10906 | + | AAAAAAAAAAAAAAGAGG | 19 | 12938 |
| BCL11A-4903 | + | AAAAAAAAAAAAAAAGAGG | 20 | 12939 |
| BCL11A-10907 | + | AAAAAAAAAAAAAAAAGAGG | 21 | 12940 |
| BCL11A-10908 | + | AAAAAAAAAAAAAAAAAGAGG | 22 | 12941 |
| BCL11A-10909 | + | AAAAAAAAAAAAAAAAAAGAGG | 23 | 12942 |
| BCL11A-10910 | + | AAAAAAAAAAAAAAAAAAAGAGG | 24 | 12943 |
| BCL11A-10911 | + | AGAGAAGAGAGAUAGAGG | 18 | 12944 |
| BCL11A-10912 | + | GAGAGAAGAGAGAUAGAGG | 19 | 12945 |
| BCL11A-10913 | + | AGAGAGAAGAGAGAUAGAGG | 20 | 12946 |
| BCL11A-10914 | + | GAGAGAGAAGAGAGAUAGAGG | 21 | 12947 |
| BCL11A-10915 | + | AGAGAGAGAAGAGAGAUAGAGG | 22 | 12948 |
| BCL11A-10916 | + | GAGAGAGAGAAGAGAGAUAGAGG | 23 | 12949 |
| BCL11A-10917 | + | AGAGAGAGAGAAGAGAGAUAGAGG | 24 | 12950 |
| BCL11A-10918 | + | GCAGGAGAGAAGGGGAGG | 18 | 12951 |
| BCL11A-10919 | + | AGCAGGAGAGAAGGGGAGG | 19 | 12952 |
| BCL11A-4408 | + | GAGCAGGAGAGAAGGGGAGG | 20 | 12953 |
| BCL11A-10920 | + | CGAGCAGGAGAGAAGGGGAGG | 21 | 12954 |
| BCL11A-10921 | + | GCGAGCAGGAGAGAAGGGGAGG | 22 | 12955 |
| BCL11A-10922 | + | GGCGAGCAGGAGAGAAGGGGAGG | 23 | 12956 |
| BCL11A-10923 | + | GGGCGAGCAGGAGAGAAGGGGAGG | 24 | 12957 |
| BCL11A-10924 | + | AUGGCCAGUGCGGGGAGG | 18 | 12958 |
| BCL11A-10925 | + | AAUGGCCAGUGCGGGGAGG | 19 | 12959 |
| BCL11A-9756 | + | CAAUGGCCAGUGCGGGGAGG | 20 | 12960 |
| BCL11A-10926 | + | CCAAUGGCCAGUGCGGGGAGG | 21 | 12961 |
| BCL11A-10927 | + | GCCAAUGGCCAGUGCGGGGAGG | 22 | 12962 |
| BCL11A-10928 | + | AGCCAAUGGCCAGUGCGGGGAGG | 23 | 12963 |
| BCL11A-10929 | + | AAGCCAAUGGCCAGUGCGGGGAGG | 24 | 12964 |
| BCL11A-10930 | + | GCCAGACGCGGCCCCCGG | 18 | 12965 |
| BCL11A-10931 | + | CGCCAGACGCGGCCCCCGG | 19 | 12966 |
| BCL11A-4561 | + | ACGCCAGACGCGGCCCCCGG | 20 | 12967 |
| BCL11A-10932 | + | GACGCCAGACGCGGCCCCCGG | 21 | 12968 |

TABLE 19C-continued

3rd Tier

| gRNA Name | DNA Strand | Targeting Domain | Target Site Length | SEQ ID NO: |
|---|---|---|---|---|
| BCL11A-10933 | + | GGACGCCAGACGCGGCCCCGG | 22 | 12969 |
| BCL11A-10934 | + | CGGACGCCAGACGCGGCCCCGG | 23 | 12970 |
| BCL11A-10935 | + | GCGGACGCCAGACGCGGCCCCGG | 24 | 12971 |
| BCL11A-10936 | + | CGGCGGUGGCGUGGCCGG | 18 | 12972 |
| BCL11A-10937 | + | GCGGCGGUGGCGUGGCCGG | 19 | 12973 |
| BCL11A-10938 | + | CGCGGCGGUGGCGUGGCCGG | 20 | 12974 |
| BCL11A-10939 | + | CCGCGGCGGUGGCGUGGCCGG | 21 | 12975 |
| BCL11A-10940 | + | GCCGCGGCGGUGGCGUGGCCGG | 22 | 12976 |
| BCL11A-10941 | + | CGCCGCGGCGGUGGCGUGGCCGG | 23 | 12977 |
| BCL11A-10942 | + | GCGCCGCGGCGGUGGCGUGGCCGG | 24 | 12978 |
| BCL11A-10943 | + | CGGCGGCGGCGGCGGCGG | 18 | 12979 |
| BCL11A-10944 | + | GCGGCGGCGGCGGCGGCGG | 19 | 12980 |
| BCL11A-4479 | + | GGCGGCGGCGGCGGCGGCGG | 20 | 12981 |
| BCL11A-10945 | + | CGGCGGCGGCGGCGGCGGCGG | 21 | 12982 |
| BCL11A-10946 | + | GCGGCGGCGGCGGCGGCGGCGG | 22 | 12983 |
| BCL11A-10947 | + | GGCGGCGGCGGCGGCGGCGGCGG | 23 | 12984 |
| BCL11A-10948 | + | CGGCGGCGGCGGCGGCGGCGGCGG | 24 | 12985 |
| BCL11A-10949 | + | CGGCUCGGUUCACAUCGG | 18 | 12986 |
| BCL11A-10950 | + | ACGGCUCGGUUCACAUCGG | 19 | 12987 |
| BCL11A-10951 | + | GACGGCUCGGUUCACAUCGG | 20 | 12988 |
| BCL11A-10952 | + | CGACGGCUCGGUUCACAUCGG | 21 | 12989 |
| BCL11A-10953 | + | ACGACGGCUCGGUUCACAUCGG | 22 | 12990 |
| BCL11A-10954 | + | GACGACGGCUCGGUUCACAUCGG | 23 | 12991 |
| BCL11A-10955 | + | GGACGACGGCUCGGUUCACAUCGG | 24 | 12992 |
| BCL11A-10956 | + | AGGGGUGGGAGGAAAGGG | 18 | 12993 |
| BCL11A-10957 | + | CAGGGGUGGGAGGAAAGGG | 19 | 12994 |
| BCL11A-9759 | + | GCAGGGGUGGGAGGAAAGGG | 20 | 12995 |
| BCL11A-10958 | + | GGCAGGGGUGGGAGGAAAGGG | 21 | 12996 |
| BCL11A-10959 | + | UGGCAGGGGUGGGAGGAAAGGG | 22 | 12997 |
| BCL11A-10960 | + | GUGGCAGGGGUGGGAGGAAAGGG | 23 | 12998 |
| BCL11A-10961 | + | GGUGGCAGGGGUGGGAGGAAAGGG | 24 | 12999 |
| BCL11A-10962 | + | GCGAGCAGGAGAGAAGGG | 18 | 13000 |
| BCL11A-10963 | + | GGCGAGCAGGAGAGAAGGG | 19 | 13001 |
| BCL11A-4873 | + | GGGCGAGCAGGAGAGAAGGG | 20 | 13002 |
| BCL11A-10964 | + | AGGGCGAGCAGGAGAGAAGGG | 21 | 13003 |
| BCL11A-10965 | + | CAGGGCGAGCAGGAGAGAAGGG | 22 | 13004 |
| BCL11A-10966 | + | GCAGGGCGAGCAGGAGAGAAGGG | 23 | 13005 |

TABLE 19C-continued

3rd Tier

| gRNA Name | DNA Strand | Targeting Domain | Target Site Length | SEQ ID NO: |
|---|---|---|---|---|
| BCL11A-10967 | + | GGCAGGGCGAGCAGGAGAGAAGGG | 24 | 13006 |
| BCL11A-10968 | + | AAGAAAGGGUGGCAGGG | 18 | 13007 |
| BCL11A-10969 | + | GAAGAAAGGGUGGCAGGG | 19 | 13008 |
| BCL11A-10970 | + | AGAAGAAAGGGUGGCAGGG | 20 | 13009 |
| BCL11A-10971 | + | GAGAAGAAAGGGUGGCAGGG | 21 | 13010 |
| BCL11A-10972 | + | AGAGAAGAAAGGGUGGCAGGG | 22 | 13011 |
| BCL11A-10973 | + | GAGAGAAGAAAGGGUGGCAGGG | 23 | 13012 |
| BCL11A-10974 | + | GGAGAGAAGAAAGGGUGGCAGGG | 24 | 13013 |
| BCL11A-10975 | + | GGAGGGGCGGGCCGAGGG | 18 | 13014 |
| BCL11A-10976 | + | GGGAGGGGCGGGCCGAGGG | 19 | 13015 |
| BCL11A-4875 | + | GGGGAGGGGCGGGCCGAGGG | 20 | 13016 |
| BCL11A-10977 | + | GGGGGAGGGGCGGGCCGAGGG | 21 | 13017 |
| BCL11A-10978 | + | CGGGGGAGGGGCGGGCCGAGGG | 22 | 13018 |
| BCL11A-10979 | + | CCGGGGGAGGGGCGGGCCGAGGG | 23 | 13019 |
| BCL11A-10980 | + | CCCGGGGGAGGGGCGGGCCGAGGG | 24 | 13020 |
| BCL11A-10981 | + | GAGAGAAGGGGAGGAGGG | 18 | 13021 |
| BCL11A-10982 | + | GGAGAGAAGGGGAGGAGGG | 19 | 13022 |
| BCL11A-4998 | + | AGGAGAGAAGGGGAGGAGGG | 20 | 13023 |
| BCL11A-10983 | + | CAGGAGAGAAGGGGAGGAGGG | 21 | 13024 |
| BCL11A-10984 | + | GCAGGAGAGAAGGGGAGGAGGG | 22 | 13025 |
| BCL11A-10985 | + | AGCAGGAGAGAAGGGGAGGAGGG | 23 | 13026 |
| BCL11A-10986 | + | GAGCAGGAGAGAAGGGGAGGAGGG | 24 | 13027 |
| BCL11A-10987 | + | GCGGCCCCGGGGGAGGG | 18 | 13028 |
| BCL11A-10988 | + | CGCGGCCCCGGGGGAGGG | 19 | 13029 |
| BCL11A-4959 | + | ACGCGGCCCCGGGGGAGGG | 20 | 13030 |
| BCL11A-10989 | + | GACGCGGCCCCGGGGGAGGG | 21 | 13031 |
| BCL11A-10990 | + | AGACGCGGCCCCGGGGGAGGG | 22 | 13032 |
| BCL11A-10991 | + | CAGACGCGGCCCCGGGGGAGGG | 23 | 13033 |
| BCL11A-10992 | + | CCAGACGCGGCCCCGGGGGAGGG | 24 | 13034 |
| BCL11A-10993 | + | CCCCGGGGGAGGGGCGGG | 18 | 13035 |
| BCL11A-10994 | + | CCCCCGGGGGAGGGGCGGG | 19 | 13036 |
| BCL11A-4817 | + | GCCCCCGGGGGAGGGGCGGG | 20 | 13037 |
| BCL11A-10995 | + | GGCCCCCGGGGGAGGGGCGGG | 21 | 13038 |
| BCL11A-10996 | + | CGGCCCCCGGGGGAGGGGCGGG | 22 | 13039 |
| BCL11A-10997 | + | GCGGCCCCCGGGGGAGGGGCGGG | 23 | 13040 |
| BCL11A-10998 | + | CGCGGCCCCCGGGGGAGGGGCGGG | 24 | 13041 |
| BCL11A-6504 | + | GACAUGGUGGGCUGCGGG | 18 | 13042 |
| BCL11A-6505 | + | AGACAUGGUGGGCUGCGGG | 19 | 13043 |

TABLE 19C-continued

3rd Tier

| gRNA Name | DNA Strand | Targeting Domain | Target Site Length | SEQ ID NO: |
|---|---|---|---|---|
| BCL11A-6506 | + | GAGACAUGGUGGGCUGCGGG | 20 | 13044 |
| BCL11A-6507 | + | CGAGACAUGGUGGGCUGCGGG | 21 | 13045 |
| BCL11A-6508 | + | GCGAGACAUGGUGGGCUGCGGG | 22 | 13046 |
| BCL11A-6509 | + | GGCGAGACAUGGUGGGCUGCGGG | 23 | 13047 |
| BCL11A-6510 | + | CGGCGAGACAUGGUGGGCUGCGGG | 24 | 13048 |
| BCL11A-10999 | + | GCCAAUGGCCAGUGCGGG | 18 | 13049 |
| BCL11A-11000 | + | AGCCAAUGGCCAGUGCGGG | 19 | 13050 |
| BCL11A-11001 | + | AAGCCAAUGGCCAGUGCGGG | 20 | 13051 |
| BCL11A-11002 | + | CAAGCCAAUGGCCAGUGCGGG | 21 | 13052 |
| BCL11A-11003 | + | ACAAGCCAAUGGCCAGUGCGGG | 22 | 13053 |
| BCL11A-11004 | + | GACAAGCCAAUGGCCAGUGCGGG | 23 | 13054 |
| BCL11A-11005 | + | GGACAAGCCAAUGGCCAGUGCGGG | 24 | 13055 |
| BCL11A-11006 | + | GGGAGGGGGAGGUGCGGG | 18 | 13056 |
| BCL11A-11007 | + | GGGGAGGGGGAGGUGCGGG | 19 | 13057 |
| BCL11A-11008 | + | CGGGGAGGGGGAGGUGCGGG | 20 | 13058 |
| BCL11A-11009 | + | GCGGGGAGGGGGAGGUGCGGG | 21 | 13059 |
| BCL11A-11010 | + | UGCGGGGAGGGGGAGGUGCGGG | 22 | 13060 |
| BCL11A-11011 | + | GUGCGGGGAGGGGGAGGUGCGGG | 23 | 13061 |
| BCL11A-11012 | + | AGUGCGGGGAGGGGGAGGUGCGGG | 24 | 13062 |
| BCL11A-11013 | + | CGAGCAGGAGAGAAGGGG | 18 | 13063 |
| BCL11A-11014 | + | GCGAGCAGGAGAGAAGGGG | 19 | 13064 |
| BCL11A-4476 | + | GGCGAGCAGGAGAGAAGGGG | 20 | 13065 |
| BCL11A-11015 | + | GGGCGAGCAGGAGAGAAGGGG | 21 | 13066 |
| BCL11A-11016 | + | AGGGCGAGCAGGAGAGAAGGGG | 22 | 13067 |
| BCL11A-11017 | + | CAGGGCGAGCAGGAGAGAAGGGG | 23 | 13068 |
| BCL11A-11018 | + | GCAGGGCGAGCAGGAGAGAAGGGG | 24 | 13069 |
| BCL11A-11019 | + | AGAAAGGGUGGCAGGGG | 18 | 13070 |
| BCL11A-11020 | + | AAGAAAGGGUGGCAGGGG | 19 | 13071 |
| BCL11A-9762 | + | GAAGAAAGGGUGGCAGGGG | 20 | 13072 |
| BCL11A-11021 | + | AGAAGAAAGGGUGGCAGGGG | 21 | 13073 |
| BCL11A-11022 | + | GAGAAGAAAGGGUGGCAGGGG | 22 | 13074 |
| BCL11A-11023 | + | AGAGAAGAAAGGGUGGCAGGGG | 23 | 13075 |
| BCL11A-11024 | + | GAGAGAAGAAAGGGUGGCAGGGG | 24 | 13076 |
| BCL11A-11025 | + | AUGGACACACAUCAGGGG | 18 | 13077 |
| BCL11A-11026 | + | AAUGGACACACAUCAGGGG | 19 | 13078 |
| BCL11A-11027 | + | CAAUGGACACACAUCAGGGG | 20 | 13079 |
| BCL11A-11028 | + | CCAAUGGACACACAUCAGGGG | 21 | 13080 |

TABLE 19C-continued

3rd Tier

| gRNA Name | DNA Strand | Targeting Domain | Target Site Length | SEQ ID NO: |
|---|---|---|---|---|
| BCL11A-11029 | + | ACCAAUGGACACACAUCAGGGG | 22 | 13081 |
| BCL11A-11030 | + | CACCAAUGGACACACAUCAGGGG | 23 | 13082 |
| BCL11A-11031 | + | ACACCAAUGGACACACAUCAGGGG | 24 | 13083 |
| BCL11A-11032 | + | GAGGGGCGGGCCGAGGGG | 18 | 13084 |
| BCL11A-11033 | + | GGAGGGGCGGGCCGAGGGG | 19 | 13085 |
| BCL11A-4486 | + | GGGAGGGGCGGGCCGAGGGG | 20 | 13086 |
| BCL11A-11034 | + | GGGGAGGGGCGGGCCGAGGGG | 21 | 13087 |
| BCL11A-11035 | + | GGGGGAGGGGCGGGCCGAGGGG | 22 | 13088 |
| BCL11A-11036 | + | CGGGGGAGGGGCGGGCCGAGGGG | 23 | 13089 |
| BCL11A-11037 | + | CCGGGGGAGGGGCGGGCCGAGGGG | 24 | 13090 |
| BCL11A-11038 | + | CAGACGCGGCCCCCGGGG | 18 | 13091 |
| BCL11A-11039 | + | CCAGACGCGGCCCCCGGGG | 19 | 13092 |
| BCL11A-4816 | + | GCCAGACGCGGCCCCCGGGG | 20 | 13093 |
| BCL11A-11040 | + | CGCCAGACGCGGCCCCCGGGG | 21 | 13094 |
| BCL11A-11041 | + | ACGCCAGACGCGGCCCCCGGGG | 22 | 13095 |
| BCL11A-11042 | + | GACGCCAGACGCGGCCCCCGGGG | 23 | 13096 |
| BCL11A-11043 | + | GGACGCCAGACGCGGCCCCCGGGG | 24 | 13097 |
| BCL11A-11044 | + | CCAAUGGCCAGUGCGGGG | 18 | 13098 |
| BCL11A-11045 | + | GCCAAUGGCCAGUGCGGGG | 19 | 13099 |
| BCL11A-9763 | + | AGCCAAUGGCCAGUGCGGGG | 20 | 13100 |
| BCL11A-11046 | + | AAGCCAAUGGCCAGUGCGGGG | 21 | 13101 |
| BCL11A-11047 | + | CAAGCCAAUGGCCAGUGCGGGG | 22 | 13102 |
| BCL11A-11048 | + | ACAAGCCAAUGGCCAGUGCGGGG | 23 | 13103 |
| BCL11A-11049 | + | GACAAGCCAAUGGCCAGUGCGGGG | 24 | 13104 |
| BCL11A-11050 | + | GGAGGGGGAGGUGCGGGG | 18 | 13105 |
| BCL11A-11051 | + | GGGAGGGGGAGGUGCGGGG | 19 | 13106 |
| BCL11A-9764 | + | GGGGAGGGGGAGGUGCGGGG | 20 | 13107 |
| BCL11A-11052 | + | CGGGGAGGGGGAGGUGCGGGG | 21 | 13108 |
| BCL11A-11053 | + | GCGGGGAGGGGGAGGUGCGGGG | 22 | 13109 |
| BCL11A-11054 | + | UGCGGGGAGGGGGAGGUGCGGGG | 23 | 13110 |
| BCL11A-11055 | + | GUGCGGGGAGGGGGAGGUGCGGGG | 24 | 13111 |
| BCL11A-11056 | + | AGACGCGGCCCCCGGGG | 18 | 13112 |
| BCL11A-11057 | + | CAGACGCGGCCCCCGGGGG | 19 | 13113 |
| BCL11A-4635 | + | CCAGACGCGGCCCCCGGGGG | 20 | 13114 |
| BCL11A-11058 | + | GCCAGACGCGGCCCCCGGGGG | 21 | 13115 |
| BCL11A-11059 | + | CGCCAGACGCGGCCCCCGGGGG | 22 | 13116 |
| BCL11A-11060 | + | ACGCCAGACGCGGCCCCCGGGGG | 23 | 13117 |
| BCL11A-11061 | + | GACGCCAGACGCGGCCCCCGGGGG | 24 | 13118 |

TABLE 19C-continued

3rd Tier

| gRNA Name | DNA Strand | Targeting Domain | Target Site Length | SEQ ID NO: |
|---|---|---|---|---|
| BCL11A-11062 | + | UGGGAGGAAAGGGUGGGG | 18 | 13119 |
| BCL11A-11063 | + | GUGGGAGGAAAGGGUGGGG | 19 | 13120 |
| BCL11A-9766 | + | GGUGGGAGGAAAGGGUGGGG | 20 | 13121 |
| BCL11A-11064 | + | GGGUGGGAGGAAAGGGUGGGG | 21 | 13122 |
| BCL11A-11065 | + | GGGGUGGGAGGAAAGGGUGGGG | 22 | 13123 |
| BCL11A-11066 | + | AGGGGUGGGAGGAAAGGGUGGGG | 23 | 13124 |
| BCL11A-11067 | + | CAGGGGUGGGAGGAAAGGGUGGGG | 24 | 13125 |
| BCL11A-11068 | + | AGACACACAAAACAUGGG | 18 | 13126 |
| BCL11A-11069 | + | GAGACACACAAAACAUGGG | 19 | 13127 |
| BCL11A-11070 | + | AGAGACACACAAAACAUGGG | 20 | 13128 |
| BCL11A-11071 | + | CAGAGACACACAAAACAUGGG | 21 | 13129 |
| BCL11A-11072 | + | ACAGAGACACACAAAACAUGGG | 22 | 13130 |
| BCL11A-11073 | + | GACAGAGACACACAAAACAUGGG | 23 | 13131 |
| BCL11A-11074 | + | GGACAGAGACACACAAAACAUGGG | 24 | 13132 |
| BCL11A-11075 | + | GCAAUGGUUCCAGAUGGG | 18 | 13133 |
| BCL11A-11076 | + | GGCAAUGGUUCCAGAUGGG | 19 | 13134 |
| BCL11A-11077 | + | CGGCAAUGGUUCCAGAUGGG | 20 | 13135 |
| BCL11A-11078 | + | ACGGCAAUGGUUCCAGAUGGG | 21 | 13136 |
| BCL11A-11079 | + | CACGGCAAUGGUUCCAGAUGGG | 22 | 13137 |
| BCL11A-11080 | + | ACACGGCAAUGGUUCCAGAUGGG | 23 | 13138 |
| BCL11A-11081 | + | UACACGGCAAUGGUUCCAGAUGGG | 24 | 13139 |
| BCL11A-11082 | + | GUGGGAGGAAAGGGUGGG | 18 | 13140 |
| BCL11A-11083 | + | GGUGGGAGGAAAGGGUGGG | 19 | 13141 |
| BCL11A-9767 | + | GGGUGGGAGGAAAGGGUGGG | 20 | 13142 |
| BCL11A-11084 | + | GGGGUGGGAGGAAAGGGUGGG | 21 | 13143 |
| BCL11A-11085 | + | AGGGGUGGGAGGAAAGGGUGGG | 22 | 13144 |
| BCL11A-11086 | + | CAGGGGUGGGAGGAAAGGGUGGG | 23 | 13145 |
| BCL11A-11087 | + | GCAGGGGUGGGAGGAAAGGGUGGG | 24 | 13146 |
| BCL11A-11088 | + | AGGGGUGGCAGGGGUGGG | 18 | 13147 |
| BCL11A-11089 | + | AAGGGGUGGCAGGGGUGGG | 19 | 13148 |
| BCL11A-9768 | + | AAAGGGGUGGCAGGGGUGGG | 20 | 13149 |
| BCL11A-11090 | + | GAAAGGGGUGGCAGGGGUGGG | 21 | 13150 |
| BCL11A-11091 | + | AGAAAGGGGUGGCAGGGGUGGG | 22 | 13151 |
| BCL11A-11092 | + | AAGAAAGGGGUGGCAGGGGUGGG | 23 | 13152 |
| BCL11A-11093 | + | GAAGAAAGGGGUGGCAGGGGUGGG | 24 | 13153 |
| BCL11A-11094 | + | UGAACGUCAGGAGUCUGG | 18 | 13154 |
| BCL11A-11095 | + | UUGAACGUCAGGAGUCUGG | 19 | 13155 |

TABLE 19C-continued

3rd Tier

| gRNA Name | DNA Strand | Targeting Domain | Target Site Length | SEQ ID NO: |
|---|---|---|---|---|
| BCL11A-11096 | + | CUUGAACGUCAGGAGUCUGG | 20 | 13156 |
| BCL11A-11097 | + | ACUUGAACGUCAGGAGUCUGG | 21 | 13157 |
| BCL11A-11098 | + | AACUUGAACGUCAGGAGUCUGG | 22 | 13158 |
| BCL11A-11099 | + | GAACUUGAACGUCAGGAGUCUGG | 23 | 13159 |
| BCL11A-11100 | + | CGAACUUGAACGUCAGGAGUCUGG | 24 | 13160 |
| BCL11A-11101 | + | GCCGCGGCGGUGGCGUGG | 18 | 13161 |
| BCL11A-11102 | + | CGCCGCGGCGGUGGCGUGG | 19 | 13162 |
| BCL11A-11103 | + | GCGCCGCGGCGGUGGCGUGG | 20 | 13163 |
| BCL11A-11104 | + | AGCGCCGCGGCGGUGGCGUGG | 21 | 13164 |
| BCL11A-11105 | + | GAGCGCCGCGGCGGUGGCGUGG | 22 | 13165 |
| BCL11A-11106 | + | CGAGCGCCGCGGCGGUGGCGUGG | 23 | 13166 |
| BCL11A-11107 | + | GCGAGCGCCGCGGCGGUGGCGUGG | 24 | 13167 |
| BCL11A-11108 | + | GGUGGGAGGAAAGGGUGG | 18 | 13168 |
| BCL11A-11109 | + | GGGUGGGAGGAAAGGGUGG | 19 | 13169 |
| BCL11A-9770 | + | GGGGUGGGAGGAAAGGGUGG | 20 | 13170 |
| BCL11A-11110 | + | AGGGGUGGGAGGAAAGGGUGG | 21 | 13171 |
| BCL11A-11111 | + | CAGGGGUGGGAGGAAAGGGUGG | 22 | 13172 |
| BCL11A-11112 | + | GCAGGGGUGGGAGGAAAGGGUGG | 23 | 13173 |
| BCL11A-11113 | + | GGCAGGGGUGGGAGGAAAGGGUGG | 24 | 13174 |
| BCL11A-11114 | + | GAGAGAAGAAAGGGUGG | 18 | 13175 |
| BCL11A-11115 | + | GGAGAGAAGAAAGGGUGG | 19 | 13176 |
| BCL11A-11116 | + | GGGAGAGAAGAAAGGGUGG | 20 | 13177 |
| BCL11A-11117 | + | CGGGAGAGAAGAAAGGGUGG | 21 | 13178 |
| BCL11A-11118 | + | CCGGGAGAGAAGAAAGGGUGG | 22 | 13179 |
| BCL11A-11119 | + | GCCGGGAGAGAAGAAAGGGUGG | 23 | 13180 |
| BCL11A-11120 | + | GGCCGGGAGAGAAGAAAGGGUGG | 24 | 13181 |
| BCL11A-11121 | + | AAGGGGUGGCAGGGGUGG | 18 | 13182 |
| BCL11A-11122 | + | AAAGGGGUGGCAGGGGUGG | 19 | 13183 |
| BCL11A-11123 | + | GAAAGGGGUGGCAGGGGUGG | 20 | 13184 |
| BCL11A-11124 | + | AGAAAGGGGUGGCAGGGGUGG | 21 | 13185 |
| BCL11A-11125 | + | AAGAAAGGGGUGGCAGGGGUGG | 22 | 13186 |
| BCL11A-11126 | + | GAAGAAAGGGGUGGCAGGGGUGG | 23 | 13187 |
| BCL11A-11127 | + | AGAAGAAAGGGGUGGCAGGGGUGG | 24 | 13188 |
| BCL11A-11128 | + | AGGGAAGAUGAAUUGUGG | 18 | 13189 |
| BCL11A-11129 | + | CAGGGAAGAUGAAUUGUGG | 19 | 13190 |
| BCL11A-11130 | + | GCAGGGAAGAUGAAUUGUGG | 20 | 13191 |
| BCL11A-11131 | + | CGCAGGGAAGAUGAAUUGUGG | 21 | 13192 |
| BCL11A-11132 | + | GCGCAGGGAAGAUGAAUUGUGG | 22 | 13193 |

TABLE 19C-continued

3rd Tier

| gRNA Name | DNA Strand | Targeting Domain | Target Site Length | SEQ ID NO: |
|---|---|---|---|---|
| BCL11A-11133 | + | GGCGCAGGGAAGAUGAAUUGUGG | 23 | 13194 |
| BCL11A-11134 | + | UGGCGCAGGGAAGAUGAAUUGUGG | 24 | 13195 |
| BCL11A-6524 | + | UGCUUGCGGCGAGACAUG | 18 | 13196 |
| BCL11A-6525 | + | UUGCUUGCGGCGAGACAUG | 19 | 13197 |
| BCL11A-6526 | + | CUUGCUUGCGGCGAGACAUG | 20 | 13198 |
| BCL11A-6527 | + | CCUUGCUUGCGGCGAGACAUG | 21 | 13199 |
| BCL11A-6528 | + | GCCUUGCUUGCGGCGAGACAUG | 22 | 13200 |
| BCL11A-6529 | + | UGCCUUGCUUGCGGCGAGACAUG | 23 | 13201 |
| BCL11A-6530 | + | UUGCCUUGCUUGCGGCGAGACAUG | 24 | 13202 |
| BCL11A-6544 | + | GCGAGACAUGGUGGGCUG | 18 | 13203 |
| BCL11A-6545 | + | GGCGAGACAUGGUGGGCUG | 19 | 13204 |
| BCL11A-5361 | + | CGGCGAGACAUGGUGGGCUG | 20 | 13205 |
| BCL11A-6546 | + | GCGGCGAGACAUGGUGGGCUG | 21 | 13206 |
| BCL11A-6547 | + | UGCGGCGAGACAUGGUGGGCUG | 22 | 13207 |
| BCL11A-6548 | + | UUGCGGCGAGACAUGGUGGGCUG | 23 | 13208 |
| BCL11A-6549 | + | CUUGCGGCGAGACAUGGUGGGCUG | 24 | 13209 |
| BCL11A-6550 | + | UUCCCGUUUGCUUAAGUG | 18 | 13210 |
| BCL11A-6551 | + | AUUCCCGUUUGCUUAAGUG | 19 | 13211 |
| BCL11A-6552 | + | AAUUCCCGUUUGCUUAAGUG | 20 | 13212 |
| BCL11A-6553 | + | GAAUUCCCGUUUGCUUAAGUG | 21 | 13213 |
| BCL11A-6554 | + | AGAAUUCCCGUUUGCUUAAGUG | 22 | 13214 |
| BCL11A-6555 | + | GAGAAUUCCCGUUUGCUUAAGUG | 23 | 13215 |
| BCL11A-6556 | + | CGAGAAUUCCCGUUUGCUUAAGUG | 24 | 13216 |
| BCL11A-11135 | + | ACAAGCCAAUGGCCAGUG | 18 | 13217 |
| BCL11A-11136 | + | GACAAGCCAAUGGCCAGUG | 19 | 13218 |
| BCL11A-9773 | + | GGACAAGCCAAUGGCCAGUG | 20 | 13219 |
| BCL11A-11137 | + | AGGACAAGCCAAUGGCCAGUG | 21 | 13220 |
| BCL11A-11138 | + | CAGGACAAGCCAAUGGCCAGUG | 22 | 13221 |
| BCL11A-11139 | + | CCAGGACAAGCCAAUGGCCAGUG | 23 | 13222 |
| BCL11A-11140 | + | ACCAGGACAAGCCAAUGGCCAGUG | 24 | 13223 |
| BCL11A-11141 | + | UGCGGGGAGGGGAGGUG | 18 | 13224 |
| BCL11A-11142 | + | GUGCGGGGAGGGGAGGUG | 19 | 13225 |
| BCL11A-9774 | + | AGUGCGGGGAGGGGAGGUG | 20 | 13226 |
| BCL11A-11143 | + | CAGUGCGGGGAGGGGAGGUG | 21 | 13227 |
| BCL11A-11144 | + | CCAGUGCGGGGAGGGGAGGUG | 22 | 13228 |
| BCL11A-11145 | + | GCCAGUGCGGGGAGGGGAGGUG | 23 | 13229 |
| BCL11A-11146 | + | GGCCAGUGCGGGGAGGGGAGGUG | 24 | 13230 |

TABLE 19C-continued

3rd Tier

| gRNA Name | DNA Strand | Targeting Domain | Target Site Length | SEQ ID NO: |
|---|---|---|---|---|
| BCL11A-11147 | + | GGGUGGGAGGAAAGGGUG | 18 | 13231 |
| BCL11A-11148 | + | GGGGUGGGAGGAAAGGGUG | 19 | 13232 |
| BCL11A-9775 | + | AGGGGUGGGAGGAAAGGGUG | 20 | 13233 |
| BCL11A-11149 | + | CAGGGGUGGGAGGAAAGGGUG | 21 | 13234 |
| BCL11A-11150 | + | GCAGGGGUGGGAGGAAAGGGUG | 22 | 13235 |
| BCL11A-11151 | + | GGCAGGGGUGGGAGGAAAGGGUG | 23 | 13236 |
| BCL11A-11152 | + | UGGCAGGGGUGGGAGGAAAGGGUG | 24 | 13237 |
| BCL11A-11153 | + | CGCAGGGAAGAUGAAUUG | 18 | 13238 |
| BCL11A-11154 | + | GCGCAGGGAAGAUGAAUUG | 19 | 13239 |
| BCL11A-9777 | + | GGCGCAGGGAAGAUGAAUUG | 20 | 13240 |
| BCL11A-11155 | + | UGGCGCAGGGAAGAUGAAUUG | 21 | 13241 |
| BCL11A-11156 | + | AUGGCGCAGGGAAGAUGAAUUG | 22 | 13242 |
| BCL11A-11157 | + | GAUGGCGCAGGGAAGAUGAAUUG | 23 | 13243 |
| BCL11A-11158 | + | AGAUGGCGCAGGGAAGAUGAAUUG | 24 | 13244 |
| BCL11A-11159 | + | UUGACAUCCAAAAUAAAU | 18 | 13245 |
| BCL11A-11160 | + | UUUGACAUCCAAAAUAAAU | 19 | 13246 |
| BCL11A-11161 | + | UUUUGACAUCCAAAAUAAAU | 20 | 13247 |
| BCL11A-11162 | + | CUUUUGACAUCCAAAAUAAAU | 21 | 13248 |
| BCL11A-11163 | + | CCUUUUGACAUCCAAAAUAAAU | 22 | 13249 |
| BCL11A-11164 | + | GCCUUUUGACAUCCAAAAUAAAU | 23 | 13250 |
| BCL11A-11165 | + | UGCCUUUUGACAUCCAAAAUAAAU | 24 | 13251 |
| BCL11A-11166 | + | ACACCAAUGGACACACAU | 18 | 13252 |
| BCL11A-11167 | + | CACACCAAUGGACACACAU | 19 | 13253 |
| BCL11A-11168 | + | UCACACCAAUGGACACACAU | 20 | 13254 |
| BCL11A-11169 | + | CUCACACCAAUGGACACACAU | 21 | 13255 |
| BCL11A-11170 | + | GCUCACACCAAUGGACACACAU | 22 | 13256 |
| BCL11A-11171 | + | AGCUCACACCAAUGGACACACAU | 23 | 13257 |
| BCL11A-11172 | + | AAGCUCACACCAAUGGACACACAU | 24 | 13258 |
| BCL11A-11173 | + | CGACGGCUCGGUUCACAU | 18 | 13259 |
| BCL11A-11174 | + | ACGACGGCUCGGUUCACAU | 19 | 13260 |
| BCL11A-9582 | + | GACGACGGCUCGGUUCACAU | 20 | 13261 |
| BCL11A-11175 | + | GGACGACGGCUCGGUUCACAU | 21 | 13262 |
| BCL11A-11176 | + | CGGACGACGGCUCGGUUCACAU | 22 | 13263 |
| BCL11A-11177 | + | GCGGACGACGGCUCGGUUCACAU | 23 | 13264 |
| BCL11A-11178 | + | GGCGGACGACGGCUCGGUUCACAU | 24 | 13265 |
| BCL11A-11179 | + | UGCGGACGUGACGUCCCU | 18 | 13266 |
| BCL11A-11180 | + | GUGCGGACGUGACGUCCCU | 19 | 13267 |
| BCL11A-11181 | + | AGUGCGGACGUGACGUCCCU | 20 | 13268 |

TABLE 19C-continued

3rd Tier

| gRNA Name | DNA Strand | Targeting Domain | Target Site Length | SEQ ID NO: |
|---|---|---|---|---|
| BCL11A-11182 | + | AAGUGCGGACGUGACGUCCCU | 21 | 13269 |
| BCL11A-11183 | + | CAAGUGCGGACGUGACGUCCCU | 22 | 13270 |
| BCL11A-11184 | + | UCAAGUGCGGACGUGACGUCCCU | 23 | 13271 |
| BCL11A-11185 | + | UUCAAGUGCGGACGUGACGUCCCU | 24 | 13272 |
| BCL11A-6618 | + | GGCGAGACAUGGUGGGCU | 18 | 13273 |
| BCL11A-6619 | + | CGGCGAGACAUGGUGGGCU | 19 | 13274 |
| BCL11A-6620 | + | GCGGCGAGACAUGGUGGGCU | 20 | 13275 |
| BCL11A-6621 | + | UGCGGCGAGACAUGGUGGGCU | 21 | 13276 |
| BCL11A-6622 | + | UUGCGGCGAGACAUGGUGGGCU | 22 | 13277 |
| BCL11A-6623 | + | CUUGCGGCGAGACAUGGUGGGCU | 23 | 13278 |
| BCL11A-6624 | + | GCUUGCGGCGAGACAUGGUGGGCU | 24 | 13279 |
| BCL11A-11186 | + | CUCUUUUACCUCGACUCU | 18 | 13280 |
| BCL11A-11187 | + | UCUCUUUUACCUCGACUCU | 19 | 13281 |
| BCL11A-9585 | + | AUCUCUUUUACCUCGACUCU | 20 | 13282 |
| BCL11A-11188 | + | UAUCUCUUUUACCUCGACUCU | 21 | 13283 |
| BCL11A-11189 | + | UUAUCUCUUUUACCUCGACUCU | 22 | 13284 |
| BCL11A-11190 | + | UUUAUCUCUUUUACCUCGACUCU | 23 | 13285 |
| BCL11A-11191 | + | CUUUAUCUCUUUUACCUCGACUCU | 24 | 13286 |
| BCL11A-11192 | + | UGAGCUGCAAGUUCAAGU | 18 | 13287 |
| BCL11A-11193 | + | CUGAGCUGCAAGUUCAAGU | 19 | 13288 |
| BCL11A-11194 | + | CCUGAGCUGCAAGUUCAAGU | 20 | 13289 |
| BCL11A-11195 | + | CCCUGAGCUGCAAGUUCAAGU | 21 | 13290 |
| BCL11A-11196 | + | CCCCUGAGCUGCAAGUUCAAGU | 22 | 13291 |
| BCL11A-11197 | + | CCCCCUGAGCUGCAAGUUCAAGU | 23 | 13292 |
| BCL11A-11198 | + | CCCCCCUGAGCUGCAAGUUCAAGU | 24 | 13293 |
| BCL11A-11199 | + | GACAAGCCAAUGGCCAGU | 18 | 13294 |
| BCL11A-11200 | + | GGACAAGCCAAUGGCCAGU | 19 | 13295 |
| BCL11A-11201 | + | AGGACAAGCCAAUGGCCAGU | 20 | 13296 |
| BCL11A-11202 | + | CAGGACAAGCCAAUGGCCAGU | 21 | 13297 |
| BCL11A-11203 | + | CCAGGACAAGCCAAUGGCCAGU | 22 | 13298 |
| BCL11A-11204 | + | ACCAGGACAAGCCAAUGGCCAGU | 23 | 13299 |
| BCL11A-11205 | + | GACCAGGACAAGCCAAUGGCCAGU | 24 | 13300 |
| BCL11A-11206 | + | CCCUGCGAACUUGAACGU | 18 | 13301 |
| BCL11A-11207 | + | UCCCUGCGAACUUGAACGU | 19 | 13302 |
| BCL11A-11208 | + | GUCCCUGCGAACUUGAACGU | 20 | 13303 |
| BCL11A-11209 | + | CGUCCCUGCGAACUUGAACGU | 21 | 13304 |
| BCL11A-11210 | + | ACGUCCCUGCGAACUUGAACGU | 22 | 13305 |

TABLE 19C-continued

| | | 3rd Tier | | |
|---|---|---|---|---|
| gRNA Name | DNA Strand | Targeting Domain | Target Site Length | SEQ ID NO: |
| BCL11A-11211 | + | GACGUCCCUGCGAACUUGAACGU | 23 | 13306 |
| BCL11A-11212 | + | UGACGUCCCUGCGAACUUGAACGU | 24 | 13307 |
| BCL11A-11213 | + | GUGCGGGGAGGGGAGGU | 18 | 13308 |
| BCL11A-11214 | + | AGUGCGGGGAGGGGAGGU | 19 | 13309 |
| BCL11A-11215 | + | CAGUGCGGGGAGGGGAGGU | 20 | 13310 |
| BCL11A-11216 | + | CCAGUGCGGGGAGGGGAGGU | 21 | 13311 |
| BCL11A-11217 | + | GCCAGUGCGGGGAGGGGAGGU | 22 | 13312 |
| BCL11A-11218 | + | GGCCAGUGCGGGGAGGGGAGGU | 23 | 13313 |
| BCL11A-11219 | + | UGGCCAGUGCGGGGAGGGGAGGU | 24 | 13314 |
| BCL11A-11220 | + | GGGGUGGGAGGAAAGGGU | 18 | 13315 |
| BCL11A-11221 | + | AGGGGUGGGAGGAAAGGGU | 19 | 13316 |
| BCL11A-9784 | + | CAGGGGUGGGAGGAAAGGGU | 20 | 13317 |
| BCL11A-11222 | + | GCAGGGGUGGGAGGAAAGGGU | 21 | 13318 |
| BCL11A-11223 | + | GGCAGGGGUGGGAGGAAAGGGU | 22 | 13319 |
| BCL11A-11224 | + | UGGCAGGGGUGGGAGGAAAGGGU | 23 | 13320 |
| BCL11A-11225 | + | GUGGCAGGGGUGGGAGGAAAGGGU | 24 | 13321 |
| BCL11A-11226 | + | ACAUCGGGAGAGCCGGGU | 18 | 13322 |
| BCL11A-11227 | + | CACAUCGGGAGAGCCGGGU | 19 | 13323 |
| BCL11A-11228 | + | UCACAUCGGGAGAGCCGGGU | 20 | 13324 |
| BCL11A-11229 | + | UUCACAUCGGGAGAGCCGGGU | 21 | 13325 |
| BCL11A-11230 | + | GUUCACAUCGGGAGAGCCGGGU | 22 | 13326 |
| BCL11A-11231 | + | GGUUCACAUCGGGAGAGCCGGGU | 23 | 13327 |
| BCL11A-11232 | + | CGGUUCACAUCGGGAGAGCCGGGU | 24 | 13328 |
| BCL11A-11233 | + | GAAAGGGGUGGCAGGGGU | 18 | 13329 |
| BCL11A-11234 | + | AGAAAGGGGUGGCAGGGGU | 19 | 13330 |
| BCL11A-9785 | + | AAGAAAGGGGUGGCAGGGGU | 20 | 13331 |
| BCL11A-11235 | + | GAAGAAAGGGGUGGCAGGGGU | 21 | 13332 |
| BCL11A-11236 | + | AGAAGAAAGGGGUGGCAGGGGU | 22 | 13333 |
| BCL11A-11237 | + | GAGAAGAAAGGGGUGGCAGGGGU | 23 | 13334 |
| BCL11A-11238 | + | AGAGAAGAAAGGGGUGGCAGGGGU | 24 | 13335 |
| BCL11A-11239 | + | GCAGGGAAGAUGAAUUGU | 18 | 13336 |
| BCL11A-11240 | + | CGCAGGGAAGAUGAAUUGU | 19 | 13337 |
| BCL11A-9786 | + | GCGCAGGGAAGAUGAAUUGU | 20 | 13338 |
| BCL11A-11241 | + | GGCGCAGGGAAGAUGAAUUGU | 21 | 13339 |
| BCL11A-11242 | + | UGGCGCAGGGAAGAUGAAUUGU | 22 | 13340 |
| BCL11A-11243 | + | AUGGCGCAGGGAAGAUGAAUUGU | 23 | 13341 |
| BCL11A-11244 | + | GAUGGCGCAGGGAAGAUGAAUUGU | 24 | 13342 |
| BCL11A-11245 | + | GCGCAGGGAAGAUGAAUU | 18 | 13343 |

TABLE 19C-continued

3rd Tier

| gRNA Name | DNA Strand | Targeting Domain | Target Site Length | SEQ ID NO: |
|---|---|---|---|---|
| BCL11A-11246 | + | GGCGCAGGGAAGAUGAAUU | 19 | 13344 |
| BCL11A-11247 | + | UGGCGCAGGGAAGAUGAAUU | 20 | 13345 |
| BCL11A-11248 | + | AUGGCGCAGGGAAGAUGAAUU | 21 | 13346 |
| BCL11A-11249 | + | GAUGGCGCAGGGAAGAUGAAUU | 22 | 13347 |
| BCL11A-11250 | + | AGAUGGCGCAGGGAAGAUGAAUU | 23 | 13348 |
| BCL11A-11251 | + | AAGAUGGCGCAGGGAAGAUGAAUU | 24 | 13349 |
| BCL11A-11252 | – | GCAGGACUAGAAGCAAAA | 18 | 13350 |
| BCL11A-11253 | – | CGCAGGACUAGAAGCAAAA | 19 | 13351 |
| BCL11A-11254 | – | GCGCAGGACUAGAAGCAAAA | 20 | 13352 |
| BCL11A-11255 | – | CGCGCAGGACUAGAAGCAAAA | 21 | 13353 |
| BCL11A-11256 | – | GCGCGCAGGACUAGAAGCAAAA | 22 | 13354 |
| BCL11A-11257 | – | AGCGCGCAGGACUAGAAGCAAAA | 23 | 13355 |
| BCL11A-11258 | – | GAGCGCGCAGGACUAGAAGCAAAA | 24 | 13356 |
| BCL11A-6678 | – | CCCCAGCACUUAAGCAAA | 18 | 13357 |
| BCL11A-6679 | – | ACCCCAGCACUUAAGCAAA | 19 | 13358 |
| BCL11A-5443 | – | AACCCCAGCACUUAAGCAAA | 20 | 13359 |
| BCL11A-6680 | – | AAACCCCAGCACUUAAGCAAA | 21 | 13360 |
| BCL11A-6681 | – | CAAACCCCAGCACUUAAGCAAA | 22 | 13361 |
| BCL11A-6682 | – | GCAAACCCCAGCACUUAAGCAAA | 23 | 13362 |
| BCL11A-6683 | – | GGCAAACCCCAGCACUUAAGCAAA | 24 | 13363 |
| BCL11A-11259 | – | CGAGGUAAAAGAGAUAAA | 18 | 13364 |
| BCL11A-11260 | – | UCGAGGUAAAAGAGAUAAA | 19 | 13365 |
| BCL11A-9693 | – | GUCGAGGUAAAAGAGAUAAA | 20 | 13366 |
| BCL11A-11261 | – | AGUCGAGGUAAAAGAGAUAAA | 21 | 13367 |
| BCL11A-11262 | – | GAGUCGAGGUAAAAGAGAUAAA | 22 | 13368 |
| BCL11A-11263 | – | AGAGUCGAGGUAAAAGAGAUAAA | 23 | 13369 |
| BCL11A-11264 | – | GAGAGUCGAGGUAAAAGAGAUAAA | 24 | 13370 |
| BCL11A-6698 | – | ACCCCAGCACUUAAGCAA | 18 | 13371 |
| BCL11A-6699 | – | AACCCCAGCACUUAAGCAA | 19 | 13372 |
| BCL11A-6700 | – | AAACCCCAGCACUUAAGCAA | 20 | 13373 |
| BCL11A-6701 | – | CAAACCCCAGCACUUAAGCAA | 21 | 13374 |
| BCL11A-6702 | – | GCAAACCCCAGCACUUAAGCAA | 22 | 13375 |
| BCL11A-6703 | – | GGCAAACCCCAGCACUUAAGCAA | 23 | 13376 |
| BCL11A-6704 | – | AGGCAAACCCCAGCACUUAAGCAA | 24 | 13377 |
| BCL11A-11265 | – | CGGCUCUCCCGAUGUGAA | 18 | 13378 |
| BCL11A-11266 | – | CCGGCUCUCCCGAUGUGAA | 19 | 13379 |
| BCL11A-11267 | – | CCCGGCUCUCCCGAUGUGAA | 20 | 13380 |

TABLE 19C-continued

3rd Tier

| gRNA Name | DNA Strand | Targeting Domain | Target Site Length | SEQ ID NO: |
|---|---|---|---|---|
| BCL11A-11268 | - | ACCCGGCUCUCCCGAUGUGAA | 21 | 13381 |
| BCL11A-11269 | - | AACCCGGCUCUCCCGAUGUGAA | 22 | 13382 |
| BCL11A-11270 | - | UAACCCGGCUCUCCCGAUGUGAA | 23 | 13383 |
| BCL11A-11271 | - | CUAACCCGGCUCUCCCGAUGUGAA | 24 | 13384 |
| BCL11A-11272 | - | UCGAGGUAAAAGAGAUAA | 18 | 13385 |
| BCL11A-11273 | - | GUCGAGGUAAAAGAGAUAA | 19 | 13386 |
| BCL11A-9699 | - | AGUCGAGGUAAAAGAGAUAA | 20 | 13387 |
| BCL11A-11274 | - | GAGUCGAGGUAAAAGAGAUAA | 21 | 13388 |
| BCL11A-11275 | - | AGAGUCGAGGUAAAAGAGAUAA | 22 | 13389 |
| BCL11A-11276 | - | GAGAGUCGAGGUAAAAGAGAUAA | 23 | 13390 |
| BCL11A-11277 | - | CGAGAGUCGAGGUAAAAGAGAUAA | 24 | 13391 |
| BCL11A-11278 | - | CUCCGAGAGUCGAGGUAA | 18 | 13392 |
| BCL11A-11279 | - | CCUCCGAGAGUCGAGGUAA | 19 | 13393 |
| BCL11A-11280 | - | ACCUCCGAGAGUCGAGGUAA | 20 | 13394 |
| BCL11A-11281 | - | AACCUCCGAGAGUCGAGGUAA | 21 | 13395 |
| BCL11A-11282 | - | AAACCUCCGAGAGUCGAGGUAA | 22 | 13396 |
| BCL11A-11283 | - | AAAACCUCCGAGAGUCGAGGUAA | 23 | 13397 |
| BCL11A-11284 | - | AAAAACCUCCGAGAGUCGAGGUAA | 24 | 13398 |
| BCL11A-11285 | - | ACUUGAACUUGCAGCUCA | 18 | 13399 |
| BCL11A-11286 | - | CACUUGAACUUGCAGCUCA | 19 | 13400 |
| BCL11A-9705 | - | GCACUUGAACUUGCAGCUCA | 20 | 13401 |
| BCL11A-11287 | - | CGCACUUGAACUUGCAGCUCA | 21 | 13402 |
| BCL11A-11288 | - | CCGCACUUGAACUUGCAGCUCA | 22 | 13403 |
| BCL11A-11289 | - | UCCGCACUUGAACUUGCAGCUCA | 23 | 13404 |
| BCL11A-11290 | - | GUCCGCACUUGAACUUGCAGCUCA | 24 | 13405 |
| BCL11A-11291 | - | GCAAAAGCGAGGGGAGA | 18 | 13406 |
| BCL11A-11292 | - | AGCAAAAGCGAGGGGAGA | 19 | 13407 |
| BCL11A-4934 | - | AAGCAAAAGCGAGGGGAGA | 20 | 13408 |
| BCL11A-11293 | - | GAAGCAAAAGCGAGGGGAGA | 21 | 13409 |
| BCL11A-11294 | - | AGAAGCAAAAGCGAGGGGAGA | 22 | 13410 |
| BCL11A-11295 | - | UAGAAGCAAAAGCGAGGGGAGA | 23 | 13411 |
| BCL11A-11296 | - | CUAGAAGCAAAAGCGAGGGGAGA | 24 | 13412 |
| BCL11A-11297 | - | GACUAGAAGCAAAAGCGA | 18 | 13413 |
| BCL11A-11298 | - | GGACUAGAAGCAAAAGCGA | 19 | 13414 |
| BCL11A-9710 | - | AGGACUAGAAGCAAAAGCGA | 20 | 13415 |
| BCL11A-11299 | - | CAGGACUAGAAGCAAAAGCGA | 21 | 13416 |
| BCL11A-11300 | - | GCAGGACUAGAAGCAAAAGCGA | 22 | 13417 |
| BCL11A-11301 | - | CGCAGGACUAGAAGCAAAAGCGA | 23 | 13418 |

TABLE 19C-continued

3rd Tier

| gRNA Name | DNA Strand | Targeting Domain | Target Site Length | SEQ ID NO: |
|---|---|---|---|---|
| BCL11A-11302 | - | GCGCAGGACUAGAAGCAAAAGCGA | 24 | 13419 |
| BCL11A-11303 | - | AAGCAAAAGCGAGGGGGA | 18 | 13420 |
| BCL11A-11304 | - | GAAGCAAAAGCGAGGGGGA | 19 | 13421 |
| BCL11A-4972 | - | AGAAGCAAAAGCGAGGGGGA | 20 | 13422 |
| BCL11A-11305 | - | UAGAAGCAAAAGCGAGGGGGA | 21 | 13423 |
| BCL11A-11306 | - | CUAGAAGCAAAAGCGAGGGGGA | 22 | 13424 |
| BCL11A-11307 | - | ACUAGAAGCAAAAGCGAGGGGGA | 23 | 13425 |
| BCL11A-11308 | - | GACUAGAAGCAAAAGCGAGGGGGA | 24 | 13426 |
| BCL11A-11309 | - | GUCGAGGUAAAAGAGAUA | 18 | 13427 |
| BCL11A-11310 | - | AGUCGAGGUAAAAGAGAUA | 19 | 13428 |
| BCL11A-11311 | - | GAGUCGAGGUAAAAGAGAUA | 20 | 13429 |
| BCL11A-11312 | - | AGAGUCGAGGUAAAAGAGAUA | 21 | 13430 |
| BCL11A-11313 | - | GAGAGUCGAGGUAAAAGAGAUA | 22 | 13431 |
| BCL11A-11314 | - | CGAGAGUCGAGGUAAAAGAGAUA | 23 | 13432 |
| BCL11A-11315 | - | CCGAGAGUCGAGGUAAAAGAGAUA | 24 | 13433 |
| BCL11A-11316 | - | GGGACGUCACGUCCGCAC | 18 | 13434 |
| BCL11A-11317 | - | AGGGACGUCACGUCCGCAC | 19 | 13435 |
| BCL11A-11318 | - | CAGGGACGUCACGUCCGCAC | 20 | 13436 |
| BCL11A-11319 | - | GCAGGGACGUCACGUCCGCAC | 21 | 13437 |
| BCL11A-11320 | - | CGCAGGGACGUCACGUCCGCAC | 22 | 13438 |
| BCL11A-11321 | - | UCGCAGGGACGUCACGUCCGCAC | 23 | 13439 |
| BCL11A-11322 | - | UUCGCAGGGACGUCACGUCCGCAC | 24 | 13440 |
| BCL11A-11323 | - | AUAAUUAUUAAUAAUCAC | 18 | 13441 |
| BCL11A-11324 | - | AAUAAUUAUUAAUAAUCAC | 19 | 13442 |
| BCL11A-11325 | - | UAAUAAUUAUUAAUAAUCAC | 20 | 13443 |
| BCL11A-11326 | - | AUAAUAAUUAUUAAUAAUCAC | 21 | 13444 |
| BCL11A-11327 | - | AAUAAUAAUUAUUAAUAAUCAC | 22 | 13445 |
| BCL11A-11328 | - | UAAUAAUAAUUAUUAAUAAUCAC | 23 | 13446 |
| BCL11A-11329 | - | GUAAUAAUAAUUAUUAAUAAUCAC | 24 | 13447 |
| BCL11A-11330 | - | CAUUUUUAAAUUUUUCAC | 18 | 13448 |
| BCL11A-11331 | - | GCAUUUUUAAAUUUUUCAC | 19 | 13449 |
| BCL11A-11332 | - | UGCAUUUUUAAAUUUUUCAC | 20 | 13450 |
| BCL11A-11333 | - | AUGCAUUUUUAAAUUUUUCAC | 21 | 13451 |
| BCL11A-11334 | - | CAUGCAUUUUUAAAUUUUUCAC | 22 | 13452 |
| BCL11A-11335 | - | GCAUGCAUUUUUAAAUUUUUCAC | 23 | 13453 |
| BCL11A-11336 | - | UGCAUGCAUUUUUAAAUUUUUCAC | 24 | 13454 |
| BCL11A-11337 | - | CACGAGAGCGCGCAGGAC | 18 | 13455 |

TABLE 19C-continued

3rd Tier

| gRNA Name | DNA Strand | Targeting Domain | Target Site Length | SEQ ID NO: |
|---|---|---|---|---|
| BCL11A-11338 | − | UCACGAGAGCGCGCAGGAC | 19 | 13456 |
| BCL11A-11339 | − | AUCACGAGAGCGCGCAGGAC | 20 | 13457 |
| BCL11A-11340 | − | AAUCACGAGAGCGCGCAGGAC | 21 | 13458 |
| BCL11A-11341 | − | UAAUCACGAGAGCGCGCAGGAC | 22 | 13459 |
| BCL11A-11342 | − | AUAAUCACGAGAGCGCGCAGGAC | 23 | 13460 |
| BCL11A-11343 | − | AAUAAUCACGAGAGCGCGCAGGAC | 24 | 13461 |
| BCL11A-11344 | − | UCGGCCCGCCCCUCCCCC | 18 | 13462 |
| BCL11A-11345 | − | CUCGGCCCGCCCCUCCCCC | 19 | 13463 |
| BCL11A-9716 | − | CCUCGGCCCGCCCCUCCCCC | 20 | 13464 |
| BCL11A-11346 | − | CCCUCGGCCCGCCCCUCCCCC | 21 | 13465 |
| BCL11A-11347 | − | CCCCUCGGCCCGCCCCUCCCCC | 22 | 13466 |
| BCL11A-11348 | − | UCCCCUCGGCCCGCCCCUCCCCC | 23 | 13467 |
| BCL11A-11349 | − | CUCCCCUCGGCCCGCCCCUCCCCC | 24 | 13468 |
| BCL11A-11350 | − | CUCGGCCCGCCCCUCCCC | 18 | 13469 |
| BCL11A-11351 | − | CCUCGGCCCGCCCCUCCCC | 19 | 13470 |
| BCL11A-9717 | − | CCCUCGGCCCGCCCCUCCCC | 20 | 13471 |
| BCL11A-11352 | − | CCCCUCGGCCCGCCCCUCCCC | 21 | 13472 |
| BCL11A-11353 | − | UCCCCUCGGCCCGCCCCUCCCC | 22 | 13473 |
| BCL11A-11354 | − | CUCCCCUCGGCCCGCCCCUCCCC | 23 | 13474 |
| BCL11A-11355 | − | CCUCCCCUCGGCCCGCCCCUCCCC | 24 | 13475 |
| BCL11A-11356 | − | CCUCGGCCCGCCCCUCCC | 18 | 13476 |
| BCL11A-11357 | − | CCCUCGGCCCGCCCCUCCC | 19 | 13477 |
| BCL11A-11358 | − | CCCCUCGGCCCGCCCCUCCC | 20 | 13478 |
| BCL11A-11359 | − | UCCCCUCGGCCCGCCCCUCCC | 21 | 13479 |
| BCL11A-11360 | − | CUCCCCUCGGCCCGCCCCUCCC | 22 | 13480 |
| BCL11A-11361 | − | CCUCCCCUCGGCCCGCCCCUCCC | 23 | 13481 |
| BCL11A-11362 | − | CCCUCCCCUCGGCCCGCCCCUCCC | 24 | 13482 |
| BCL11A-11363 | − | GGGCCGCGUCUGGCGUCC | 18 | 13483 |
| BCL11A-11364 | − | GGGGCCGCGUCUGGCGUCC | 19 | 13484 |
| BCL11A-11365 | − | GGGGGCCGCGUCUGGCGUCC | 20 | 13485 |
| BCL11A-11366 | − | CGGGGGCCGCGUCUGGCGUCC | 21 | 13486 |
| BCL11A-11367 | − | CCGGGGGCCGCGUCUGGCGUCC | 22 | 13487 |
| BCL11A-11368 | − | CCCGGGGGCCGCGUCUGGCGUCC | 23 | 13488 |
| BCL11A-11369 | − | CCCCGGGGGCCGCGUCUGGCGUCC | 24 | 13489 |
| BCL11A-11370 | − | AGGACUAGAAGCAAAAGC | 18 | 13490 |
| BCL11A-11371 | − | CAGGACUAGAAGCAAAAGC | 19 | 13491 |
| BCL11A-11372 | − | GCAGGACUAGAAGCAAAAGC | 20 | 13492 |
| BCL11A-11373 | − | CGCAGGACUAGAAGCAAAAGC | 21 | 13493 |

TABLE 19C-continued

| | | 3rd Tier | | |
|---|---|---|---|---|
| gRNA Name | DNA Strand | Targeting Domain | Target Site Length | SEQ ID NO: |
| BCL11A-11374 | - | GCGCAGGACUAGAAGCAAAAGC | 22 | 13494 |
| BCL11A-11375 | - | CGCGCAGGACUAGAAGCAAAAGC | 23 | 13495 |
| BCL11A-11376 | - | GCGCGCAGGACUAGAAGCAAAAGC | 24 | 13496 |
| BCL11A-11377 | - | CCUGACGUUCAAGUUCGC | 18 | 13497 |
| BCL11A-11378 | - | UCCUGACGUUCAAGUUCGC | 19 | 13498 |
| BCL11A-9566 | - | CUCCUGACGUUCAAGUUCGC | 20 | 13499 |
| BCL11A-11379 | - | ACUCCUGACGUUCAAGUUCGC | 21 | 13500 |
| BCL11A-11380 | - | GACUCCUGACGUUCAAGUUCGC | 22 | 13501 |
| BCL11A-11381 | - | AGACUCCUGACGUUCAAGUUCGC | 23 | 13502 |
| BCL11A-11382 | - | CAGACUCCUGACGUUCAAGUUCGC | 24 | 13503 |
| BCL11A-11383 | - | UAAUAAUUAUUAAUAAUC | 18 | 13504 |
| BCL11A-11384 | - | AUAAUAAUUAUUAAUAAUC | 19 | 13505 |
| BCL11A-11385 | - | AAUAAUAAUUAUUAAUAAUC | 20 | 13506 |
| BCL11A-11386 | - | UAAUAAUAAUUAUUAAUAAUC | 21 | 13507 |
| BCL11A-11387 | - | GUAAUAAUAAUUAUUAAUAAUC | 22 | 13508 |
| BCL11A-11388 | - | AGUAAUAAUAAUUAUUAAUAAUC | 23 | 13509 |
| BCL11A-11389 | - | UAGUAAUAAUAAUUAUUAAUAAUC | 24 | 13510 |
| BCL11A-11390 | - | AAAAACCCUCAUCCCAUC | 18 | 13511 |
| BCL11A-11391 | - | AAAAAACCCUCAUCCCAUC | 19 | 13512 |
| BCL11A-9730 | - | GAAAAAACCCUCAUCCCAUC | 20 | 13513 |
| BCL11A-11392 | - | GGAAAAAACCCUCAUCCCAUC | 21 | 13514 |
| BCL11A-11393 | - | GGGAAAAAACCCUCAUCCCAUC | 22 | 13515 |
| BCL11A-11394 | - | GGGGAAAAAACCCUCAUCCCAUC | 23 | 13516 |
| BCL11A-11395 | - | GGGGGAAAAAACCCUCAUCCCAUC | 24 | 13517 |
| BCL11A-11396 | - | CACUUGAACUUGCAGCUC | 18 | 13518 |
| BCL11A-11397 | - | GCACUUGAACUUGCAGCUC | 19 | 13519 |
| BCL11A-9569 | - | CGCACUUGAACUUGCAGCUC | 20 | 13520 |
| BCL11A-11398 | - | CCGCACUUGAACUUGCAGCUC | 21 | 13521 |
| BCL11A-11399 | - | UCCGCACUUGAACUUGCAGCUC | 22 | 13522 |
| BCL11A-11400 | - | GUCCGCACUUGAACUUGCAGCUC | 23 | 13523 |
| BCL11A-11401 | - | CGUCCGCACUUGAACUUGCAGCUC | 24 | 13524 |
| BCL11A-11402 | - | UGCAUUUUUAAAUUUUUC | 18 | 13525 |
| BCL11A-11403 | - | AUGCAUUUUUAAAUUUUUC | 19 | 13526 |
| BCL11A-11404 | - | CAUGCAUUUUUAAAUUUUUC | 20 | 13527 |
| BCL11A-11405 | - | GCAUGCAUUUUUAAAUUUUUC | 21 | 13528 |
| BCL11A-11406 | - | UGCAUGCAUUUUUAAAUUUUUC | 22 | 13529 |
| BCL11A-11407 | - | GUGCAUGCAUUUUUAAAUUUUUC | 23 | 13530 |

TABLE 19C-continued

3rd Tier

| gRNA Name | DNA Strand | Targeting Domain | Target Site Length | SEQ ID NO: |
|---|---|---|---|---|
| BCL11A-11408 | - | UGUGCAUGCAUUUUUAAAUUUUUC | 24 | 13531 |
| BCL11A-11409 | - | GAGGUAAAAGAGAUAAAG | 18 | 13532 |
| BCL11A-11410 | - | CGAGGUAAAAGAGAUAAAG | 19 | 13533 |
| BCL11A-9571 | - | UCGAGGUAAAAGAGAUAAAG | 20 | 13534 |
| BCL11A-11411 | - | GUCGAGGUAAAAGAGAUAAAG | 21 | 13535 |
| BCL11A-11412 | - | AGUCGAGGUAAAAGAGAUAAAG | 22 | 13536 |
| BCL11A-11413 | - | GAGUCGAGGUAAAAGAGAUAAAG | 23 | 13537 |
| BCL11A-11414 | - | AGAGUCGAGGUAAAAGAGAUAAAG | 24 | 13538 |
| BCL11A-11415 | - | CUUGAACUUGCAGCUCAG | 18 | 13539 |
| BCL11A-11416 | - | ACUUGAACUUGCAGCUCAG | 19 | 13540 |
| BCL11A-9738 | - | CACUUGAACUUGCAGCUCAG | 20 | 13541 |
| BCL11A-11417 | - | GCACUUGAACUUGCAGCUCAG | 21 | 13542 |
| BCL11A-11418 | - | CGCACUUGAACUUGCAGCUCAG | 22 | 13543 |
| BCL11A-11419 | - | CCGCACUUGAACUUGCAGCUCAG | 23 | 13544 |
| BCL11A-11420 | - | UCCGCACUUGAACUUGCAGCUCAG | 24 | 13545 |
| BCL11A-11421 | - | GAGAAAAACCUCCGAGAG | 18 | 13546 |
| BCL11A-11422 | - | CGAGAAAAACCUCCGAGAG | 19 | 13547 |
| BCL11A-11423 | - | ACGAGAAAAACCUCCGAGAG | 20 | 13548 |
| BCL11A-11424 | - | CACGAGAAAAACCUCCGAGAG | 21 | 13549 |
| BCL11A-11425 | - | UCACGAGAAAAACCUCCGAGAG | 22 | 13550 |
| BCL11A-11426 | - | UUCACGAGAAAAACCUCCGAGAG | 23 | 13551 |
| BCL11A-11427 | - | UUUCACGAGAAAAACCUCCGAGAG | 24 | 13552 |
| BCL11A-11428 | - | ACUAGAAGCAAAAGCGAG | 18 | 13553 |
| BCL11A-11429 | - | GACUAGAAGCAAAAGCGAG | 19 | 13554 |
| BCL11A-9739 | - | GGACUAGAAGCAAAAGCGAG | 20 | 13555 |
| BCL11A-11430 | - | AGGACUAGAAGCAAAAGCGAG | 21 | 13556 |
| BCL11A-11431 | - | CAGGACUAGAAGCAAAAGCGAG | 22 | 13557 |
| BCL11A-11432 | - | GCAGGACUAGAAGCAAAAGCGAG | 23 | 13558 |
| BCL11A-11433 | - | CGCAGGACUAGAAGCAAAAGCGAG | 24 | 13559 |
| BCL11A-11434 | - | CGCGUGUGUGGGGGGAG | 18 | 13560 |
| BCL11A-11435 | - | CCGCGUGUGUGGGGGGAG | 19 | 13561 |
| BCL11A-11436 | - | UCCGCGUGUGUGGGGGGAG | 20 | 13562 |
| BCL11A-11437 | - | GUCCGCGUGUGUGGGGGGAG | 21 | 13563 |
| BCL11A-11438 | - | AGUCCGCGUGUGUGGGGGGAG | 22 | 13564 |
| BCL11A-11439 | - | GAGUCCGCGUGUGUGGGGGGAG | 23 | 13565 |
| BCL11A-11440 | - | AGAGUCCGCGUGUGUGGGGGGAG | 24 | 13566 |
| BCL11A-11441 | - | GGCCGCGUCUGGCGUCCG | 18 | 13567 |
| BCL11A-11442 | - | GGGCCGCGUCUGGCGUCCG | 19 | 13568 |

TABLE 19C-continued

3rd Tier

| gRNA Name | DNA Strand | Targeting Domain | Target Site Length | SEQ ID NO: |
|---|---|---|---|---|
| BCL11A-9574 | - | GGGGCCGCGUCUGGCGUCCG | 20 | 13569 |
| BCL11A-11443 | - | GGGGGCCGCGUCUGGCGUCCG | 21 | 13570 |
| BCL11A-11444 | - | CGGGGGCCGCGUCUGGCGUCCG | 22 | 13571 |
| BCL11A-11445 | - | CCGGGGGCCGCGUCUGGCGUCCG | 23 | 13572 |
| BCL11A-11446 | - | CCCGGGGGCCGCGUCUGGCGUCCG | 24 | 13573 |
| BCL11A-11447 | - | GGACUAGAAGCAAAAGCG | 18 | 13574 |
| BCL11A-11448 | - | AGGACUAGAAGCAAAAGCG | 19 | 13575 |
| BCL11A-9748 | - | CAGGACUAGAAGCAAAAGCG | 20 | 13576 |
| BCL11A-11449 | - | GCAGGACUAGAAGCAAAAGCG | 21 | 13577 |
| BCL11A-11450 | - | CGCAGGACUAGAAGCAAAAGCG | 22 | 13578 |
| BCL11A-11451 | - | GCGCAGGACUAGAAGCAAAAGCG | 23 | 13579 |
| BCL11A-11452 | - | CGCGCAGGACUAGAAGCAAAAGCG | 24 | 13580 |
| BCL11A-11453 | - | AAUAAUCACGAGAGCGCG | 18 | 13581 |
| BCL11A-11454 | - | UAAUAAUCACGAGAGCGCG | 19 | 13582 |
| BCL11A-11455 | - | UUAAUAAUCACGAGAGCGCG | 20 | 13583 |
| BCL11A-11456 | - | AUUAAUAAUCACGAGAGCGCG | 21 | 13584 |
| BCL11A-11457 | - | UAUUAAUAAUCACGAGAGCGCG | 22 | 13585 |
| BCL11A-11458 | - | UUAUUAAUAAUCACGAGAGCGCG | 23 | 13586 |
| BCL11A-11459 | - | AUUAUUAAUAAUCACGAGAGCGCG | 24 | 13587 |
| BCL11A-11460 | - | UCCUGACGUUCAAGUUCG | 18 | 13588 |
| BCL11A-11461 | - | CUCCUGACGUUCAAGUUCG | 19 | 13589 |
| BCL11A-11462 | - | ACUCCUGACGUUCAAGUUCG | 20 | 13590 |
| BCL11A-11463 | - | GACUCCUGACGUUCAAGUUCG | 21 | 13591 |
| BCL11A-11464 | - | AGACUCCUGACGUUCAAGUUCG | 22 | 13592 |
| BCL11A-11465 | - | CAGACUCCUGACGUUCAAGUUCG | 23 | 13593 |
| BCL11A-11466 | - | CCAGACUCCUGACGUUCAAGUUCG | 24 | 13594 |
| BCL11A-11467 | - | AGGUAAAAGAGAUAAAGG | 18 | 13595 |
| BCL11A-11468 | - | GAGGUAAAAGAGAUAAAGG | 19 | 13596 |
| BCL11A-9753 | - | CGAGGUAAAAGAGAUAAAGG | 20 | 13597 |
| BCL11A-11469 | - | UCGAGGUAAAAGAGAUAAAGG | 21 | 13598 |
| BCL11A-11470 | - | GUCGAGGUAAAAGAGAUAAAGG | 22 | 13599 |
| BCL11A-11471 | - | AGUCGAGGUAAAAGAGAUAAAGG | 23 | 13600 |
| BCL11A-11472 | - | GAGUCGAGGUAAAAGAGAUAAAGG | 24 | 13601 |
| BCL11A-11473 | - | CUAGAAGCAAAAGCGAGG | 18 | 13602 |
| BCL11A-11474 | - | ACUAGAAGCAAAAGCGAGG | 19 | 13603 |
| BCL11A-9755 | - | GACUAGAAGCAAAAGCGAGG | 20 | 13604 |
| BCL11A-11475 | - | GGACUAGAAGCAAAAGCGAGG | 21 | 13605 |

TABLE 19C-continued

3rd Tier

| gRNA Name | DNA Strand | Targeting Domain | Target Site Length | SEQ ID NO: |
|---|---|---|---|---|
| BCL11A-11476 | - | AGGACUAGAAGCAAAAGCGAGG | 22 | 13606 |
| BCL11A-11477 | - | CAGGACUAGAAGCAAAAGCGAGG | 23 | 13607 |
| BCL11A-11478 | - | GCAGGACUAGAAGCAAAAGCGAGG | 24 | 13608 |
| BCL11A-11479 | - | AGAAGCAAAAGCGAGGGG | 18 | 13609 |
| BCL11A-11480 | - | UAGAAGCAAAAGCGAGGGG | 19 | 13610 |
| BCL11A-11481 | - | CUAGAAGCAAAAGCGAGGGG | 20 | 13611 |
| BCL11A-11482 | - | ACUAGAAGCAAAAGCGAGGGG | 21 | 13612 |
| BCL11A-11483 | - | GACUAGAAGCAAAAGCGAGGGG | 22 | 13613 |
| BCL11A-11484 | - | GGACUAGAAGCAAAAGCGAGGGG | 23 | 13614 |
| BCL11A-11485 | - | AGGACUAGAAGCAAAAGCGAGGGG | 24 | 13615 |
| BCL11A-11486 | - | GAGUCCGCGUGUGUGGGG | 18 | 13616 |
| BCL11A-11487 | - | AGAGUCCGCGUGUGUGGGG | 19 | 13617 |
| BCL11A-9577 | - | UAGAGUCCGCGUGUGUGGGG | 20 | 13618 |
| BCL11A-11488 | - | UUAGAGUCCGCGUGUGUGGGG | 21 | 13619 |
| BCL11A-11489 | - | UUUAGAGUCCGCGUGUGUGGGG | 22 | 13620 |
| BCL11A-11490 | - | UUUUAGAGUCCGCGUGUGUGGGG | 23 | 13621 |
| BCL11A-11491 | - | AUUUUAGAGUCCGCGUGUGUGGGG | 24 | 13622 |
| BCL11A-11492 | - | AGAGUCCGCGUGUGUGGG | 18 | 13623 |
| BCL11A-11493 | - | UAGAGUCCGCGUGUGUGGG | 19 | 13624 |
| BCL11A-9769 | - | UUAGAGUCCGCGUGUGUGGG | 20 | 13625 |
| BCL11A-11494 | - | UUUAGAGUCCGCGUGUGUGGG | 21 | 13626 |
| BCL11A-11495 | - | UUUUAGAGUCCGCGUGUGUGGG | 22 | 13627 |
| BCL11A-11496 | - | AUUUUAGAGUCCGCGUGUGUGGG | 23 | 13628 |
| BCL11A-11497 | - | CAUUUUAGAGUCCGCGUGUGUGGG | 24 | 13629 |
| BCL11A-11498 | - | UAGAGUCCGCGUGUGUGG | 18 | 13630 |
| BCL11A-11499 | - | UUAGAGUCCGCGUGUGUGG | 19 | 13631 |
| BCL11A-9578 | - | UUUAGAGUCCGCGUGUGUGG | 20 | 13632 |
| BCL11A-11500 | - | UUUUAGAGUCCGCGUGUGUGG | 21 | 13633 |
| BCL11A-11501 | - | AUUUUAGAGUCCGCGUGUGUGG | 22 | 13634 |
| BCL11A-11502 | - | CAUUUUAGAGUCCGCGUGUGUGG | 23 | 13635 |
| BCL11A-11503 | - | UCAUUUUAGAGUCCGCGUGUGUGG | 24 | 13636 |
| BCL11A-11504 | - | CGCUCGCUGCGGCCACUG | 18 | 13637 |
| BCL11A-11505 | - | GCGCUCGCUGCGGCCACUG | 19 | 13638 |
| BCL11A-11506 | - | GGCGCUCGCUGCGGCCACUG | 20 | 13639 |
| BCL11A-11507 | - | CGGCGCUCGCUGCGGCCACUG | 21 | 13640 |
| BCL11A-11508 | - | GCGGCGCUCGCUGCGGCCACUG | 22 | 13641 |
| BCL11A-11509 | - | CGCGGCGCUCGCUGCGGCCACUG | 23 | 13642 |
| BCL11A-11510 | - | CCGCGGCGCUCGCUGCGGCCACUG | 24 | 13643 |

TABLE 19C-continued

| | | 3rd Tier | | |
|---|---|---|---|---|
| gRNA Name | DNA Strand | Targeting Domain | Target Site Length | SEQ ID NO: |
| BCL11A-11511 | − | GGAUGUCAAAAGGCACUG | 18 | 13644 |
| BCL11A-11512 | − | UGGAUGUCAAAAGGCACUG | 19 | 13645 |
| BCL11A-11513 | − | UUGGAUGUCAAAAGGCACUG | 20 | 13646 |
| BCL11A-11514 | − | UUUGGAUGUCAAAAGGCACUG | 21 | 13647 |
| BCL11A-11515 | − | UUUUGGAUGUCAAAAGGCACUG | 22 | 13648 |
| BCL11A-11516 | − | AUUUUGGAUGUCAAAAGGCACUG | 23 | 13649 |
| BCL11A-11517 | − | UAUUUUGGAUGUCAAAAGGCACUG | 24 | 13650 |
| BCL11A-11518 | − | UUUUAGAGUCCGCGUGUG | 18 | 13651 |
| BCL11A-11519 | − | AUUUUAGAGUCCGCGUGUG | 19 | 13652 |
| BCL11A-9581 | − | CAUUUUAGAGUCCGCGUGUG | 20 | 13653 |
| BCL11A-11520 | − | UCAUUUUAGAGUCCGCGUGUG | 21 | 13654 |
| BCL11A-11521 | − | UUCAUUUUAGAGUCCGCGUGUG | 22 | 13655 |
| BCL11A-11522 | − | UUUCAUUUUAGAGUCCGCGUGUG | 23 | 13656 |
| BCL11A-11523 | − | CUUUCAUUUUAGAGUCCGCGUGUG | 24 | 13657 |
| BCL11A-11524 | − | UUAGAGUCCGCGUGUGUG | 18 | 13658 |
| BCL11A-11525 | − | UUUAGAGUCCGCGUGUGUG | 19 | 13659 |
| BCL11A-9776 | − | UUUUAGAGUCCGCGUGUGUG | 20 | 13660 |
| BCL11A-11526 | − | AUUUUAGAGUCCGCGUGUGUG | 21 | 13661 |
| BCL11A-11527 | − | CAUUUUAGAGUCCGCGUGUGUG | 22 | 13662 |
| BCL11A-11528 | − | UCAUUUUAGAGUCCGCGUGUGUG | 23 | 13663 |
| BCL11A-11529 | − | UUCAUUUUAGAGUCCGCGUGUGUG | 24 | 13664 |
| BCL11A-11530 | − | AAAAAACCCUCAUCCCAU | 18 | 13665 |
| BCL11A-11531 | − | GAAAAAACCCUCAUCCCAU | 19 | 13666 |
| BCL11A-11532 | − | GGAAAAAACCCUCAUCCCAU | 20 | 13667 |
| BCL11A-11533 | − | GGGAAAAAACCCUCAUCCCAU | 21 | 13668 |
| BCL11A-11534 | − | GGGGAAAAAACCCUCAUCCCAU | 22 | 13669 |
| BCL11A-11535 | − | GGGGGAAAAAACCCUCAUCCCAU | 23 | 13670 |
| BCL11A-11536 | − | AGGGGGAAAAAACCCUCAUCCCAU | 24 | 13671 |
| BCL11A-11537 | − | UAACCCGGCUCUCCCGAU | 18 | 13672 |
| BCL11A-11538 | − | CUAACCCGGCUCUCCCGAU | 19 | 13673 |
| BCL11A-11539 | − | UCUAACCCGGCUCUCCCGAU | 20 | 13674 |
| BCL11A-11540 | − | UUCUAACCCGGCUCUCCCGAU | 21 | 13675 |
| BCL11A-11541 | − | UUUCUAACCCGGCUCUCCCGAU | 22 | 13676 |
| BCL11A-11542 | − | CUUUCUAACCCGGCUCUCCCGAU | 23 | 13677 |
| BCL11A-11543 | − | UCUUUCUAACCCGGCUCUCCCGAU | 24 | 13678 |
| BCL11A-11544 | − | UUUUCACGAGAAAACCU | 18 | 13679 |
| BCL11A-11545 | − | UUUUUCACGAGAAAACCU | 19 | 13680 |

TABLE 19C-continued

3rd Tier

| gRNA Name | DNA Strand | Targeting Domain | Target Site Length | SEQ ID NO: |
|---|---|---|---|---|
| BCL11A-11546 | - | AUUUUUCACGAGAAAAACCU | 20 | 13681 |
| BCL11A-11547 | - | AAUUUUUCACGAGAAAAACCU | 21 | 13682 |
| BCL11A-11548 | - | AAAUUUUUCACGAGAAAAACCU | 22 | 13683 |
| BCL11A-11549 | - | UAAAUUUUUCACGAGAAAAACCU | 23 | 13684 |
| BCL11A-11550 | - | UUAAAUUUUUCACGAGAAAAACCU | 24 | 13685 |
| BCL11A-11551 | - | GCACUUGAACUUGCAGCU | 18 | 13686 |
| BCL11A-11552 | - | CGCACUUGAACUUGCAGCU | 19 | 13687 |
| BCL11A-11553 | - | CCGCACUUGAACUUGCAGCU | 20 | 13688 |
| BCL11A-11554 | - | UCCGCACUUGAACUUGCAGCU | 21 | 13689 |
| BCL11A-11555 | - | GUCCGCACUUGAACUUGCAGCU | 22 | 13690 |
| BCL11A-11556 | - | CGUCCGCACUUGAACUUGCAGCU | 23 | 13691 |
| BCL11A-11557 | - | ACGUCCGCACUUGAACUUGCAGCU | 24 | 13692 |
| BCL11A-11558 | - | CUGAUGAAGAUAUUUUCU | 18 | 13693 |
| BCL11A-11559 | - | ACUGAUGAAGAUAUUUUCU | 19 | 13694 |
| BCL11A-11560 | - | CACUGAUGAAGAUAUUUUCU | 20 | 13695 |
| BCL11A-11561 | - | GCACUGAUGAAGAUAUUUUCU | 21 | 13696 |
| BCL11A-11562 | - | GGCACUGAUGAAGAUAUUUUCU | 22 | 13697 |
| BCL11A-11563 | - | AGGCACUGAUGAAGAUAUUUUCU | 23 | 13698 |
| BCL11A-11564 | - | AAGGCACUGAUGAAGAUAUUUUCU | 24 | 13699 |
| BCL11A-11565 | - | UGAUGUGUGUCCAUUGGU | 18 | 13700 |
| BCL11A-11566 | - | CUGAUGUGUGUCCAUUGGU | 19 | 13701 |
| BCL11A-11567 | - | CCUGAUGUGUGUCCAUUGGU | 20 | 13702 |
| BCL11A-11568 | - | CCCUGAUGUGUGUCCAUUGGU | 21 | 13703 |
| BCL11A-11569 | - | CCCCUGAUGUGUGUCCAUUGGU | 22 | 13704 |
| BCL11A-11570 | - | GCCCCUGAUGUGUGUCCAUUGGU | 23 | 13705 |
| BCL11A-11571 | - | AGCCCCUGAUGUGUGUCCAUUGGU | 24 | 13706 |
| BCL11A-11572 | - | AUUUUAGAGUCCGCGUGU | 18 | 13707 |
| BCL11A-11573 | - | CAUUUUAGAGUCCGCGUGU | 19 | 13708 |
| BCL11A-11574 | - | UCAUUUUAGAGUCCGCGUGU | 20 | 13709 |
| BCL11A-11575 | - | UUCAUUUUAGAGUCCGCGUGU | 21 | 13710 |
| BCL11A-11576 | - | UUUCAUUUUAGAGUCCGCGUGU | 22 | 13711 |
| BCL11A-11577 | - | CUUUCAUUUUAGAGUCCGCGUGU | 23 | 13712 |
| BCL11A-11578 | - | UCUUUCAUUUUAGAGUCCGCGUGU | 24 | 13713 |
| BCL11A-11579 | - | UUUAGAGUCCGCGUGUGU | 18 | 13714 |
| BCL11A-11580 | - | UUUUAGAGUCCGCGUGUGU | 19 | 13715 |
| BCL11A-9586 | - | AUUUUAGAGUCCGCGUGUGU | 20 | 13716 |
| BCL11A-11581 | - | CAUUUUAGAGUCCGCGUGUGU | 21 | 13717 |
| BCL11A-11582 | - | UCAUUUUAGAGUCCGCGUGUGU | 22 | 13718 |

TABLE 19C-continued

3rd Tier

| gRNA Name | DNA Strand | Targeting Domain | Target Site Length | SEQ ID NO: |
|---|---|---|---|---|
| BCL11A-11583 | - | UUCAUUUUAGAGUCCGCGUGUGU | 23 | 13719 |
| BCL11A-11584 | - | UUUCAUUUUAGAGUCCGCGUGUGU | 24 | 13720 |
| BCL11A-11585 | - | AUUGCCGUGUAUGCACUU | 18 | 13721 |
| BCL11A-11586 | - | CAUUGCCGUGUAUGCACUU | 19 | 13722 |
| BCL11A-11587 | - | CCAUUGCCGUGUAUGCACUU | 20 | 13723 |
| BCL11A-11588 | - | ACCAUUGCCGUGUAUGCACUU | 21 | 13724 |
| BCL11A-11589 | - | AACCAUUGCCGUGUAUGCACUU | 22 | 13725 |
| BCL11A-11590 | - | GAACCAUUGCCGUGUAUGCACUU | 23 | 13726 |
| BCL11A-11591 | - | GGAACCAUUGCCGUGUAUGCACUU | 24 | 13727 |

Table 19D provides exemplary targeting domains for knocking down the BCL11A gene selected according to the fourth tier parameters. The targeting domains bind within the additional 500 bp (e.g., upstream or downstream) of a transcription start site (TSS), e.g., extending to 1 kb upstream and downstream of a TSS, and the PAM is NNGRRT. It is contemplated herein that in an embodiment the targeting domain hybridizes to the target domain through complementary base pairing. Any of the targeting domains in the table can be used with a *S. aureus* eiCas9 molecule or eiCas9 fusion protein (e.g., an eiCas9 fused to a transcription repressor domain) to alter the BCL11A gene (e.g., reduce or eliminate BCL11A gene expression, BCL11A protein function, or the level of BCL11A protein). One or more gRNA may be used to target an eiCas9 to the promoter region of the BCL11A gene.

TABLE 19D

4th Tier

| gRNA Name | DNA Strand | Targeting Domain | Target Site Length | SEQ ID NO: |
|---|---|---|---|---|
| BCL11A-11592 | + | CUCACCUCUUUUCUCCCC | 18 | 13728 |
| BCL11A-11593 | + | UCUCACCUCUUUUCUCCCC | 19 | 13729 |
| BCL11A-10076 | + | GUCUCACCUCUUUUCUCCCC | 20 | 13730 |
| BCL11A-11594 | + | AGUCUCACCUCUUUUCUCCCC | 21 | 13731 |
| BCL11A-11595 | + | CAGUCUCACCUCUUUUCUCCCC | 22 | 13732 |
| BCL11A-11596 | + | CCAGUCUCACCUCUUUUCUCCCC | 23 | 13733 |
| BCL11A-11597 | + | GCCAGUCUCACCUCUUUUCUCCCC | 24 | 13734 |
| BCL11A-11598 | + | AAAAGAAAAAAUAGAGC | 18 | 13735 |
| BCL11A-11599 | + | AAAAAGAAAAAAUAGAGC | 19 | 13736 |
| BCL11A-11600 | + | AAAAAAGAAAAAAUAGAGC | 20 | 13737 |
| BCL11A-11601 | + | CAAAAAAGAAAAAAUAGAGC | 21 | 13738 |
| BCL11A-11602 | + | UCAAAAAAGAAAAAAUAGAGC | 22 | 13739 |
| BCL11A-11603 | + | UUCAAAAAAGAAAAAAUAGAGC | 23 | 13740 |
| BCL11A-11604 | + | AUUCAAAAAAGAAAAAAUAGAGC | 24 | 13741 |
| BCL11A-11605 | + | GGCGGGGCGGGGGGGAG | 18 | 13742 |
| BCL11A-11606 | + | UGGCGGGGCGGGGGGGAG | 19 | 13743 |
| BCL11A-10153 | + | CUGGCGGGGCGGGGGGGAG | 20 | 13744 |
| BCL11A-11607 | + | ACUGGCGGGGCGGGGGGGAG | 21 | 13745 |

TABLE 19D-continued

4th Tier

| gRNA Name | DNA Strand | Targeting Domain | Target Site Length | SEQ ID NO: |
|---|---|---|---|---|
| BCL11A-11608 | + | AACUGGCGGGGCGGGGGGGAG | 22 | 13746 |
| BCL11A-11609 | + | AAACUGGCGGGGCGGGGGGGAG | 23 | 13747 |
| BCL11A-11610 | + | AAAACUGGCGGGGCGGGGGGGAG | 24 | 13748 |
| BCL11A-11611 | + | AGGGAGCGCACGGCAACG | 18 | 13749 |
| BCL11A-11612 | + | GAGGGAGCGCACGGCAACG | 19 | 13750 |
| BCL11A-10155 | + | GGAGGGAGCGCACGGCAACG | 20 | 13751 |
| BCL11A-11613 | + | GGGAGGGAGCGCACGGCAACG | 21 | 13752 |
| BCL11A-11614 | + | UGGGAGGGAGCGCACGGCAACG | 22 | 13753 |
| BCL11A-11615 | + | GUGGGAGGGAGCGCACGGCAACG | 23 | 13754 |
| BCL11A-11616 | + | GGUGGGAGGGAGCGCACGGCAACG | 24 | 13755 |
| BCL11A-11617 | + | CCCCCCCAUUUUCUUACG | 18 | 13756 |
| BCL11A-11618 | + | ACCCCCCCAUUUUCUUACG | 19 | 13757 |
| BCL11A-11619 | + | UACCCCCCCAUUUUCUUACG | 20 | 13758 |
| BCL11A-11620 | + | CUACCCCCCCAUUUUCUUACG | 21 | 13759 |
| BCL11A-11621 | + | CCUACCCCCCCAUUUUCUUACG | 22 | 13760 |
| BCL11A-11622 | + | CCCUACCCCCCCAUUUUCUUACG | 23 | 13761 |
| BCL11A-11623 | + | UCCCUACCCCCCCAUUUUCUUACG | 24 | 13762 |
| BCL11A-11624 | + | GGGCGGAGGGAAGCCAGG | 18 | 13763 |
| BCL11A-11625 | + | CGGGCGGAGGGAAGCCAGG | 19 | 13764 |
| BCL11A-11626 | + | GCGGGCGGAGGGAAGCCAGG | 20 | 13765 |
| BCL11A-11627 | + | CGCGGGCGGAGGGAAGCCAGG | 21 | 13766 |
| BCL11A-11628 | + | GCGCGGGCGGAGGGAAGCCAGG | 22 | 13767 |
| BCL11A-11629 | + | AGCGCGGGCGGAGGGAAGCCAGG | 23 | 13768 |
| BCL11A-11630 | + | AAGCGCGGGCGGAGGGAAGCCAGG | 24 | 13769 |
| BCL11A-11631 | + | CGGAAAGGAGGAAAGAGG | 18 | 13770 |
| BCL11A-11632 | + | GCGGAAAGGAGGAAAGAGG | 19 | 13771 |
| BCL11A-10187 | + | GGCGGAAAGGAGGAAAGAGG | 20 | 13772 |
| BCL11A-11633 | + | CGGCGGAAAGGAGGAAAGAGG | 21 | 13773 |
| BCL11A-11634 | + | GCGGCGGAAAGGAGGAAAGAGG | 22 | 13774 |
| BCL11A-11635 | + | AGCGGCGGAAAGGAGGAAAGAGG | 23 | 13775 |
| BCL11A-11636 | + | AAGCGGCGGAAAGGAGGAAAGAGG | 24 | 13776 |
| BCL11A-11637 | + | AAACUGGCGGGGCGGGGG | 18 | 13777 |
| BCL11A-11638 | + | AAAACUGGCGGGGCGGGGG | 19 | 13778 |
| BCL11A-10209 | + | CAAAACUGGCGGGGCGGGGG | 20 | 13779 |
| BCL11A-11639 | + | GCAAAACUGGCGGGGCGGGGG | 21 | 13780 |
| BCL11A-11640 | + | UGCAAAACUGGCGGGGCGGGGG | 22 | 13781 |
| BCL11A-11641 | + | UUGCAAAACUGGCGGGGCGGGGG | 23 | 13782 |
| BCL11A-11642 | + | UUUGCAAAACUGGCGGGGCGGGGG | 24 | 13783 |

TABLE 19D-continued

| | 4th Tier | | | |
|---|---|---|---|---|
| gRNA Name | DNA Strand | Targeting Domain | Target Site Length | SEQ ID NO: |
| BCL11A-11643 | + | CCACCCCCAGGUUUGCAU | 18 | 13784 |
| BCL11A-11644 | + | CCCACCCCCAGGUUUGCAU | 19 | 13785 |
| BCL11A-11645 | + | UCCCACCCCCAGGUUUGCAU | 20 | 13786 |
| BCL11A-11646 | + | CUCCCACCCCCAGGUUUGCAU | 21 | 13787 |
| BCL11A-11647 | + | GCUCCCACCCCCAGGUUUGCAU | 22 | 13788 |
| BCL11A-11648 | + | AGCUCCCACCCCCAGGUUUGCAU | 23 | 13789 |
| BCL11A-11649 | + | CAGCUCCCACCCCCAGGUUUGCAU | 24 | 13790 |
| BCL11A-11650 | + | GCCUAAGUUUGGAGGGCU | 18 | 13791 |
| BCL11A-11651 | + | AGCCUAAGUUUGGAGGGCU | 19 | 13792 |
| BCL11A-11652 | + | CAGCCUAAGUUUGGAGGGCU | 20 | 13793 |
| BCL11A-11653 | + | CCAGCCUAAGUUUGGAGGGCU | 21 | 13794 |
| BCL11A-11654 | + | UCCAGCCUAAGUUUGGAGGGCU | 22 | 13795 |
| BCL11A-11655 | + | AUCCAGCCUAAGUUUGGAGGGCU | 23 | 13796 |
| BCL11A-11656 | + | AAUCCAGCCUAAGUUUGGAGGGCU | 24 | 13797 |
| BCL11A-11657 | + | CCACUUUCUCACUAUUGU | 18 | 13798 |
| BCL11A-11658 | + | GCCACUUUCUCACUAUUGU | 19 | 13799 |
| BCL11A-10251 | + | UGCCACUUUCUCACUAUUGU | 20 | 13800 |
| BCL11A-11659 | + | GUGCCACUUUCUCACUAUUGU | 21 | 13801 |
| BCL11A-11660 | + | AGUGCCACUUUCUCACUAUUGU | 22 | 13802 |
| BCL11A-11661 | + | CAGUGCCACUUUCUCACUAUUGU | 23 | 13803 |
| BCL11A-11662 | + | ACAGUGCCACUUUCUCACUAUUGU | 24 | 13804 |
| BCL11A-11663 | − | UUAUUUCUCUUUUCGAAA | 18 | 13805 |
| BCL11A-11664 | − | UUUAUUUCUCUUUUCGAAA | 19 | 13806 |
| BCL11A-10027 | − | CUUUAUUUCUCUUUUCGAAA | 20 | 13807 |
| BCL11A-11665 | − | GCUUUAUUUCUCUUUUCGAAA | 21 | 13808 |
| BCL11A-11666 | − | CGCUUUAUUUCUCUUUUCGAAA | 22 | 13809 |
| BCL11A-11667 | − | CCGCUUUAUUUCUCUUUUCGAAA | 23 | 13810 |
| BCL11A-11668 | − | GCCGCUUUAUUUCUCUUUUCGAAA | 24 | 13811 |
| BCL11A-11669 | − | CGGCGGCGGGGAGGGGAA | 18 | 13812 |
| BCL11A-11670 | − | GCGGCGGCGGGGAGGGGAA | 19 | 13813 |
| BCL11A-11671 | − | GGCGGCGGCGGGGAGGGGAA | 20 | 13814 |
| BCL11A-11672 | − | CGGCGGCGGCGGGGAGGGGAA | 21 | 13815 |
| BCL11A-11673 | − | GCGGCGGCGGCGGGGAGGGGAA | 22 | 13816 |
| BCL11A-11674 | − | CGCGGCGGCGGCGGGGAGGGGAA | 23 | 13817 |
| BCL11A-11675 | − | GCGCGGCGGCGGCGGGGAGGGGAA | 24 | 13818 |
| BCL11A-11676 | − | UGGGGGGGUAGGGAGGGA | 18 | 13819 |
| BCL11A-11677 | − | AUGGGGGGGUAGGGAGGGA | 19 | 13820 |

TABLE 19D-continued

4th Tier

| gRNA Name | DNA Strand | Targeting Domain | Target Site Length | SEQ ID NO: |
|---|---|---|---|---|
| BCL11A-11678 | - | AAUGGGGGGUAGGGAGGGA | 20 | 13821 |
| BCL11A-11679 | - | AAAUGGGGGGUAGGGAGGGA | 21 | 13822 |
| BCL11A-11680 | - | AAAAUGGGGGGUAGGGAGGGA | 22 | 13823 |
| BCL11A-11681 | - | GAAAAUGGGGGGUAGGGAGGGA | 23 | 13824 |
| BCL11A-11682 | - | AGAAAAUGGGGGGUAGGGAGGGA | 24 | 13825 |
| BCL11A-11683 | - | AAAUGGGGGGUAGGGA | 18 | 13826 |
| BCL11A-11684 | - | GAAAAUGGGGGGUAGGGA | 19 | 13827 |
| BCL11A-10049 | - | AGAAAAUGGGGGGUAGGGA | 20 | 13828 |
| BCL11A-11685 | - | AAGAAAAUGGGGGGUAGGGA | 21 | 13829 |
| BCL11A-11686 | - | UAAGAAAAUGGGGGGUAGGGA | 22 | 13830 |
| BCL11A-11687 | - | GUAAGAAAAUGGGGGGUAGGGA | 23 | 13831 |
| BCL11A-11688 | - | CGUAAGAAAAUGGGGGGUAGGGA | 24 | 13832 |
| BCL11A-11689 | - | AAGGGGCCCCCGGCGCUC | 18 | 13833 |
| BCL11A-11690 | - | AAAGGGGCCCCCGGCGCUC | 19 | 13834 |
| BCL11A-11691 | - | GAAAGGGGCCCCCGGCGCUC | 20 | 13835 |
| BCL11A-11692 | - | GGAAAGGGGCCCCCGGCGCUC | 21 | 13836 |
| BCL11A-11693 | - | UGGAAAGGGGCCCCCGGCGCUC | 22 | 13837 |
| BCL11A-11694 | - | GUGGAAAGGGGCCCCCGGCGCUC | 23 | 13838 |
| BCL11A-11695 | - | UGUGGAAAGGGGCCCCCGGCGCUC | 24 | 13839 |
| BCL11A-11696 | - | CUUUUGUUCCGGCCAGAG | 18 | 13840 |
| BCL11A-11697 | - | CCUUUUGUUCCGGCCAGAG | 19 | 13841 |
| BCL11A-11698 | - | GCCUUUUGUUCCGGCCAGAG | 20 | 13842 |
| BCL11A-11699 | - | CGCCUUUUGUUCCGGCCAGAG | 21 | 13843 |
| BCL11A-11700 | - | CCGCCUUUUGUUCCGGCCAGAG | 22 | 13844 |
| BCL11A-11701 | - | GCCGCCUUUUGUUCCGGCCAGAG | 23 | 13845 |
| BCL11A-11702 | - | UGCCGCCUUUUGUUCCGGCCAGAG | 24 | 13846 |
| BCL11A-11703 | - | GUGGGUGUGCGUACGGAG | 18 | 13847 |
| BCL11A-11704 | - | AGUGGGUGUGCGUACGGAG | 19 | 13848 |
| BCL11A-11705 | - | AAGUGGGUGUGCGUACGGAG | 20 | 13849 |
| BCL11A-11706 | - | GAAGUGGGUGUGCGUACGGAG | 21 | 13850 |
| BCL11A-11707 | - | GGAAGUGGGUGUGCGUACGGAG | 22 | 13851 |
| BCL11A-11708 | - | GGGAAGUGGGUGUGCGUACGGAG | 23 | 13852 |
| BCL11A-11709 | - | GGGGAAGUGGGUGUGCGUACGGAG | 24 | 13853 |
| BCL11A-11710 | - | CCGGCGCUCCUGAGUCCG | 18 | 13854 |
| BCL11A-11711 | - | CCCGGCGCUCCUGAGUCCG | 19 | 13855 |
| BCL11A-10172 | - | CCCCGGCGCUCCUGAGUCCG | 20 | 13856 |
| BCL11A-11712 | - | CCCCCGGCGCUCCUGAGUCCG | 21 | 13857 |
| BCL11A-11713 | - | GCCCCCGGCGCUCCUGAGUCCG | 22 | 13858 |

TABLE 19D-continued

4th Tier

| gRNA Name | DNA Strand | Targeting Domain | Target Site Length | SEQ ID NO: |
|---|---|---|---|---|
| BCL11A-11714 | - | GGCCCCCGGCGCUCCUGAGUCCG | 23 | 13859 |
| BCL11A-11715 | - | GGGCCCCCGGCGCUCCUGAGUCCG | 24 | 13860 |
| BCL11A-11716 | - | CAGCCCUCCAAACUUAGG | 18 | 13861 |
| BCL11A-11717 | - | GCAGCCCUCCAAACUUAGG | 19 | 13862 |
| BCL11A-11718 | - | CGCAGCCCUCCAAACUUAGG | 20 | 13863 |
| BCL11A-11719 | - | CCGCAGCCCUCCAAACUUAGG | 21 | 13864 |
| BCL11A-11720 | - | CCCGCAGCCCUCCAAACUUAGG | 22 | 13865 |
| BCL11A-11721 | - | ACCCGCAGCCCUCCAAACUUAGG | 23 | 13866 |
| BCL11A-11722 | - | GACCCGCAGCCCUCCAAACUUAGG | 24 | 13867 |
| BCL11A-11723 | - | CUCACCGUAAGAAAAUGG | 18 | 13868 |
| BCL11A-11724 | - | ACUCACCGUAAGAAAAUGG | 19 | 13869 |
| BCL11A-10214 | - | CACUCACCGUAAGAAAAUGG | 20 | 13870 |
| BCL11A-11725 | - | CCACUCACCGUAAGAAAAUGG | 21 | 13871 |
| BCL11A-11726 | - | CCCACUCACCGUAAGAAAAUGG | 22 | 13872 |
| BCL11A-11727 | - | UCCCACUCACCGUAAGAAAAUGG | 23 | 13873 |
| BCL11A-11728 | - | UUCCCACUCACCGUAAGAAAAUGG | 24 | 13874 |
| BCL11A-11729 | - | GAGGCUCAGCUCUCAACU | 18 | 13875 |
| BCL11A-11730 | - | GGAGGCUCAGCUCUCAACU | 19 | 13876 |
| BCL11A-11731 | - | UGGAGGCUCAGCUCUCAACU | 20 | 13877 |
| BCL11A-11732 | - | UUGGAGGCUCAGCUCUCAACU | 21 | 13878 |
| BCL11A-11733 | - | CUUGGAGGCUCAGCUCUCAACU | 22 | 13879 |
| BCL11A-11734 | - | ACUUGGAGGCUCAGCUCUCAACU | 23 | 13880 |
| BCL11A-11735 | - | AACUUGGAGGCUCAGCUCUCAACU | 24 | 13881 |
| BCL11A-11736 | - | CAACUCACAUGCAAACCU | 18 | 13882 |
| BCL11A-11737 | - | ACAACUCACAUGCAAACCU | 19 | 13883 |
| BCL11A-10235 | - | AACAACUCACAUGCAAACCU | 20 | 13884 |
| BCL11A-11738 | - | GAACAACUCACAUGCAAACCU | 21 | 13885 |
| BCL11A-11739 | - | CGAACAACUCACAUGCAAACCU | 22 | 13886 |
| BCL11A-11740 | - | GCGAACAACUCACAUGCAAACCU | 23 | 13887 |
| BCL11A-11741 | - | UGCGAACAACUCACAUGCAAACCU | 24 | 13888 |
| BCL11A-10351 | - | UUGAAUAAUCUUUCAUUU | 18 | 13889 |
| BCL11A-10352 | - | UUUGAAUAAUCUUUCAUUU | 19 | 13890 |
| BCL11A-10353 | - | UUUUGAAUAAUCUUUCAUUU | 20 | 13891 |
| BCL11A-10354 | - | UUUUUGAAUAAUCUUUCAUUU | 21 | 13892 |
| BCL11A-10355 | - | UUUUUUGAAUAAUCUUUCAUUU | 22 | 13893 |
| BCL11A-10356 | - | CUUUUUUGAAUAAUCUUUCAUUU | 23 | 13894 |
| BCL11A-10357 | - | UCUUUUUUGAAUAAUCUUUCAUUU | 24 | 13895 |

TABLE 19D-continued

4th Tier

| gRNA Name | DNA Strand | Targeting Domain | Target Site Length | SEQ ID NO: |
|---|---|---|---|---|
| BCL11A-11742 | − | GCUCUAUUUUUUCUUUU | 18 | 13896 |
| BCL11A-11743 | − | CGCUCUAUUUUUUCUUUU | 19 | 13897 |
| BCL11A-11744 | − | UCGCUCUAUUUUUUCUUUU | 20 | 13898 |
| BCL11A-11745 | − | CUCGCUCUAUUUUUUCUUUU | 21 | 13899 |
| BCL11A-11746 | − | UCUCGCUCUAUUUUUUCUUUU | 22 | 13900 |
| BCL11A-11747 | − | CUCUCGCUCUAUUUUUUCUUUU | 23 | 13901 |
| BCL11A-11748 | − | ACUCUCGCUCUAUUUUUUCUUUU | 24 | 13902 |

Table 19E provides exemplary targeting domains for knocking down the BCL11A gene selected according to the fifth tier parameters. The targeting domains bind within the additional 500 bp (e.g., upstream or downstream) of a transcription start site (TSS), e.g., extending to 1 kb upstream and downstream of a TSS, and the PAM is NNGRRV. It is contemplated herein that in an embodiment the targeting domain hybridizes to the target domain through complementary base pairing. Any of the targeting domains in the table can be used with a *S. aureus* eiCas9 molecule or eiCas9 fusion protein (e.g., an eiCas9 fused to a transcription repressor domain) to alter the BCL11A gene (e.g., reduce or eliminate BCL11A gene expression, BCL11A protein function, or the level of BCL11A protein). One or more gRNA may be used to target an eiCas9 to the promoter region of the BCL11A gene.

TABLE 19E

5th Tier

| gRNA Name | DNA Strand | Targeting Domain | Target Site Length | SEQ ID NO: |
|---|---|---|---|---|
| BCL11A-11749 | + | AUUCAAAAAGAAAAAAA | 18 | 13903 |
| BCL11A-11750 | + | UAUUCAAAAAGAAAAAAA | 19 | 13904 |
| BCL11A-11751 | + | UUAUUCAAAAAGAAAAAAA | 20 | 13905 |
| BCL11A-11752 | + | AUUAUUCAAAAAGAAAAAAA | 21 | 13906 |
| BCL11A-11753 | + | GAUUAUUCAAAAAGAAAAAAA | 22 | 13907 |
| BCL11A-11754 | + | AGAUUAUUCAAAAAGAAAAAAA | 23 | 13908 |
| BCL11A-11755 | + | AAGAUUAUUCAAAAAGAAAAAAA | 24 | 13909 |
| BCL11A-11756 | + | AUGAAAGAUUAUUCAAAA | 18 | 13910 |
| BCL11A-11757 | + | AAUGAAAGAUUAUUCAAAA | 19 | 13911 |
| BCL11A-11758 | + | AAAUGAAAGAUUAUUCAAAA | 20 | 13912 |
| BCL11A-11759 | + | AAAAUGAAAGAUUAUUCAAAA | 21 | 13913 |
| BCL11A-11760 | + | UAAAAUGAAAGAUUAUUCAAAA | 22 | 13914 |
| BCL11A-11761 | + | CUAAAAUGAAAGAUUAUUCAAAA | 23 | 13915 |
| BCL11A-11762 | + | UCUAAAAUGAAAGAUUAUUCAAAA | 24 | 13916 |
| BCL11A-11763 | + | UGCAUUCCUUUUCGAAAA | 18 | 13917 |
| BCL11A-11764 | + | UUGCAUUCCUUUUCGAAAA | 19 | 13918 |
| BCL11A-11765 | + | AUUGCAUUCCUUUUCGAAAA | 20 | 13919 |
| BCL11A-11766 | + | CAUUGCAUUCCUUUUCGAAAA | 21 | 13920 |
| BCL11A-11767 | + | UCAUUGCAUUCCUUUUCGAAAA | 22 | 13921 |
| BCL11A-11768 | + | AUCAUUGCAUUCCUUUUCGAAAA | 23 | 13922 |

TABLE 19E-continued

5th Tier

| gRNA Name | DNA Strand | Targeting Domain | Target Site Length | SEQ ID NO: |
|---|---|---|---|---|
| BCL11A-11769 | + | AAUCAUUGCAUUCCUUUUCGAAAA | 24 | 13923 |
| BCL11A-11770 | + | GCGGCGGAAAGGAGGAAA | 18 | 13924 |
| BCL11A-11771 | + | AGCGGCGGAAAGGAGGAAA | 19 | 13925 |
| BCL11A-11772 | + | AAGCGGCGGAAAGGAGGAAA | 20 | 13926 |
| BCL11A-11773 | + | AAAGCGGCGGAAAGGAGGAAA | 21 | 13927 |
| BCL11A-11774 | + | UAAAGCGGCGGAAAGGAGGAAA | 22 | 13928 |
| BCL11A-11775 | + | AUAAAGCGGCGGAAAGGAGGAAA | 23 | 13929 |
| BCL11A-11776 | + | AAUAAAGCGGCGGAAAGGAGGAAA | 24 | 13930 |
| BCL11A-11777 | + | GCCCGCGCGGCCUGGAAA | 18 | 13931 |
| BCL11A-11778 | + | AGCCCGCGCGGCCUGGAAA | 19 | 13932 |
| BCL11A-11779 | + | GAGCCCGCGCGGCCUGGAAA | 20 | 13933 |
| BCL11A-11780 | + | GGAGCCCGCGCGGCCUGGAAA | 21 | 13934 |
| BCL11A-11781 | + | AGGAGCCCGCGCGGCCUGGAAA | 22 | 13935 |
| BCL11A-11782 | + | CAGGAGCCCGCGCGGCCUGGAAA | 23 | 13936 |
| BCL11A-11783 | + | CCAGGAGCCCGCGCGGCCUGGAAA | 24 | 13937 |
| BCL11A-10371 | + | ACACACGCGGACUCUAAA | 18 | 13938 |
| BCL11A-10372 | + | CACACACGCGGACUCUAAA | 19 | 13939 |
| BCL11A-10373 | + | CCACACACGCGGACUCUAAA | 20 | 13940 |
| BCL11A-10374 | + | CCCACACACGCGGACUCUAAA | 21 | 13941 |
| BCL11A-10375 | + | CCCCACACACGCGGACUCUAAA | 22 | 13942 |
| BCL11A-10376 | + | CCCCCACACACGCGGACUCUAAA | 23 | 13943 |
| BCL11A-10377 | + | CCCCCCACACACGCGGACUCUAAA | 24 | 13944 |
| BCL11A-11784 | + | AUUGCAUUCCUUUUCGAA | 18 | 13945 |
| BCL11A-11785 | + | CAUUGCAUUCCUUUUCGAA | 19 | 13946 |
| BCL11A-11786 | + | UCAUUGCAUUCCUUUUCGAA | 20 | 13947 |
| BCL11A-11787 | + | AUCAUUGCAUUCCUUUUCGAA | 21 | 13948 |
| BCL11A-11788 | + | AAUCAUUGCAUUCCUUUUCGAA | 22 | 13949 |
| BCL11A-11789 | + | GAAUCAUUGCAUUCCUUUUCGAA | 23 | 13950 |
| BCL11A-11790 | + | GGAAUCAUUGCAUUCCUUUUCGAA | 24 | 13951 |
| BCL11A-11791 | + | AGAAAUAAAGCGGCGGAA | 18 | 13952 |
| BCL11A-11792 | + | GAGAAAUAAAGCGGCGGAA | 19 | 13953 |
| BCL11A-10031 | + | AGAGAAAUAAAGCGGCGGAA | 20 | 13954 |
| BCL11A-11793 | + | AAGAGAAAUAAAGCGGCGGAA | 21 | 13955 |
| BCL11A-11794 | + | AAAGAGAAAUAAAGCGGCGGAA | 22 | 13956 |
| BCL11A-11795 | + | AAAAGAGAAAUAAAGCGGCGGAA | 23 | 13957 |
| BCL11A-11796 | + | GAAAAGAGAAAUAAAGCGGCGGAA | 24 | 13958 |
| BCL11A-11797 | + | CCCGAGGAGAGGACAGCA | 18 | 13959 |

TABLE 19E-continued

5th Tier

| gRNA Name | DNA Strand | Targeting Domain | Target Site Length | SEQ ID NO: |
|---|---|---|---|---|
| BCL11A-11798 | + | GCCCGAGGAGAGGACAGCA | 19 | 13960 |
| BCL11A-11799 | + | UGCCCGAGGAGAGGACAGCA | 20 | 13961 |
| BCL11A-11800 | + | UUGCCCGAGGAGAGGACAGCA | 21 | 13962 |
| BCL11A-11801 | + | UUUGCCCGAGGAGAGGACAGCA | 22 | 13963 |
| BCL11A-11802 | + | CUUUGCCCGAGGAGAGGACAGCA | 23 | 13964 |
| BCL11A-11803 | + | ACUUUGCCCGAGGAGAGGACAGCA | 24 | 13965 |
| BCL11A-11804 | + | CCAAGUUACAGCUCCGCA | 18 | 13966 |
| BCL11A-11805 | + | UCCAAGUUACAGCUCCGCA | 19 | 13967 |
| BCL11A-11806 | + | CUCCAAGUUACAGCUCCGCA | 20 | 13968 |
| BCL11A-11807 | + | CCUCCAAGUUACAGCUCCGCA | 21 | 13969 |
| BCL11A-11808 | + | GCCUCCAAGUUACAGCUCCGCA | 22 | 13970 |
| BCL11A-11809 | + | AGCCUCCAAGUUACAGCUCCGCA | 23 | 13971 |
| BCL11A-11810 | + | GAGCCUCCAAGUUACAGCUCCGCA | 24 | 13972 |
| BCL11A-11811 | + | GAGCCGGCACAAAAGGCA | 18 | 13973 |
| BCL11A-11812 | + | GGAGCCGGCACAAAAGGCA | 19 | 13974 |
| BCL11A-11813 | + | AGGAGCCGGCACAAAAGGCA | 20 | 13975 |
| BCL11A-11814 | + | GAGGAGCCGGCACAAAAGGCA | 21 | 13976 |
| BCL11A-11815 | + | CGAGGAGCCGGCACAAAAGGCA | 22 | 13977 |
| BCL11A-11816 | + | GCGAGGAGCCGGCACAAAAGGCA | 23 | 13978 |
| BCL11A-11817 | + | CGCGAGGAGCCGGCACAAAAGGCA | 24 | 13979 |
| BCL11A-11818 | + | AAAUAGAGCGAGAGUGCA | 18 | 13980 |
| BCL11A-11819 | + | AAAAUAGAGCGAGAGUGCA | 19 | 13981 |
| BCL11A-11820 | + | AAAAAUAGAGCGAGAGUGCA | 20 | 13982 |
| BCL11A-11821 | + | AAAAAAUAGAGCGAGAGUGCA | 21 | 13983 |
| BCL11A-11822 | + | AAAAAAAUAGAGCGAGAGUGCA | 22 | 13984 |
| BCL11A-11823 | + | GAAAAAAAUAGAGCGAGAGUGCA | 23 | 13985 |
| BCL11A-11824 | + | AGAAAAAAAUAGAGCGAGAGUGCA | 24 | 13986 |
| BCL11A-11825 | + | CCGCGCGGCCUGGAAAGA | 18 | 13987 |
| BCL11A-11826 | + | CCCGCGCGGCCUGGAAAGA | 19 | 13988 |
| BCL11A-10040 | + | GCCCGCGCGGCCUGGAAAGA | 20 | 13989 |
| BCL11A-11827 | + | AGCCCGCGCGGCCUGGAAAGA | 21 | 13990 |
| BCL11A-11828 | + | GAGCCCGCGCGGCCUGGAAAGA | 22 | 13991 |
| BCL11A-11829 | + | GGAGCCCGCGCGGCCUGGAAAGA | 23 | 13992 |
| BCL11A-11830 | + | AGGAGCCCGCGCGGCCUGGAAAGA | 24 | 13993 |
| BCL11A-11831 | + | AAAAAAGAAAAAAAUAGA | 18 | 13994 |
| BCL11A-11832 | + | CAAAAAAGAAAAAAAUAGA | 19 | 13995 |
| BCL11A-11833 | + | UCAAAAAAGAAAAAAAUAGA | 20 | 13996 |

TABLE 19E-continued

5th Tier

| gRNA Name | DNA Strand | Targeting Domain | Target Site Length | SEQ ID NO: |
|---|---|---|---|---|
| BCL11A-11834 | + | UUCAAAAAGAAAAAAUAGA | 21 | 13997 |
| BCL11A-11835 | + | AUUCAAAAAGAAAAAAUAGA | 22 | 13998 |
| BCL11A-11836 | + | UAUUCAAAAAGAAAAAAUAGA | 23 | 13999 |
| BCL11A-11837 | + | UUAUUCAAAAAGAAAAAAUAGA | 24 | 14000 |
| BCL11A-11838 | + | CAGCUCCGCAGCGGGCGA | 18 | 14001 |
| BCL11A-11839 | + | ACAGCUCCGCAGCGGGCGA | 19 | 14002 |
| BCL11A-10044 | + | UACAGCUCCGCAGCGGGCGA | 20 | 14003 |
| BCL11A-11840 | + | UUACAGCUCCGCAGCGGGCGA | 21 | 14004 |
| BCL11A-11841 | + | GUUACAGCUCCGCAGCGGGCGA | 22 | 14005 |
| BCL11A-11842 | + | AGUUACAGCUCCGCAGCGGGCGA | 23 | 14006 |
| BCL11A-11843 | + | AAGUUACAGCUCCGCAGCGGGCGA | 24 | 14007 |
| BCL11A-11844 | + | GGAAACUUUGCCCGAGGA | 18 | 14008 |
| BCL11A-11845 | + | GGGAAACUUUGCCCGAGGA | 19 | 14009 |
| BCL11A-11846 | + | CGGGAAACUUUGCCCGAGGA | 20 | 14010 |
| BCL11A-11847 | + | UCGGGAAACUUUGCCCGAGGA | 21 | 14011 |
| BCL11A-11848 | + | CUCGGGAAACUUUGCCCGAGGA | 22 | 14012 |
| BCL11A-11849 | + | GCUCGGGAAACUUUGCCCGAGGA | 23 | 14013 |
| BCL11A-11850 | + | CGCUCGGGAAACUUUGCCCGAGGA | 24 | 14014 |
| BCL11A-11851 | + | AAGCGGCGGAAAGGAGGA | 18 | 14015 |
| BCL11A-11852 | + | AAAGCGGCGGAAAGGAGGA | 19 | 14016 |
| BCL11A-11853 | + | UAAAGCGGCGGAAAGGAGGA | 20 | 14017 |
| BCL11A-11854 | + | AUAAAGCGGCGGAAAGGAGGA | 21 | 14018 |
| BCL11A-11855 | + | AAUAAAGCGGCGGAAAGGAGGA | 22 | 14019 |
| BCL11A-11856 | + | AAAUAAAGCGGCGGAAAGGAGGA | 23 | 14020 |
| BCL11A-11857 | + | GAAAUAAAGCGGCGGAAAGGAGGA | 24 | 14021 |
| BCL11A-11858 | + | GAGAAAUAAAGCGGCGGA | 18 | 14022 |
| BCL11A-11859 | + | AGAGAAAUAAAGCGGCGGA | 19 | 14023 |
| BCL11A-11860 | + | AAGAGAAAUAAAGCGGCGGA | 20 | 14024 |
| BCL11A-11861 | + | AAAGAGAAAUAAAGCGGCGGA | 21 | 14025 |
| BCL11A-11862 | + | AAAAGAGAAAUAAAGCGGCGGA | 22 | 14026 |
| BCL11A-11863 | + | GAAAAGAGAAAUAAAGCGGCGGA | 23 | 14027 |
| BCL11A-11864 | + | CGAAAAGAGAAAUAAAGCGGCGGA | 24 | 14028 |
| BCL11A-11865 | + | UGGGGAAGCGCGGGCGGA | 18 | 14029 |
| BCL11A-11866 | + | CUGGGGAAGCGCGGGCGGA | 19 | 14030 |
| BCL11A-10048 | + | GCUGGGGAAGCGCGGGCGGA | 20 | 14031 |
| BCL11A-11867 | + | GGCUGGGGAAGCGCGGGCGGA | 21 | 14032 |
| BCL11A-11868 | + | GGGCUGGGGAAGCGCGGGCGGA | 22 | 14033 |

TABLE 19E-continued

5th Tier

| gRNA Name | DNA Strand | Targeting Domain | Target Site Length | SEQ ID NO: |
|---|---|---|---|---|
| BCL11A-11869 | + | CGGGCUGGGGAAGCGCGGGCGGA | 23 | 14034 |
| BCL11A-11870 | + | CCGGGCUGGGGAAGCGCGGGCGGA | 24 | 14035 |
| BCL11A-11871 | + | CCAAGGCCGAGCCAGGGA | 18 | 14036 |
| BCL11A-11872 | + | CCCAAGGCCGAGCCAGGGA | 19 | 14037 |
| BCL11A-11873 | + | CCCCAAGGCCGAGCCAGGGA | 20 | 14038 |
| BCL11A-11874 | + | CCCCCAAGGCCGAGCCAGGGA | 21 | 14039 |
| BCL11A-11875 | + | GCCCCCAAGGCCGAGCCAGGGA | 22 | 14040 |
| BCL11A-11876 | + | CGCCCCCAAGGCCGAGCCAGGGA | 23 | 14041 |
| BCL11A-11877 | + | GCGCCCCCAAGGCCGAGCCAGGGA | 24 | 14042 |
| BCL11A-11878 | + | CGGCCUGGAAAGAGGGGA | 18 | 14043 |
| BCL11A-11879 | + | GCGGCCUGGAAAGAGGGGA | 19 | 14044 |
| BCL11A-11880 | + | CGCGGCCUGGAAAGAGGGGA | 20 | 14045 |
| BCL11A-11881 | + | GCGCGGCCUGGAAAGAGGGGA | 21 | 14046 |
| BCL11A-11882 | + | CGCGCGGCCUGGAAAGAGGGGA | 22 | 14047 |
| BCL11A-11883 | + | CCGCGCGGCCUGGAAAGAGGGGA | 23 | 14048 |
| BCL11A-11884 | + | CCCGCGCGGCCUGGAAAGAGGGGA | 24 | 14049 |
| BCL11A-11885 | + | UGGCGGGGCGGGGGGGA | 18 | 14050 |
| BCL11A-11886 | + | CUGGCGGGGCGGGGGGGA | 19 | 14051 |
| BCL11A-11887 | + | ACUGGCGGGGCGGGGGGGA | 20 | 14052 |
| BCL11A-11888 | + | AACUGGCGGGGCGGGGGGGA | 21 | 14053 |
| BCL11A-11889 | + | AAACUGGCGGGGCGGGGGGGA | 22 | 14054 |
| BCL11A-11890 | + | AAAACUGGCGGGGCGGGGGGGA | 23 | 14055 |
| BCL11A-11891 | + | CAAAACUGGCGGGGCGGGGGGGA | 24 | 14056 |
| BCL11A-11892 | + | GGGCGAGGGGAGGUGGGA | 18 | 14057 |
| BCL11A-11893 | + | CGGGCGAGGGGAGGUGGGA | 19 | 14058 |
| BCL11A-10052 | + | GCGGGCGAGGGGAGGUGGGA | 20 | 14059 |
| BCL11A-11894 | + | AGCGGGCGAGGGGAGGUGGGA | 21 | 14060 |
| BCL11A-11895 | + | CAGCGGGCGAGGGGAGGUGGGA | 22 | 14061 |
| BCL11A-11896 | + | GCAGCGGGCGAGGGGAGGUGGGA | 23 | 14062 |
| BCL11A-11897 | + | CGCAGCGGGCGAGGGGAGGUGGGA | 24 | 14063 |
| BCL11A-11898 | + | GAGCCCGCGCGGCCUGGA | 18 | 14064 |
| BCL11A-11899 | + | GGAGCCCGCGCGGCCUGGA | 19 | 14065 |
| BCL11A-11900 | + | AGGAGCCCGCGCGGCCUGGA | 20 | 14066 |
| BCL11A-11901 | + | CAGGAGCCCGCGCGGCCUGGA | 21 | 14067 |
| BCL11A-11902 | + | CCAGGAGCCCGCGCGGCCUGGA | 22 | 14068 |
| BCL11A-11903 | + | UCCAGGAGCCCGCGCGGCCUGGA | 23 | 14069 |
| BCL11A-11904 | + | CUCCAGGAGCCCGCGCGGCCUGGA | 24 | 14070 |

TABLE 19E-continued

5th Tier

| gRNA Name | DNA Strand | Targeting Domain | Target Site Length | SEQ ID NO: |
|---|---|---|---|---|
| BCL11A-11905 | + | CCCAUUUCUUACGGUGA | 18 | 14071 |
| BCL11A-11906 | + | CCCCAUUUCUUACGGUGA | 19 | 14072 |
| BCL11A-11907 | + | CCCCCAUUUCUUACGGUGA | 20 | 14073 |
| BCL11A-11908 | + | CCCCCCAUUUCUUACGGUGA | 21 | 14074 |
| BCL11A-11909 | + | CCCCCCCAUUUCUUACGGUGA | 22 | 14075 |
| BCL11A-11910 | + | ACCCCCCCAUUUCUUACGGUGA | 23 | 14076 |
| BCL11A-11911 | + | UACCCCCCCAUUUCUUACGGUGA | 24 | 14077 |
| BCL11A-11912 | + | GAGGGAGCGCACGGCAAC | 18 | 14078 |
| BCL11A-11913 | + | GGAGGGAGCGCACGGCAAC | 19 | 14079 |
| BCL11A-11914 | + | GGGAGGGAGCGCACGGCAAC | 20 | 14080 |
| BCL11A-11915 | + | UGGGAGGGAGCGCACGGCAAC | 21 | 14081 |
| BCL11A-11916 | + | GUGGGAGGGAGCGCACGGCAAC | 22 | 14082 |
| BCL11A-11917 | + | GGUGGGAGGGAGCGCACGGCAAC | 23 | 14083 |
| BCL11A-11918 | + | AGGUGGGAGGGAGCGCACGGCAAC | 24 | 14084 |
| BCL11A-10612 | + | CUGCUCCCCCCCACACAC | 18 | 14085 |
| BCL11A-10613 | + | CCUGCUCCCCCCCACACAC | 19 | 14086 |
| BCL11A-10614 | + | CCCUGCUCCCCCCCACACAC | 20 | 14087 |
| BCL11A-10615 | + | GCCCUGCUCCCCCCCACACAC | 21 | 14088 |
| BCL11A-10616 | + | CGCCCUGCUCCCCCCCACACAC | 22 | 14089 |
| BCL11A-10617 | + | GCGCCCUGCUCCCCCCCACACAC | 23 | 14090 |
| BCL11A-10618 | + | UGCGCCCUGCUCCCCCCCACACAC | 24 | 14091 |
| BCL11A-11919 | + | AAUAGAGCGAGAGUGCAC | 18 | 14092 |
| BCL11A-11920 | + | AAAUAGAGCGAGAGUGCAC | 19 | 14093 |
| BCL11A-10059 | + | AAAAUAGAGCGAGAGUGCAC | 20 | 14094 |
| BCL11A-11921 | + | AAAAAUAGAGCGAGAGUGCAC | 21 | 14095 |
| BCL11A-11922 | + | AAAAAAUAGAGCGAGAGUGCAC | 22 | 14096 |
| BCL11A-11923 | + | AAAAAAAUAGAGCGAGAGUGCAC | 23 | 14097 |
| BCL11A-11924 | + | GAAAAAAAUAGAGCGAGAGUGCAC | 24 | 14098 |
| BCL11A-11925 | + | ACAGCAAAGAAAAAUCAC | 18 | 14099 |
| BCL11A-11926 | + | GACAGCAAAGAAAAAUCAC | 19 | 14100 |
| BCL11A-11927 | + | GGACAGCAAAGAAAAAUCAC | 20 | 14101 |
| BCL11A-11928 | + | AGGACAGCAAAGAAAAAUCAC | 21 | 14102 |
| BCL11A-11929 | + | GAGGACAGCAAAGAAAAAUCAC | 22 | 14103 |
| BCL11A-11930 | + | AGAGGACAGCAAAGAAAAAUCAC | 23 | 14104 |
| BCL11A-11931 | + | GAGAGGACAGCAAAGAAAAAUCAC | 24 | 14105 |
| BCL11A-11932 | + | CAAGGCCGAGCCAGGGAC | 18 | 14106 |
| BCL11A-11933 | + | CCAAGGCCGAGCCAGGGAC | 19 | 14107 |

TABLE 19E-continued

5th Tier

| gRNA Name | DNA Strand | Targeting Domain | Target Site Length | SEQ ID NO: |
|---|---|---|---|---|
| BCL11A-10063 | + | CCCAAGGCCGAGCCAGGGAC | 20 | 14108 |
| BCL11A-11934 | + | CCCCAAGGCCGAGCCAGGGAC | 21 | 14109 |
| BCL11A-11935 | + | CCCCCAAGGCCGAGCCAGGGAC | 22 | 14110 |
| BCL11A-11936 | + | GCCCCCAAGGCCGAGCCAGGGAC | 23 | 14111 |
| BCL11A-11937 | + | CGCCCCCAAGGCCGAGCCAGGGAC | 24 | 14112 |
| BCL11A-11938 | + | GGCCUGGAAAGAGGGGAC | 18 | 14113 |
| BCL11A-11939 | + | CGGCCUGGAAAGAGGGGAC | 19 | 14114 |
| BCL11A-10064 | + | GCGGCCUGGAAAGAGGGGAC | 20 | 14115 |
| BCL11A-11940 | + | CGCGGCCUGGAAAGAGGGGAC | 21 | 14116 |
| BCL11A-11941 | + | GCGCGGCCUGGAAAGAGGGGAC | 22 | 14117 |
| BCL11A-11942 | + | CGCGCGGCCUGGAAAGAGGGGAC | 23 | 14118 |
| BCL11A-11943 | + | CCGCGCGGCCUGGAAAGAGGGGAC | 24 | 14119 |
| BCL11A-11944 | + | AUAGAGCGAGAGUGCACC | 18 | 14120 |
| BCL11A-11945 | + | AAUAGAGCGAGAGUGCACC | 19 | 14121 |
| BCL11A-10067 | + | AAAUAGAGCGAGAGUGCACC | 20 | 14122 |
| BCL11A-11946 | + | AAAAUAGAGCGAGAGUGCACC | 21 | 14123 |
| BCL11A-11947 | + | AAAAAUAGAGCGAGAGUGCACC | 22 | 14124 |
| BCL11A-11948 | + | AAAAAAUAGAGCGAGAGUGCACC | 23 | 14125 |
| BCL11A-11949 | + | AAAAAAAUAGAGCGAGAGUGCACC | 24 | 14126 |
| BCL11A-11950 | + | AAGGCCGAGCCAGGGACC | 18 | 14127 |
| BCL11A-11951 | + | CAAGGCCGAGCCAGGGACC | 19 | 14128 |
| BCL11A-10068 | + | CCAAGGCCGAGCCAGGGACC | 20 | 14129 |
| BCL11A-11952 | + | CCCAAGGCCGAGCCAGGGACC | 21 | 14130 |
| BCL11A-11953 | + | CCCCAAGGCCGAGCCAGGGACC | 22 | 14131 |
| BCL11A-11954 | + | CCCCCAAGGCCGAGCCAGGGACC | 23 | 14132 |
| BCL11A-11955 | + | GCCCCCAAGGCCGAGCCAGGGACC | 24 | 14133 |
| BCL11A-11956 | + | GCCUGGAAAGAGGGGACC | 18 | 14134 |
| BCL11A-11957 | + | GGCCUGGAAAGAGGGGACC | 19 | 14135 |
| BCL11A-10069 | + | CGGCCUGGAAAGAGGGGACC | 20 | 14136 |
| BCL11A-11958 | + | GCGGCCUGGAAAGAGGGGACC | 21 | 14137 |
| BCL11A-11959 | + | CGCGGCCUGGAAAGAGGGGACC | 22 | 14138 |
| BCL11A-11960 | + | GCGCGGCCUGGAAAGAGGGGACC | 23 | 14139 |
| BCL11A-11961 | + | CGCGCGGCCUGGAAAGAGGGGACC | 24 | 14140 |
| BCL11A-11962 | + | CCCGCUGCACACUUGACC | 18 | 14141 |
| BCL11A-11963 | + | UCCCGCUGCACACUUGACC | 19 | 14142 |
| BCL11A-11964 | + | CUCCCGCUGCACACUUGACC | 20 | 14143 |
| BCL11A-11965 | + | CCUCCCGCUGCACACUUGACC | 21 | 14144 |

TABLE 19E-continued

5th Tier

| gRNA Name | DNA Strand | Targeting Domain | Target Site Length | SEQ ID NO: |
|---|---|---|---|---|
| BCL11A-11966 | + | UCCUCCCGCUGCACACUUGACC | 22 | 14145 |
| BCL11A-11967 | + | UUCCUCCCGCUGCACACUUGACC | 23 | 14146 |
| BCL11A-11968 | + | UUUCCUCCCGCUGCACACUUGACC | 24 | 14147 |
| BCL11A-11969 | + | CGGCGCAGGCCGGGGCCC | 18 | 14148 |
| BCL11A-11970 | + | GCGGCGCAGGCCGGGGCCC | 19 | 14149 |
| BCL11A-11971 | + | GGCGGCGCAGGCCGGGGCCC | 20 | 14150 |
| BCL11A-11972 | + | AGGCGGCGCAGGCCGGGGCCC | 21 | 14151 |
| BCL11A-11973 | + | CAGGCGGCGCAGGCCGGGGCCC | 22 | 14152 |
| BCL11A-11974 | + | GCAGGCGGCGCAGGCCGGGGCCC | 23 | 14153 |
| BCL11A-11975 | + | GGCAGGCGGCGCAGGCCGGGGCCC | 24 | 14154 |
| BCL11A-11976 | + | GCUCGGGAAACUUUGCCC | 18 | 14155 |
| BCL11A-11977 | + | CGCUCGGGAAACUUUGCCC | 19 | 14156 |
| BCL11A-11978 | + | GCGCUCGGGAAACUUUGCCC | 20 | 14157 |
| BCL11A-11979 | + | UGCGCUCGGGAAACUUUGCCC | 21 | 14158 |
| BCL11A-11980 | + | CUGCGCUCGGGAAACUUUGCCC | 22 | 14159 |
| BCL11A-11981 | + | GCUGCGCUCGGGAAACUUUGCCC | 23 | 14160 |
| BCL11A-11982 | + | GGCUGCGCUCGGGAAACUUUGCCC | 24 | 14161 |
| BCL11A-11983 | + | UCUCACCUCUUUUCUCCC | 18 | 14162 |
| BCL11A-11984 | + | GUCUCACCUCUUUUCUCCC | 19 | 14163 |
| BCL11A-10081 | + | AGUCUCACCUCUUUUCUCCC | 20 | 14164 |
| BCL11A-11985 | + | CAGUCUCACCUCUUUUCUCCC | 21 | 14165 |
| BCL11A-11986 | + | CCAGUCUCACCUCUUUUCUCCC | 22 | 14166 |
| BCL11A-11987 | + | GCCAGUCUCACCUCUUUUCUCCC | 23 | 14167 |
| BCL11A-11988 | + | AGCCAGUCUCACCUCUUUUCUCCC | 24 | 14168 |
| BCL11A-11989 | + | GGGGCCGAAGUAAAAGCC | 18 | 14169 |
| BCL11A-11990 | + | AGGGGCCGAAGUAAAAGCC | 19 | 14170 |
| BCL11A-11991 | + | CAGGGGCCGAAGUAAAAGCC | 20 | 14171 |
| BCL11A-11992 | + | CCAGGGGCCGAAGUAAAAGCC | 21 | 14172 |
| BCL11A-11993 | + | GCCAGGGGCCGAAGUAAAAGCC | 22 | 14173 |
| BCL11A-11994 | + | CGCCAGGGGCCGAAGUAAAAGCC | 23 | 14174 |
| BCL11A-11995 | + | ACGCCAGGGGCCGAAGUAAAAGCC | 24 | 14175 |
| BCL11A-11996 | + | CACCGGGAGGCUGCAGCC | 18 | 14176 |
| BCL11A-11997 | + | GCACCGGGAGGCUGCAGCC | 19 | 14177 |
| BCL11A-11998 | + | UGCACCGGGAGGCUGCAGCC | 20 | 14178 |
| BCL11A-11999 | + | GUGCACCGGGAGGCUGCAGCC | 21 | 14179 |
| BCL11A-12000 | + | AGUGCACCGGGAGGCUGCAGCC | 22 | 14180 |
| BCL11A-12001 | + | GAGUGCACCGGGAGGCUGCAGCC | 23 | 14181 |

TABLE 19E-continued

5th Tier

| gRNA Name | DNA Strand | Targeting Domain | Target Site Length | SEQ ID NO: |
|---|---|---|---|---|
| BCL11A-12002 | + | AGAGUGCACCGGGAGGCUGCAGCC | 24 | 14182 |
| BCL11A-12003 | + | CGCCCCAAGGCCGAGCC | 18 | 14183 |
| BCL11A-12004 | + | GCGCCCCAAGGCCGAGCC | 19 | 14184 |
| BCL11A-10085 | + | GGCGCCCCAAGGCCGAGCC | 20 | 14185 |
| BCL11A-12005 | + | GGGCGCCCCAAGGCCGAGCC | 21 | 14186 |
| BCL11A-12006 | + | AGGGCGCCCCAAGGCCGAGCC | 22 | 14187 |
| BCL11A-12007 | + | GAGGGCGCCCCAAGGCCGAGCC | 23 | 14188 |
| BCL11A-12008 | + | CGAGGGCGCCCCAAGGCCGAGCC | 24 | 14189 |
| BCL11A-12009 | + | UCCCCGCGUGUGGACGCC | 18 | 14190 |
| BCL11A-12010 | + | CUCCCCGCGUGUGGACGCC | 19 | 14191 |
| BCL11A-10086 | + | GCUCCCCGCGUGUGGACGCC | 20 | 14192 |
| BCL11A-12011 | + | CGCUCCCCGCGUGUGGACGCC | 21 | 14193 |
| BCL11A-12012 | + | UCGCUCCCCGCGUGUGGACGCC | 22 | 14194 |
| BCL11A-12013 | + | CUCGCUCCCCGCGUGUGGACGCC | 23 | 14195 |
| BCL11A-12014 | + | GCUCGCUCCCCGCGUGUGGACGCC | 24 | 14196 |
| BCL11A-12015 | + | CGCGGACUCAGGAGCGCC | 18 | 14197 |
| BCL11A-12016 | + | CCGCGGACUCAGGAGCGCC | 19 | 14198 |
| BCL11A-10087 | + | UCCGCGGACUCAGGAGCGCC | 20 | 14199 |
| BCL11A-12017 | + | CUCCGCGGACUCAGGAGCGCC | 21 | 14200 |
| BCL11A-12018 | + | ACUCCGCGGACUCAGGAGCGCC | 22 | 14201 |
| BCL11A-12019 | + | GACUCCGCGGACUCAGGAGCGCC | 23 | 14202 |
| BCL11A-12020 | + | CGACUCCGCGGACUCAGGAGCGCC | 24 | 14203 |
| BCL11A-12021 | + | CCAGGAGCCCGCGCGGCC | 18 | 14204 |
| BCL11A-12022 | + | UCCAGGAGCCCGCGCGGCC | 19 | 14205 |
| BCL11A-10089 | + | CUCCAGGAGCCCGCGCGGCC | 20 | 14206 |
| BCL11A-12023 | + | UCUCCAGGAGCCCGCGCGGCC | 21 | 14207 |
| BCL11A-12024 | + | GUCUCCAGGAGCCCGCGCGGCC | 22 | 14208 |
| BCL11A-12025 | + | AGUCUCCAGGAGCCCGCGCGGCC | 23 | 14209 |
| BCL11A-12026 | + | AAGUCUCCAGGAGCCCGCGCGGCC | 24 | 14210 |
| BCL11A-12027 | + | GGCCCCUCUCCCGACUCC | 18 | 14211 |
| BCL11A-12028 | + | CGGCCCCUCUCCCGACUCC | 19 | 14212 |
| BCL11A-12029 | + | GCGGCCCCUCUCCCGACUCC | 20 | 14213 |
| BCL11A-12030 | + | CGCGGCCCCUCUCCCGACUCC | 21 | 14214 |
| BCL11A-12031 | + | CCGCGGCCCCUCUCCCGACUCC | 22 | 14215 |
| BCL11A-12032 | + | GCCGCGGCCCCUCUCCCGACUCC | 23 | 14216 |
| BCL11A-12033 | + | CGCCGCGGCCCCUCUCCCGACUCC | 24 | 14217 |
| BCL11A-12034 | + | GGCAGCGCCCAAGUCUCC | 18 | 14218 |

TABLE 19E-continued

5th Tier

| gRNA Name | DNA Strand | Targeting Domain | Target Site Length | SEQ ID NO: |
|---|---|---|---|---|
| BCL11A-12035 | + | GGGCAGCGCCCAAGUCUCC | 19 | 14219 |
| BCL11A-10093 | + | AGGGCAGCGCCCAAGUCUCC | 20 | 14220 |
| BCL11A-12036 | + | AAGGGCAGCGCCCAAGUCUCC | 21 | 14221 |
| BCL11A-12037 | + | GAAGGGCAGCGCCCAAGUCUCC | 22 | 14222 |
| BCL11A-12038 | + | GGAAGGGCAGCGCCCAAGUCUCC | 23 | 14223 |
| BCL11A-12039 | + | CGGAAGGGCAGCGCCCAAGUCUCC | 24 | 14224 |
| BCL11A-12040 | + | GUCUCACCUCUUUUCUCC | 18 | 14225 |
| BCL11A-12041 | + | AGUCUCACCUCUUUUCUCC | 19 | 14226 |
| BCL11A-12042 | + | CAGUCUCACCUCUUUUCUCC | 20 | 14227 |
| BCL11A-12043 | + | CCAGUCUCACCUCUUUUCUCC | 21 | 14228 |
| BCL11A-12044 | + | GCCAGUCUCACCUCUUUUCUCC | 22 | 14229 |
| BCL11A-12045 | + | AGCCAGUCUCACCUCUUUUCUCC | 23 | 14230 |
| BCL11A-12046 | + | AAGCCAGUCUCACCUCUUUUCUCC | 24 | 14231 |
| BCL11A-12047 | + | CGGCGCGGGAGGGCAAGC | 18 | 14232 |
| BCL11A-12048 | + | GCGGCGCGGGAGGGCAAGC | 19 | 14233 |
| BCL11A-12049 | + | GGCGGCGCGGGAGGGCAAGC | 20 | 14234 |
| BCL11A-12050 | + | GCCCCGGGCUGGGGAAGC | 18 | 14235 |
| BCL11A-12051 | + | AGCCCCGGGCUGGGGAAGC | 19 | 14236 |
| BCL11A-12052 | + | CAGCCCCGGGCUGGGGAAGC | 20 | 14237 |
| BCL11A-12053 | + | GCAGCCCCGGGCUGGGGAAGC | 21 | 14238 |
| BCL11A-12054 | + | UGCAGCCCCGGGCUGGGGAAGC | 22 | 14239 |
| BCL11A-12055 | + | CUGCAGCCCCGGGCUGGGGAAGC | 23 | 14240 |
| BCL11A-12056 | + | GCUGCAGCCCCGGGCUGGGGAAGC | 24 | 14241 |
| BCL11A-12057 | + | GCGCCCCCAAGGCCGAGC | 18 | 14242 |
| BCL11A-12058 | + | GGCGCCCCCAAGGCCGAGC | 19 | 14243 |
| BCL11A-12059 | + | GGGCGCCCCCAAGGCCGAGC | 20 | 14244 |
| BCL11A-12060 | + | AGGGCGCCCCCAAGGCCGAGC | 21 | 14245 |
| BCL11A-12061 | + | GAGGGCGCCCCCAAGGCCGAGC | 22 | 14246 |
| BCL11A-12062 | + | CGAGGGCGCCCCCAAGGCCGAGC | 23 | 14247 |
| BCL11A-12063 | + | CCGAGGGCGCCCCCAAGGCCGAGC | 24 | 14248 |
| BCL11A-12064 | + | CUCCCCGCGUGUGGACGC | 18 | 14249 |
| BCL11A-12065 | + | GCUCCCCGCGUGUGGACGC | 19 | 14250 |
| BCL11A-12066 | + | CGCUCCCCGCGUGUGGACGC | 20 | 14251 |
| BCL11A-12067 | + | UCGCUCCCCGCGUGUGGACGC | 21 | 14252 |
| BCL11A-12068 | + | CUCGCUCCCCGCGUGUGGACGC | 22 | 14253 |
| BCL11A-12069 | + | GCUCGCUCCCCGCGUGUGGACGC | 23 | 14254 |
| BCL11A-12070 | + | CGCUCGCUCCCCGCGUGUGGACGC | 24 | 14255 |

TABLE 19E-continued

5th Tier

| gRNA Name | DNA Strand | Targeting Domain | Target Site Length | SEQ ID NO: |
|---|---|---|---|---|
| BCL11A-12071 | + | GCGCGGGAGGGCAAGCGC | 18 | 14256 |
| BCL11A-12072 | + | GGCGCGGGAGGGCAAGCGC | 19 | 14257 |
| BCL11A-12073 | + | CGGCGCGGGAGGGCAAGCGC | 20 | 14258 |
| BCL11A-12074 | + | CCGCGGACUCAGGAGCGC | 18 | 14259 |
| BCL11A-12075 | + | UCCGCGGACUCAGGAGCGC | 19 | 14260 |
| BCL11A-10106 | + | CUCCGCGGACUCAGGAGCGC | 20 | 14261 |
| BCL11A-12076 | + | ACUCCGCGGACUCAGGAGCGC | 21 | 14262 |
| BCL11A-12077 | + | GACUCCGCGGACUCAGGAGCGC | 22 | 14263 |
| BCL11A-12078 | + | CGACUCCGCGGACUCAGGAGCGC | 23 | 14264 |
| BCL11A-12079 | + | CCGACUCCGCGGACUCAGGAGCGC | 24 | 14265 |
| BCL11A-12080 | + | CCGAGCCCGCGGCUGCGC | 18 | 14266 |
| BCL11A-12081 | + | CCCGAGCCCGCGGCUGCGC | 19 | 14267 |
| BCL11A-12082 | + | CCCCGAGCCCGCGGCUGCGC | 20 | 14268 |
| BCL11A-12083 | + | GCCCCGAGCCCGCGGCUGCGC | 21 | 14269 |
| BCL11A-12084 | + | AGCCCCGAGCCCGCGGCUGCGC | 22 | 14270 |
| BCL11A-12085 | + | AAGCCCCGAGCCCGCGGCUGCGC | 23 | 14271 |
| BCL11A-12086 | + | AAAGCCCCGAGCCCGCGGCUGCGC | 24 | 14272 |
| BCL11A-12087 | + | GAGGCAGGCGGCGCAGGC | 18 | 14273 |
| BCL11A-12088 | + | AGAGGCAGGCGGCGCAGGC | 19 | 14274 |
| BCL11A-10110 | + | GAGAGGCAGGCGGCGCAGGC | 20 | 14275 |
| BCL11A-12089 | + | GGAGAGGCAGGCGGCGCAGGC | 21 | 14276 |
| BCL11A-12090 | + | GGGAGAGGCAGGCGGCGCAGGC | 22 | 14277 |
| BCL11A-12091 | + | GGGGAGAGGCAGGCGGCGCAGGC | 23 | 14278 |
| BCL11A-12092 | + | CGGGGAGAGGCAGGCGGCGCAGGC | 24 | 14279 |
| BCL11A-12093 | + | UCCAGGAGCCCGCGCGGC | 18 | 14280 |
| BCL11A-12094 | + | CUCCAGGAGCCCGCGCGGC | 19 | 14281 |
| BCL11A-12095 | + | UCUCCAGGAGCCCGCGCGGC | 20 | 14282 |
| BCL11A-12096 | + | GUCUCCAGGAGCCCGCGCGGC | 21 | 14283 |
| BCL11A-12097 | + | AGUCUCCAGGAGCCCGCGCGGC | 22 | 14284 |
| BCL11A-12098 | + | AAGUCUCCAGGAGCCCGCGCGGC | 23 | 14285 |
| BCL11A-12099 | + | CAAGUCUCCAGGAGCCCGCGCGGC | 24 | 14286 |
| BCL11A-12100 | + | GAGGCUGCAGCCCCGGGC | 18 | 14287 |
| BCL11A-12101 | + | GGAGGCUGCAGCCCCGGGC | 19 | 14288 |
| BCL11A-10115 | + | GGGAGGCUGCAGCCCCGGGC | 20 | 14289 |
| BCL11A-12102 | + | CGGGAGGCUGCAGCCCCGGGC | 21 | 14290 |
| BCL11A-12103 | + | CCGGGAGGCUGCAGCCCCGGGC | 22 | 14291 |
| BCL11A-12104 | + | ACCGGGAGGCUGCAGCCCCGGGC | 23 | 14292 |

TABLE 19E-continued

5th Tier

| gRNA Name | DNA Strand | Targeting Domain | Target Site Length | SEQ ID NO: |
|---|---|---|---|---|
| BCL11A-12105 | + | CACCGGGAGGCUGCAGCCCCGGGC | 24 | 14293 |
| BCL11A-12106 | + | UACAGCUCCGCAGCGGGC | 18 | 14294 |
| BCL11A-12107 | + | UUACAGCUCCGCAGCGGGC | 19 | 14295 |
| BCL11A-12108 | + | GUUACAGCUCCGCAGCGGGC | 20 | 14296 |
| BCL11A-12109 | + | AGUUACAGCUCCGCAGCGGGC | 21 | 14297 |
| BCL11A-12110 | + | AAGUUACAGCUCCGCAGCGGGC | 22 | 14298 |
| BCL11A-12111 | + | CAAGUUACAGCUCCGCAGCGGGC | 23 | 14299 |
| BCL11A-12112 | + | CCAAGUUACAGCUCCGCAGCGGGC | 24 | 14300 |
| BCL11A-12113 | + | GGCGGCGCAGGCCGGGGC | 18 | 14301 |
| BCL11A-12114 | + | AGGCGGCGCAGGCCGGGGC | 19 | 14302 |
| BCL11A-12115 | + | CAGGCGGCGCAGGCCGGGGC | 20 | 14303 |
| BCL11A-12116 | + | GCAGGCGGCGCAGGCCGGGGC | 21 | 14304 |
| BCL11A-12117 | + | GGCAGGCGGCGCAGGCCGGGGC | 22 | 14305 |
| BCL11A-12118 | + | AGGCAGGCGGCGCAGGCCGGGGC | 23 | 14306 |
| BCL11A-12119 | + | GAGGCAGGCGGCGCAGGCCGGGGC | 24 | 14307 |
| BCL11A-12120 | + | UUGCAAAACUGGCGGGGC | 18 | 14308 |
| BCL11A-12121 | + | UUUGCAAAACUGGCGGGGC | 19 | 14309 |
| BCL11A-10116 | + | UUUUGCAAAACUGGCGGGGC | 20 | 14310 |
| BCL11A-12122 | + | AUUUUGCAAAACUGGCGGGGC | 21 | 14311 |
| BCL11A-12123 | + | UAUUUUGCAAAACUGGCGGGGC | 22 | 14312 |
| BCL11A-12124 | + | UUAUUUUGCAAAACUGGCGGGGC | 23 | 14313 |
| BCL11A-12125 | + | AUUAUUUUGCAAAACUGGCGGGGC | 24 | 14314 |
| BCL11A-12126 | + | CAAACACCCACCUCUGGC | 18 | 14315 |
| BCL11A-12127 | + | ACAAACACCCACCUCUGGC | 19 | 14316 |
| BCL11A-10118 | + | GACAAACACCCACCUCUGGC | 20 | 14317 |
| BCL11A-12128 | + | GGACAAACACCCACCUCUGGC | 21 | 14318 |
| BCL11A-12129 | + | GGGACAAACACCCACCUCUGGC | 22 | 14319 |
| BCL11A-12130 | + | CGGGACAAACACCCACCUCUGGC | 23 | 14320 |
| BCL11A-12131 | + | GCGGGACAAACACCCACCUCUGGC | 24 | 14321 |
| BCL11A-12132 | + | GCGCUCGGGAAACUUUGC | 18 | 14322 |
| BCL11A-12133 | + | UGCGCUCGGGAAACUUUGC | 19 | 14323 |
| BCL11A-12134 | + | CUGCGCUCGGGAAACUUUGC | 20 | 14324 |
| BCL11A-12135 | + | GCUGCGCUCGGGAAACUUUGC | 21 | 14325 |
| BCL11A-12136 | + | GGCUGCGCUCGGGAAACUUUGC | 22 | 14326 |
| BCL11A-12137 | + | CGGCUGCGCUCGGGAAACUUUGC | 23 | 14327 |
| BCL11A-12138 | + | GCGGCUGCGCUCGGGAAACUUUGC | 24 | 14328 |
| BCL11A-12139 | + | UCCCGACUCCGCGGACUC | 18 | 14329 |

TABLE 19E-continued

5th Tier

| gRNA Name | DNA Strand | Targeting Domain | Target Site Length | SEQ ID NO: |
|---|---|---|---|---|
| BCL11A-12140 | + | CUCCCGACUCCGCGGACUC | 19 | 14330 |
| BCL11A-10122 | + | UCUCCCGACUCCGCGGACUC | 20 | 14331 |
| BCL11A-12141 | + | CUCUCCCGACUCCGCGGACUC | 21 | 14332 |
| BCL11A-12142 | + | CCUCUCCCGACUCCGCGGACUC | 22 | 14333 |
| BCL11A-12143 | + | CCCUCUCCCGACUCCGCGGACUC | 23 | 14334 |
| BCL11A-12144 | + | CCCCUCUCCCGACUCCGCGGACUC | 24 | 14335 |
| BCL11A-12145 | + | GAGCCCGCGGCUGCGCUC | 18 | 14336 |
| BCL11A-12146 | + | CGAGCCCGCGGCUGCGCUC | 19 | 14337 |
| BCL11A-10126 | + | CCGAGCCCGCGGCUGCGCUC | 20 | 14338 |
| BCL11A-12147 | + | CCCGAGCCCGCGGCUGCGCUC | 21 | 14339 |
| BCL11A-12148 | + | CCCCGAGCCCGCGGCUGCGCUC | 22 | 14340 |
| BCL11A-12149 | + | GCCCCGAGCCCGCGGCUGCGCUC | 23 | 14341 |
| BCL11A-12150 | + | AGCCCCGAGCCCGCGGCUGCGCUC | 24 | 14342 |
| BCL11A-12151 | + | AGCCAGGUAGAGUUGCUC | 18 | 14343 |
| BCL11A-12152 | + | AAGCCAGGUAGAGUUGCUC | 19 | 14344 |
| BCL11A-12153 | + | GAAGCCAGGUAGAGUUGCUC | 20 | 14345 |
| BCL11A-12154 | + | GGAAGCCAGGUAGAGUUGCUC | 21 | 14346 |
| BCL11A-12155 | + | GGGAAGCCAGGUAGAGUUGCUC | 22 | 14347 |
| BCL11A-12156 | + | AGGGAAGCCAGGUAGAGUUGCUC | 23 | 14348 |
| BCL11A-12157 | + | GAGGGAAGCCAGGUAGAGUUGCUC | 24 | 14349 |
| BCL11A-12158 | + | GGGCAGCGCCCAAGUCUC | 18 | 14350 |
| BCL11A-12159 | + | AGGGCAGCGCCCAAGUCUC | 19 | 14351 |
| BCL11A-12160 | + | AAGGGCAGCGCCCAAGUCUC | 20 | 14352 |
| BCL11A-12161 | + | GAAGGGCAGCGCCCAAGUCUC | 21 | 14353 |
| BCL11A-12162 | + | GGAAGGGCAGCGCCCAAGUCUC | 22 | 14354 |
| BCL11A-12163 | + | CGGAAGGGCAGCGCCCAAGUCUC | 23 | 14355 |
| BCL11A-12164 | + | CCGGAAGGGCAGCGCCCAAGUCUC | 24 | 14356 |
| BCL11A-12165 | + | UUUGGAGGGCUGCGGGUC | 18 | 14357 |
| BCL11A-12166 | + | GUUUGGAGGGCUGCGGGUC | 19 | 14358 |
| BCL11A-10129 | + | AGUUUGGAGGGCUGCGGGUC | 20 | 14359 |
| BCL11A-12167 | + | AAGUUUGGAGGGCUGCGGGUC | 21 | 14360 |
| BCL11A-12168 | + | UAAGUUUGGAGGGCUGCGGGUC | 22 | 14361 |
| BCL11A-12169 | + | CUAAGUUUGGAGGGCUGCGGGUC | 23 | 14362 |
| BCL11A-12170 | + | CCUAAGUUUGGAGGGCUGCGGGUC | 24 | 14363 |
| BCL11A-12171 | + | CGGCGGAAAGGAGGAAAG | 18 | 14364 |
| BCL11A-12172 | + | GCGGCGGAAAGGAGGAAAG | 19 | 14365 |
| BCL11A-10136 | + | AGCGGCGGAAAGGAGGAAAG | 20 | 14366 |

TABLE 19E-continued

5th Tier

| gRNA Name | DNA Strand | Targeting Domain | Target Site Length | SEQ ID NO: |
|---|---|---|---|---|
| BCL11A-12173 | + | AAGCGGCGGAAAGGAGGAAAG | 21 | 14367 |
| BCL11A-12174 | + | AAAGCGGCGGAAAGGAGGAAAG | 22 | 14368 |
| BCL11A-12175 | + | UAAAGCGGCGGAAAGGAGGAAAG | 23 | 14369 |
| BCL11A-12176 | + | AUAAAGCGGCGGAAAGGAGGAAAG | 24 | 14370 |
| BCL11A-12177 | + | AAAUAAAGCGGCGGAAAG | 18 | 14371 |
| BCL11A-12178 | + | GAAAUAAAGCGGCGGAAAG | 19 | 14372 |
| BCL11A-12179 | + | AGAAAUAAAGCGGCGGAAAG | 20 | 14373 |
| BCL11A-12180 | + | GAGAAAUAAAGCGGCGGAAAG | 21 | 14374 |
| BCL11A-12181 | + | AGAGAAAUAAAGCGGCGGAAAG | 22 | 14375 |
| BCL11A-12182 | + | AAGAGAAAUAAAGCGGCGGAAAG | 23 | 14376 |
| BCL11A-12183 | + | AAAGAGAAAUAAAGCGGCGGAAAG | 24 | 14377 |
| BCL11A-12184 | + | CCCGCGCGGCCUGGAAAG | 18 | 14378 |
| BCL11A-12185 | + | GCCCGCGCGGCCUGGAAAG | 19 | 14379 |
| BCL11A-10137 | + | AGCCCGCGCGGCCUGGAAAG | 20 | 14380 |
| BCL11A-12186 | + | GAGCCCGCGCGGCCUGGAAAG | 21 | 14381 |
| BCL11A-12187 | + | GGAGCCCGCGCGGCCUGGAAAG | 22 | 14382 |
| BCL11A-12188 | + | AGGAGCCCGCGCGGCCUGGAAAG | 23 | 14383 |
| BCL11A-12189 | + | CAGGAGCCCGCGCGGCCUGGAAAG | 24 | 14384 |
| BCL11A-12190 | + | AAGAAAAAUCACCCGAAG | 18 | 14385 |
| BCL11A-12191 | + | AAAGAAAAAUCACCCGAAG | 19 | 14386 |
| BCL11A-12192 | + | CAAAGAAAAAUCACCCGAAG | 20 | 14387 |
| BCL11A-12193 | + | GCAAAGAAAAAUCACCCGAAG | 21 | 14388 |
| BCL11A-12194 | + | AGCAAAGAAAAAUCACCCGAAG | 22 | 14389 |
| BCL11A-12195 | + | CAGCAAAGAAAAAUCACCCGAAG | 23 | 14390 |
| BCL11A-12196 | + | ACAGCAAAGAAAAAUCACCCGAAG | 24 | 14391 |
| BCL11A-12197 | + | AGCCGGCACAAAAGGCAG | 18 | 14392 |
| BCL11A-12198 | + | GAGCCGGCACAAAAGGCAG | 19 | 14393 |
| BCL11A-10144 | + | GGAGCCGGCACAAAAGGCAG | 20 | 14394 |
| BCL11A-12199 | + | AGGAGCCGGCACAAAAGGCAG | 21 | 14395 |
| BCL11A-12200 | + | GAGGAGCCGGCACAAAAGGCAG | 22 | 14396 |
| BCL11A-12201 | + | CGAGGAGCCGGCACAAAAGGCAG | 23 | 14397 |
| BCL11A-12202 | + | GCGAGGAGCCGGCACAAAAGGCAG | 24 | 14398 |
| BCL11A-12203 | + | GCGGAAAGGAGGAAAGAG | 18 | 14399 |
| BCL11A-12204 | + | GGCGGAAAGGAGGAAAGAG | 19 | 14400 |
| BCL11A-12205 | + | CGGCGGAAAGGAGGAAAGAG | 20 | 14401 |
| BCL11A-12206 | + | GCGGCGGAAAGGAGGAAAGAG | 21 | 14402 |
| BCL11A-12207 | + | AGCGGCGGAAAGGAGGAAAGAG | 22 | 14403 |

TABLE 19E-continued

5th Tier

| gRNA Name | DNA Strand | Targeting Domain | Target Site Length | SEQ ID NO: |
|---|---|---|---|---|
| BCL11A-12208 | + | AAGCGGCGGAAAGGAGGAAAGAG | 23 | 14404 |
| BCL11A-12209 | + | AAAGCGGCGGAAAGGAGGAAAGAG | 24 | 14405 |
| BCL11A-12210 | + | AUCACCCGAAGUUGAGAG | 18 | 14406 |
| BCL11A-12211 | + | AAUCACCCGAAGUUGAGAG | 19 | 14407 |
| BCL11A-12212 | + | AAAUCACCCGAAGUUGAGAG | 20 | 14408 |
| BCL11A-12213 | + | AAAAUCACCCGAAGUUGAGAG | 21 | 14409 |
| BCL11A-12214 | + | AAAAAUCACCCGAAGUUGAGAG | 22 | 14410 |
| BCL11A-12215 | + | GAAAAAUCACCCGAAGUUGAGAG | 23 | 14411 |
| BCL11A-12216 | + | AGAAAAAUCACCCGAAGUUGAGAG | 24 | 14412 |
| BCL11A-12217 | + | CGGGAAACUUUGCCCGAG | 18 | 14413 |
| BCL11A-12218 | + | UCGGGAAACUUUGCCCGAG | 19 | 14414 |
| BCL11A-12219 | + | CUCGGGAAACUUUGCCCGAG | 20 | 14415 |
| BCL11A-12220 | + | GCUCGGGAAACUUUGCCCGAG | 21 | 14416 |
| BCL11A-12221 | + | CGCUCGGGAAACUUUGCCCGAG | 22 | 14417 |
| BCL11A-12222 | + | GCGCUCGGGAAACUUUGCCCGAG | 23 | 14418 |
| BCL11A-12223 | + | UGCGCUCGGGAAACUUUGCCCGAG | 24 | 14419 |
| BCL11A-12224 | + | AGCUCCGCAGCGGGCGAG | 18 | 14420 |
| BCL11A-12225 | + | CAGCUCCGCAGCGGGCGAG | 19 | 14421 |
| BCL11A-10148 | + | ACAGCUCCGCAGCGGGCGAG | 20 | 14422 |
| BCL11A-12226 | + | UACAGCUCCGCAGCGGGCGAG | 21 | 14423 |
| BCL11A-12227 | + | UUACAGCUCCGCAGCGGGCGAG | 22 | 14424 |
| BCL11A-12228 | + | GUUACAGCUCCGCAGCGGGCGAG | 23 | 14425 |
| BCL11A-12229 | + | AGUUACAGCUCCGCAGCGGGCGAG | 24 | 14426 |
| BCL11A-12230 | + | CGCAGCGGGCGAGGGGAG | 18 | 14427 |
| BCL11A-12231 | + | CCGCAGCGGGCGAGGGGAG | 19 | 14428 |
| BCL11A-12232 | + | UCCGCAGCGGGCGAGGGGAG | 20 | 14429 |
| BCL11A-12233 | + | CUCCGCAGCGGGCGAGGGGAG | 21 | 14430 |
| BCL11A-12234 | + | GCUCCGCAGCGGGCGAGGGGAG | 22 | 14431 |
| BCL11A-12235 | + | AGCUCCGCAGCGGGCGAGGGGAG | 23 | 14432 |
| BCL11A-12236 | + | CAGCUCCGCAGCGGGCGAGGGGAG | 24 | 14433 |
| BCL11A-12237 | + | CCAUUUUCUUACGGUGAG | 18 | 14434 |
| BCL11A-12238 | + | CCCAUUUUCUUACGGUGAG | 19 | 14435 |
| BCL11A-10154 | + | CCCCAUUUUCUUACGGUGAG | 20 | 14436 |
| BCL11A-12239 | + | CCCCCAUUUUCUUACGGUGAG | 21 | 14437 |
| BCL11A-12240 | + | CCCCCCAUUUUCUUACGGUGAG | 22 | 14438 |
| BCL11A-12241 | + | CCCCCCCAUUUUCUUACGGUGAG | 23 | 14439 |
| BCL11A-12242 | + | ACCCCCCCAUUUUCUUACGGUGAG | 24 | 14440 |

TABLE 19E-continued

5th Tier

| gRNA Name | DNA Strand | Targeting Domain | Target Site Length | SEQ ID NO: |
|---|---|---|---|---|
| BCL11A-12243 | + | CCUGGAAAGAGGGGACCG | 18 | 14441 |
| BCL11A-12244 | + | GCCUGGAAAGAGGGGACCG | 19 | 14442 |
| BCL11A-10159 | + | GGCCUGGAAAGAGGGGACCG | 20 | 14443 |
| BCL11A-12245 | + | CGGCCUGGAAAGAGGGGACCG | 21 | 14444 |
| BCL11A-12246 | + | GCGGCCUGGAAAGAGGGGACCG | 22 | 14445 |
| BCL11A-12247 | + | CGCGGCCUGGAAAGAGGGGACCG | 23 | 14446 |
| BCL11A-12248 | + | GCGCGGCCUGGAAAGAGGGGACCG | 24 | 14447 |
| BCL11A-12249 | + | CUCGGGAAACUUUGCCCG | 18 | 14448 |
| BCL11A-12250 | + | GCUCGGGAAACUUUGCCCG | 19 | 14449 |
| BCL11A-10163 | + | CGCUCGGGAAACUUUGCCCG | 20 | 14450 |
| BCL11A-12251 | + | GCGCUCGGGAAACUUUGCCCG | 21 | 14451 |
| BCL11A-12252 | + | UGCGCUCGGGAAACUUUGCCCG | 22 | 14452 |
| BCL11A-12253 | + | CUGCGCUCGGGAAACUUUGCCCG | 23 | 14453 |
| BCL11A-12254 | + | GCUGCGCUCGGGAAACUUUGCCCG | 24 | 14454 |
| BCL11A-12255 | + | GAAAAGAGAAAUAAAGCG | 18 | 14455 |
| BCL11A-12256 | + | CGAAAAGAGAAAUAAAGCG | 19 | 14456 |
| BCL11A-12257 | + | UCGAAAAGAGAAAUAAAGCG | 20 | 14457 |
| BCL11A-12258 | + | UUCGAAAAGAGAAAUAAAGCG | 21 | 14458 |
| BCL11A-12259 | + | UUUCGAAAAGAGAAAUAAAGCG | 22 | 14459 |
| BCL11A-12260 | + | UUUUCGAAAAGAGAAAUAAAGCG | 23 | 14460 |
| BCL11A-12261 | + | CUUUUCGAAAAGAGAAAUAAAGCG | 24 | 14461 |
| BCL11A-12262 | + | UCCGCGGACUCAGGAGCG | 18 | 14462 |
| BCL11A-12263 | + | CUCCGCGGACUCAGGAGCG | 19 | 14463 |
| BCL11A-12264 | + | ACUCCGCGGACUCAGGAGCG | 20 | 14464 |
| BCL11A-12265 | + | GACUCCGCGGACUCAGGAGCG | 21 | 14465 |
| BCL11A-12266 | + | CGACUCCGCGGACUCAGGAGCG | 22 | 14466 |
| BCL11A-12267 | + | CCGACUCCGCGGACUCAGGAGCG | 23 | 14467 |
| BCL11A-12268 | + | CCCGACUCCGCGGACUCAGGAGCG | 24 | 14468 |
| BCL11A-12269 | + | CGCGGGAGGGCAAGCGCG | 18 | 14469 |
| BCL11A-12270 | + | GCGCGGGAGGGCAAGCGCG | 19 | 14470 |
| BCL11A-10178 | + | GGCGCGGGAGGGCAAGCGCG | 20 | 14471 |
| BCL11A-12271 | + | ACAGCUCCGCAGCGGGCG | 18 | 14472 |
| BCL11A-12272 | + | UACAGCUCCGCAGCGGGCG | 19 | 14473 |
| BCL11A-10180 | + | UUACAGCUCCGCAGCGGGCG | 20 | 14474 |
| BCL11A-12273 | + | GUUACAGCUCCGCAGCGGGCG | 21 | 14475 |
| BCL11A-12274 | + | AGUUACAGCUCCGCAGCGGGCG | 22 | 14476 |
| BCL11A-12275 | + | AAGUUACAGCUCCGCAGCGGGCG | 23 | 14477 |

TABLE 19E-continued

5th Tier

| gRNA Name | DNA Strand | Targeting Domain | Target Site Length | SEQ ID NO: |
|---|---|---|---|---|
| BCL11A-12276 | + | CAAGUUACAGCUCCGCAGCGGGCG | 24 | 14478 |
| BCL11A-12277 | + | GCUGGGGAAGCGCGGGCG | 18 | 14479 |
| BCL11A-12278 | + | GGCUGGGGAAGCGCGGGCG | 19 | 14480 |
| BCL11A-12279 | + | GGGCUGGGGAAGCGCGGGCG | 20 | 14481 |
| BCL11A-12280 | + | CGGGCUGGGGAAGCGCGGGCG | 21 | 14482 |
| BCL11A-12281 | + | CCGGGCUGGGGAAGCGCGGGCG | 22 | 14483 |
| BCL11A-12282 | + | CCCGGGCUGGGGAAGCGCGGGCG | 23 | 14484 |
| BCL11A-12283 | + | CCCCGGGCUGGGGAAGCGCGGGCG | 24 | 14485 |
| BCL11A-12284 | + | UGCAAAACUGGCGGGGCG | 18 | 14486 |
| BCL11A-12285 | + | UUGCAAAACUGGCGGGGCG | 19 | 14487 |
| BCL11A-10181 | + | UUUGCAAAACUGGCGGGGCG | 20 | 14488 |
| BCL11A-12286 | + | UUUUGCAAAACUGGCGGGGCG | 21 | 14489 |
| BCL11A-12287 | + | AUUUUGCAAAACUGGCGGGGCG | 22 | 14490 |
| BCL11A-12288 | + | UAUUUUGCAAAACUGGCGGGGCG | 23 | 14491 |
| BCL11A-12289 | + | UUAUUUUGCAAAACUGGCGGGGCG | 24 | 14492 |
| BCL11A-12290 | + | AAUAAAGCGGCGGAAAGG | 18 | 14493 |
| BCL11A-12291 | + | AAAUAAAGCGGCGGAAAGG | 19 | 14494 |
| BCL11A-10185 | + | GAAAUAAAGCGGCGGAAAGG | 20 | 14495 |
| BCL11A-12292 | + | AGAAAUAAAGCGGCGGAAAGG | 21 | 14496 |
| BCL11A-12293 | + | GAGAAAUAAAGCGGCGGAAAGG | 22 | 14497 |
| BCL11A-12294 | + | AGAGAAAUAAAGCGGCGGAAAGG | 23 | 14498 |
| BCL11A-12295 | + | AAGAGAAAUAAAGCGGCGGAAAGG | 24 | 14499 |
| BCL11A-12296 | + | CCGAGGGCGCCCCCAAGG | 18 | 14500 |
| BCL11A-12297 | + | CCCGAGGGCGCCCCCAAGG | 19 | 14501 |
| BCL11A-12298 | + | GCCCGAGGGCGCCCCCAAGG | 20 | 14502 |
| BCL11A-12299 | + | GGCCCGAGGGCGCCCCCAAGG | 21 | 14503 |
| BCL11A-12300 | + | GGGCCCGAGGGCGCCCCCAAGG | 22 | 14504 |
| BCL11A-12301 | + | GGGGCCCGAGGGCGCCCCCAAGG | 23 | 14505 |
| BCL11A-12302 | + | CGGGGCCCGAGGGCGCCCCCAAGG | 24 | 14506 |
| BCL11A-12303 | + | AGAGGCAGGCGGCGCAGG | 18 | 14507 |
| BCL11A-12304 | + | GAGAGGCAGGCGGCGCAGG | 19 | 14508 |
| BCL11A-12305 | + | GGAGAGGCAGGCGGCGCAGG | 20 | 14509 |
| BCL11A-12306 | + | GGGAGAGGCAGGCGGCGCAGG | 21 | 14510 |
| BCL11A-12307 | + | GGGGAGAGGCAGGCGGCGCAGG | 22 | 14511 |
| BCL11A-12308 | + | CGGGGAGAGGCAGGCGGCGCAGG | 23 | 14512 |
| BCL11A-12309 | + | CCGGGGAGAGGCAGGCGGCGCAGG | 24 | 14513 |
| BCL11A-12310 | + | GCAGCGGGCGAGGGGAGG | 18 | 14514 |

TABLE 19E-continued

5th Tier

| gRNA Name | DNA Strand | Targeting Domain | Target Site Length | SEQ ID NO: |
|---|---|---|---|---|
| BCL11A-12311 | + | CGCAGCGGGCGAGGGGAGG | 19 | 14515 |
| BCL11A-10190 | + | CCGCAGCGGGCGAGGGGAGG | 20 | 14516 |
| BCL11A-12312 | + | UCCGCAGCGGGCGAGGGGAGG | 21 | 14517 |
| BCL11A-12313 | + | CUCCGCAGCGGGCGAGGGGAGG | 22 | 14518 |
| BCL11A-12314 | + | GCUCCGCAGCGGGCGAGGGGAGG | 23 | 14519 |
| BCL11A-12315 | + | AGCUCCGCAGCGGGCGAGGGGAGG | 24 | 14520 |
| BCL11A-12316 | + | GGAGGGCUGCGGGUCCGG | 18 | 14521 |
| BCL11A-12317 | + | UGGAGGGCUGCGGGUCCGG | 19 | 14522 |
| BCL11A-12318 | + | UUGGAGGGCUGCGGGUCCGG | 20 | 14523 |
| BCL11A-12319 | + | UUUGGAGGGCUGCGGGUCCGG | 21 | 14524 |
| BCL11A-12320 | + | GUUUGGAGGGCUGCGGGUCCGG | 22 | 14525 |
| BCL11A-12321 | + | AGUUUGGAGGGCUGCGGGUCCGG | 23 | 14526 |
| BCL11A-12322 | + | AAGUUUGGAGGGCUGCGGGUCCGG | 24 | 14527 |
| BCL11A-12323 | + | AAAAGAGAAAUAAAGCGG | 18 | 14528 |
| BCL11A-12324 | + | GAAAAGAGAAAUAAAGCGG | 19 | 14529 |
| BCL11A-10193 | + | CGAAAAGAGAAAUAAAGCGG | 20 | 14530 |
| BCL11A-12325 | + | UCGAAAAGAGAAAUAAAGCGG | 21 | 14531 |
| BCL11A-12326 | + | UUCGAAAAGAGAAAUAAAGCGG | 22 | 14532 |
| BCL11A-12327 | + | UUUCGAAAAGAGAAAUAAAGCGG | 23 | 14533 |
| BCL11A-12328 | + | UUUUCGAAAAGAGAAAUAAAGCGG | 24 | 14534 |
| BCL11A-12329 | + | GUUACAGCUCCGCAGCGG | 18 | 14535 |
| BCL11A-12330 | + | AGUUACAGCUCCGCAGCGG | 19 | 14536 |
| BCL11A-12331 | + | AAGUUACAGCUCCGCAGCGG | 20 | 14537 |
| BCL11A-12332 | + | CAAGUUACAGCUCCGCAGCGG | 21 | 14538 |
| BCL11A-12333 | + | CCAAGUUACAGCUCCGCAGCGG | 22 | 14539 |
| BCL11A-12334 | + | UCCAAGUUACAGCUCCGCAGCGG | 23 | 14540 |
| BCL11A-12335 | + | CUCCAAGUUACAGCUCCGCAGCGG | 24 | 14541 |
| BCL11A-12336 | + | CGGGCUGGGGAAGCGCGG | 18 | 14542 |
| BCL11A-12337 | + | CCGGGCUGGGGAAGCGCGG | 19 | 14543 |
| BCL11A-12338 | + | CCCGGGCUGGGGAAGCGCGG | 20 | 14544 |
| BCL11A-12339 | + | CCCCGGGCUGGGGAAGCGCGG | 21 | 14545 |
| BCL11A-12340 | + | GCCCCGGGCUGGGGAAGCGCGG | 22 | 14546 |
| BCL11A-12341 | + | AGCCCCGGGCUGGGGAAGCGCGG | 23 | 14547 |
| BCL11A-12342 | + | CAGCCCCGGGCUGGGGAAGCGCGG | 24 | 14548 |
| BCL11A-12343 | + | CUGGGGAAGCGCGGGCGG | 18 | 14549 |
| BCL11A-12344 | + | GCUGGGGAAGCGCGGGCGG | 19 | 14550 |
| BCL11A-10197 | + | GGCUGGGGAAGCGCGGGCGG | 20 | 14551 |

TABLE 19E-continued

5th Tier

| gRNA Name | DNA Strand | Targeting Domain | Target Site Length | SEQ ID NO: |
|---|---|---|---|---|
| BCL11A-12345 | + | GGGCUGGGGAAGCGCGGGCGG | 21 | 14552 |
| BCL11A-12346 | + | CGGGCUGGGGAAGCGCGGGCGG | 22 | 14553 |
| BCL11A-12347 | + | CCGGGCUGGGGAAGCGCGGGCGG | 23 | 14554 |
| BCL11A-12348 | + | CCCGGGCUGGGGAAGCGCGGGCGG | 24 | 14555 |
| BCL11A-12349 | + | GCAAAACUGGCGGGGCGG | 18 | 14556 |
| BCL11A-12350 | + | UGCAAAACUGGCGGGGCGG | 19 | 14557 |
| BCL11A-10198 | + | UUGCAAAACUGGCGGGGCGG | 20 | 14558 |
| BCL11A-12351 | + | UUUGCAAAACUGGCGGGGCGG | 21 | 14559 |
| BCL11A-12352 | + | UUUUGCAAAACUGGCGGGGCGG | 22 | 14560 |
| BCL11A-12353 | + | AUUUUGCAAAACUGGCGGGGCGG | 23 | 14561 |
| BCL11A-12354 | + | UAUUUUGCAAAACUGGCGGGGCGG | 24 | 14562 |
| BCL11A-12355 | + | UGGAAAGAGGGGACCGGG | 18 | 14563 |
| BCL11A-12356 | + | CUGGAAAGAGGGGACCGGG | 19 | 14564 |
| BCL11A-12357 | + | CCUGGAAAGAGGGGACCGGG | 20 | 14565 |
| BCL11A-12358 | + | GCCUGGAAAGAGGGGACCGGG | 21 | 14566 |
| BCL11A-12359 | + | GGCCUGGAAAGAGGGGACCGGG | 22 | 14567 |
| BCL11A-12360 | + | CGGCCUGGAAAGAGGGGACCGGG | 23 | 14568 |
| BCL11A-12361 | + | GCGGCCUGGAAAGAGGGGACCGGG | 24 | 14569 |
| BCL11A-12362 | + | GGAGGCUGCAGCCCCGGG | 18 | 14570 |
| BCL11A-12363 | + | GGGAGGCUGCAGCCCCGGG | 19 | 14571 |
| BCL11A-12364 | + | CGGGAGGCUGCAGCCCCGGG | 20 | 14572 |
| BCL11A-12365 | + | CCGGGAGGCUGCAGCCCCGGG | 21 | 14573 |
| BCL11A-12366 | + | ACCGGGAGGCUGCAGCCCCGGG | 22 | 14574 |
| BCL11A-12367 | + | CACCGGGAGGCUGCAGCCCCGGG | 23 | 14575 |
| BCL11A-12368 | + | GCACCGGGAGGCUGCAGCCCCGGG | 24 | 14576 |
| BCL11A-12369 | + | GGGCUGGGGAAGCGCGGG | 18 | 14577 |
| BCL11A-12370 | + | CGGGCUGGGGAAGCGCGGG | 19 | 14578 |
| BCL11A-10203 | + | CCGGGCUGGGGAAGCGCGGG | 20 | 14579 |
| BCL11A-12371 | + | CCCGGGCUGGGGAAGCGCGGG | 21 | 14580 |
| BCL11A-12372 | + | CCCCGGGCUGGGGAAGCGCGGG | 22 | 14581 |
| BCL11A-12373 | + | GCCCCGGGCUGGGGAAGCGCGGG | 23 | 14582 |
| BCL11A-12374 | + | AGCCCCGGGCUGGGGAAGCGCGGG | 24 | 14583 |
| BCL11A-12375 | + | CAAAACUGGCGGGGCGGG | 18 | 14584 |
| BCL11A-12376 | + | GCAAAACUGGCGGGGCGGG | 19 | 14585 |
| BCL11A-10204 | + | UGCAAAACUGGCGGGGCGGG | 20 | 14586 |
| BCL11A-12377 | + | UUGCAAAACUGGCGGGGCGGG | 21 | 14587 |
| BCL11A-12378 | + | UUUGCAAAACUGGCGGGGCGGG | 22 | 14588 |

TABLE 19E-continued

5th Tier

| gRNA Name | DNA Strand | Targeting Domain | Target Site Length | SEQ ID NO: |
|---|---|---|---|---|
| BCL11A-12379 | + | UUUUGCAAAACUGGCGGGGCGGG | 23 | 14589 |
| BCL11A-12380 | + | AUUUUGCAAAACUGGCGGGGCGGG | 24 | 14590 |
| BCL11A-12381 | + | UUUUGCAAAACUGGCGGG | 18 | 14591 |
| BCL11A-12382 | + | AUUUUGCAAAACUGGCGGG | 19 | 14592 |
| BCL11A-12383 | + | UAUUUUGCAAAACUGGCGGG | 20 | 14593 |
| BCL11A-12384 | + | UUAUUUUGCAAAACUGGCGGG | 21 | 14594 |
| BCL11A-12385 | + | AUUAUUUUGCAAAACUGGCGGG | 22 | 14595 |
| BCL11A-12386 | + | CAUUAUUUUGCAAAACUGGCGGG | 23 | 14596 |
| BCL11A-12387 | + | UCAUUAUUUUGCAAAACUGGCGGG | 24 | 14597 |
| BCL11A-12388 | + | GCGUGUGGACGCCAGGGG | 18 | 14598 |
| BCL11A-12389 | + | CGCGUGUGGACGCCAGGGG | 19 | 14599 |
| BCL11A-12390 | + | CCGCGUGUGGACGCCAGGGG | 20 | 14600 |
| BCL11A-12391 | + | CCCGCGUGUGGACGCCAGGGG | 21 | 14601 |
| BCL11A-12392 | + | CCCCGCGUGUGGACGCCAGGGG | 22 | 14602 |
| BCL11A-12393 | + | UCCCCGCGUGUGGACGCCAGGGG | 23 | 14603 |
| BCL11A-12394 | + | CUCCCCGCGUGUGGACGCCAGGGG | 24 | 14604 |
| BCL11A-12395 | + | AAAACUGGCGGGGCGGGG | 18 | 14605 |
| BCL11A-12396 | + | CAAAACUGGCGGGGCGGGG | 19 | 14606 |
| BCL11A-10207 | + | GCAAAACUGGCGGGGCGGGG | 20 | 14607 |
| BCL11A-12397 | + | UGCAAAACUGGCGGGGCGGGG | 21 | 14608 |
| BCL11A-12398 | + | UUGCAAAACUGGCGGGGCGGGG | 22 | 14609 |
| BCL11A-12399 | + | UUUGCAAAACUGGCGGGGCGGGG | 23 | 14610 |
| BCL11A-12400 | + | UUUUGCAAAACUGGCGGGGCGGGG | 24 | 14611 |
| BCL11A-12401 | + | UUUGCAAAACUGGCGGGG | 18 | 14612 |
| BCL11A-12402 | + | UUUUGCAAAACUGGCGGGG | 19 | 14613 |
| BCL11A-10208 | + | AUUUUGCAAAACUGGCGGGG | 20 | 14614 |
| BCL11A-12403 | + | UAUUUUGCAAAACUGGCGGGG | 21 | 14615 |
| BCL11A-12404 | + | UUAUUUUGCAAAACUGGCGGGG | 22 | 14616 |
| BCL11A-12405 | + | AUUAUUUUGCAAAACUGGCGGGG | 23 | 14617 |
| BCL11A-12406 | + | CAUUAUUUUGCAAAACUGGCGGGG | 24 | 14618 |
| BCL11A-12407 | + | CGGGCGAGGGGAGGUGGG | 18 | 14619 |
| BCL11A-12408 | + | GCGGGCGAGGGGAGGUGGG | 19 | 14620 |
| BCL11A-10213 | + | AGCGGGCGAGGGGAGGUGGG | 20 | 14621 |
| BCL11A-12409 | + | CAGCGGGCGAGGGGAGGUGGG | 21 | 14622 |
| BCL11A-12410 | + | GCAGCGGGCGAGGGGAGGUGGG | 22 | 14623 |
| BCL11A-12411 | + | CGCAGCGGGCGAGGGGAGGUGGG | 23 | 14624 |
| BCL11A-12412 | + | CCGCAGCGGGCGAGGGGAGGUGGG | 24 | 14625 |

TABLE 19E-continued

5th Tier

| gRNA Name | DNA Strand | Targeting Domain | Target Site Length | SEQ ID NO: |
|---|---|---|---|---|
| BCL11A-12413 | + | AUUAUUUUGCAAAACUGG | 18 | 14626 |
| BCL11A-12414 | + | CAUUAUUUUGCAAAACUGG | 19 | 14627 |
| BCL11A-10215 | + | UCAUUAUUUUGCAAAACUGG | 20 | 14628 |
| BCL11A-12415 | + | UUCAUUAUUUUGCAAAACUGG | 21 | 14629 |
| BCL11A-12416 | + | GUUCAUUAUUUUGCAAAACUGG | 22 | 14630 |
| BCL11A-12417 | + | UGUUCAUUAUUUUGCAAAACUGG | 23 | 14631 |
| BCL11A-12418 | + | UUGUUCAUUAUUUUGCAAAACUGG | 24 | 14632 |
| BCL11A-12419 | + | ACAAACACCCACCUCUGG | 18 | 14633 |
| BCL11A-12420 | + | GACAAACACCCACCUCUGG | 19 | 14634 |
| BCL11A-12421 | + | GGACAAACACCCACCUCUGG | 20 | 14635 |
| BCL11A-12422 | + | GGGACAAACACCCACCUCUGG | 21 | 14636 |
| BCL11A-12423 | + | CGGGACAAACACCCACCUCUGG | 22 | 14637 |
| BCL11A-12424 | + | GCGGGACAAACACCCACCUCUGG | 23 | 14638 |
| BCL11A-12425 | + | AGCGGGACAAACACCCACCUCUGG | 24 | 14639 |
| BCL11A-12426 | + | GCGGGCGAGGGGAGGUGG | 18 | 14640 |
| BCL11A-12427 | + | AGCGGGCGAGGGGAGGUGG | 19 | 14641 |
| BCL11A-12428 | + | CAGCGGGCGAGGGGAGGUGG | 20 | 14642 |
| BCL11A-12429 | + | GCAGCGGGCGAGGGGAGGUGG | 21 | 14643 |
| BCL11A-12430 | + | CGCAGCGGGCGAGGGGAGGUGG | 22 | 14644 |
| BCL11A-12431 | + | CCGCAGCGGGCGAGGGGAGGUGG | 23 | 14645 |
| BCL11A-12432 | + | UCCGCAGCGGGCGAGGGGAGGUGG | 24 | 14646 |
| BCL11A-12433 | + | CAUUAUUUUGCAAAACUG | 18 | 14647 |
| BCL11A-12434 | + | UCAUUAUUUUGCAAAACUG | 19 | 14648 |
| BCL11A-12435 | + | UUCAUUAUUUUGCAAAACUG | 20 | 14649 |
| BCL11A-12436 | + | GUUCAUUAUUUUGCAAAACUG | 21 | 14650 |
| BCL11A-12437 | + | UGUUCAUUAUUUUGCAAAACUG | 22 | 14651 |
| BCL11A-12438 | + | UUGUUCAUUAUUUUGCAAAACUG | 23 | 14652 |
| BCL11A-12439 | + | AUUGUUCAUUAUUUUGCAAAACUG | 24 | 14653 |
| BCL11A-12440 | + | GGCUGCAGCCCCGGGCUG | 18 | 14654 |
| BCL11A-12441 | + | AGGCUGCAGCCCCGGGCUG | 19 | 14655 |
| BCL11A-10226 | + | GAGGCUGCAGCCCCGGGCUG | 20 | 14656 |
| BCL11A-12442 | + | GGAGGCUGCAGCCCCGGGCUG | 21 | 14657 |
| BCL11A-12443 | + | GGGAGGCUGCAGCCCCGGGCUG | 22 | 14658 |
| BCL11A-12444 | + | CGGGAGGCUGCAGCCCCGGGCUG | 23 | 14659 |
| BCL11A-12445 | + | CCGGGAGGCUGCAGCCCCGGGCUG | 24 | 14660 |
| BCL11A-12446 | + | GCCACUUUCUCACUAUUG | 18 | 14661 |
| BCL11A-12447 | + | UGCCACUUUCUCACUAUUG | 19 | 14662 |

TABLE 19E-continued

5th Tier

| gRNA Name | DNA Strand | Targeting Domain | Target Site Length | SEQ ID NO: |
|---|---|---|---|---|
| BCL11A-10230 | + | GUGCCACUUUCUCACUAUUG | 20 | 14663 |
| BCL11A-12448 | + | AGUGCCACUUUCUCACUAUUG | 21 | 14664 |
| BCL11A-12449 | + | CAGUGCCACUUUCUCACUAUUG | 22 | 14665 |
| BCL11A-12450 | + | ACAGUGCCACUUUCUCACUAUUG | 23 | 14666 |
| BCL11A-12451 | + | CACAGUGCCACUUUCUCACUAUUG | 24 | 14667 |
| BCL11A-12452 | + | GAAUCCAGCCUAAGUUUG | 18 | 14668 |
| BCL11A-12453 | + | GGAAUCCAGCCUAAGUUUG | 19 | 14669 |
| BCL11A-12454 | + | CGGAAUCCAGCCUAAGUUUG | 20 | 14670 |
| BCL11A-12455 | + | GCGGAAUCCAGCCUAAGUUUG | 21 | 14671 |
| BCL11A-12456 | + | CGCGGAAUCCAGCCUAAGUUUG | 22 | 14672 |
| BCL11A-12457 | + | ACGCGGAAUCCAGCCUAAGUUUG | 23 | 14673 |
| BCL11A-12458 | + | AACGCGGAAUCCAGCCUAAGUUUG | 24 | 14674 |
| BCL11A-12459 | + | CUCCCGACUCCGCGGACU | 18 | 14675 |
| BCL11A-12460 | + | UCUCCCGACUCCGCGGACU | 19 | 14676 |
| BCL11A-12461 | + | CUCUCCCGACUCCGCGGACU | 20 | 14677 |
| BCL11A-12462 | + | CCUCUCCCGACUCCGCGGACU | 21 | 14678 |
| BCL11A-12463 | + | CCCUCUCCCGACUCCGCGGACU | 22 | 14679 |
| BCL11A-12464 | + | CCCCUCUCCCGACUCCGCGGACU | 23 | 14680 |
| BCL11A-12465 | + | GCCCCUCUCCCGACUCCGCGGACU | 24 | 14681 |
| BCL11A-12466 | + | CGAGCCCGCGGCUGCGCU | 18 | 14682 |
| BCL11A-12467 | + | CCGAGCCCGCGGCUGCGCU | 19 | 14683 |
| BCL11A-10239 | + | CCCGAGCCCGCGGCUGCGCU | 20 | 14684 |
| BCL11A-12468 | + | CCCCGAGCCCGCGGCUGCGCU | 21 | 14685 |
| BCL11A-12469 | + | GCCCCGAGCCCGCGGCUGCGCU | 22 | 14686 |
| BCL11A-12470 | + | AGCCCCGAGCCCGCGGCUGCGCU | 23 | 14687 |
| BCL11A-12471 | + | AAGCCCCGAGCCCGCGGCUGCGCU | 24 | 14688 |
| BCL11A-12472 | + | AGGCUGCAGCCCCGGGCU | 18 | 14689 |
| BCL11A-12473 | + | GAGGCUGCAGCCCCGGGCU | 19 | 14690 |
| BCL11A-10240 | + | GGAGGCUGCAGCCCCGGGCU | 20 | 14691 |
| BCL11A-12474 | + | GGGAGGCUGCAGCCCCGGGCU | 21 | 14692 |
| BCL11A-12475 | + | CGGGAGGCUGCAGCCCCGGGCU | 22 | 14693 |
| BCL11A-12476 | + | CCGGGAGGCUGCAGCCCCGGGCU | 23 | 14694 |
| BCL11A-12477 | + | ACCGGGAGGCUGCAGCCCCGGGCU | 24 | 14695 |
| BCL11A-12478 | + | GCGGAAUCCAGCCUAAGU | 18 | 14696 |
| BCL11A-12479 | + | CGCGGAAUCCAGCCUAAGU | 19 | 14697 |
| BCL11A-12480 | + | ACGCGGAAUCCAGCCUAAGU | 20 | 14698 |
| BCL11A-12481 | + | AACGCGGAAUCCAGCCUAAGU | 21 | 14699 |

TABLE 19E-continued

5th Tier

| gRNA Name | DNA Strand | Targeting Domain | Target Site Length | SEQ ID NO: |
|---|---|---|---|---|
| BCL11A-12482 | + | CAACGCGGAAUCCAGCCUAAGU | 22 | 14700 |
| BCL11A-12483 | + | GCAACGCGGAAUCCAGCCUAAGU | 23 | 14701 |
| BCL11A-12484 | + | GGCAACGCGGAAUCCAGCCUAAGU | 24 | 14702 |
| BCL11A-12485 | + | CAUUUUCUUACGGUGAGU | 18 | 14703 |
| BCL11A-12486 | + | CCAUUUUCUUACGGUGAGU | 19 | 14704 |
| BCL11A-10244 | + | CCCAUUUUCUUACGGUGAGU | 20 | 14705 |
| BCL11A-12487 | + | CCCCAUUUUCUUACGGUGAGU | 21 | 14706 |
| BCL11A-12488 | + | CCCCCAUUUUCUUACGGUGAGU | 22 | 14707 |
| BCL11A-12489 | + | CCCCCCAUUUUCUUACGGUGAGU | 23 | 14708 |
| BCL11A-12490 | + | CCCCCCCAUUUUCUUACGGUGAGU | 24 | 14709 |
| BCL11A-12491 | + | CGCGCUCGCUCCCCGCGU | 18 | 14710 |
| BCL11A-12492 | + | CCGCGCUCGCUCCCCGCGU | 19 | 14711 |
| BCL11A-12493 | + | GCCGCGCUCGCUCCCCGCGU | 20 | 14712 |
| BCL11A-12494 | + | CGCCGCGCUCGCUCCCCGCGU | 21 | 14713 |
| BCL11A-12495 | + | CCGCCGCGCUCGCUCCCCGCGU | 22 | 14714 |
| BCL11A-12496 | + | GCCGCCGCGCUCGCUCCCCGCGU | 23 | 14715 |
| BCL11A-12497 | + | CGCCGCCGCGCUCGCUCCCCGCGU | 24 | 14716 |
| BCL11A-12498 | + | CAGCGGGCGAGGGGAGGU | 18 | 14717 |
| BCL11A-12499 | + | GCAGCGGGCGAGGGGAGGU | 19 | 14718 |
| BCL11A-10247 | + | CGCAGCGGGCGAGGGGAGGU | 20 | 14719 |
| BCL11A-12500 | + | CCGCAGCGGGCGAGGGGAGGU | 21 | 14720 |
| BCL11A-12501 | + | UCCGCAGCGGGCGAGGGGAGGU | 22 | 14721 |
| BCL11A-12502 | + | CUCCGCAGCGGGCGAGGGGAGGU | 23 | 14722 |
| BCL11A-12503 | + | GCUCCGCAGCGGGCGAGGGGAGGU | 24 | 14723 |
| BCL11A-12504 | + | GUUUGGAGGGCUGCGGGU | 18 | 14724 |
| BCL11A-12505 | + | AGUUUGGAGGGCUGCGGGU | 19 | 14725 |
| BCL11A-12506 | + | AAGUUUGGAGGGCUGCGGGU | 20 | 14726 |
| BCL11A-12507 | + | UAAGUUUGGAGGGCUGCGGGU | 21 | 14727 |
| BCL11A-12508 | + | CUAAGUUUGGAGGGCUGCGGGU | 22 | 14728 |
| BCL11A-12509 | + | CCUAAGUUUGGAGGGCUGCGGGU | 23 | 14729 |
| BCL11A-12510 | + | GCCUAAGUUUGGAGGGCUGCGGGU | 24 | 14730 |
| BCL11A-12511 | + | UGCCACUUUCUCACUAUU | 18 | 14731 |
| BCL11A-12512 | + | GUGCCACUUUCUCACUAUU | 19 | 14732 |
| BCL11A-12513 | + | AGUGCCACUUUCUCACUAUU | 20 | 14733 |
| BCL11A-12514 | + | CAGUGCCACUUUCUCACUAUU | 21 | 14734 |
| BCL11A-12515 | + | ACAGUGCCACUUUCUCACUAUU | 22 | 14735 |
| BCL11A-12516 | + | CACAGUGCCACUUUCUCACUAUU | 23 | 14736 |

TABLE 19E-continued

5th Tier

| gRNA Name | DNA Strand | Targeting Domain | Target Site Length | SEQ ID NO: |
|---|---|---|---|---|
| BCL11A-12517 | + | CCACAGUGCCACUUUCUCACUAUU | 24 | 14737 |
| BCL11A-12518 | + | GAAAAAUCACCCGAAGUU | 18 | 14738 |
| BCL11A-12519 | + | AGAAAAAUCACCCGAAGUU | 19 | 14739 |
| BCL11A-12520 | + | AAGAAAAAUCACCCGAAGUU | 20 | 14740 |
| BCL11A-12521 | + | AAAGAAAAAUCACCCGAAGUU | 21 | 14741 |
| BCL11A-12522 | + | CAAAGAAAAAUCACCCGAAGUU | 22 | 14742 |
| BCL11A-12523 | + | GCAAAGAAAAAUCACCCGAAGUU | 23 | 14743 |
| BCL11A-12524 | + | AGCAAAGAAAAAUCACCCGAAGUU | 24 | 14744 |
| BCL11A-12525 | + | CGGAAUCCAGCCUAAGUU | 18 | 14745 |
| BCL11A-12526 | + | GCGGAAUCCAGCCUAAGUU | 19 | 14746 |
| BCL11A-10257 | + | CGCGGAAUCCAGCCUAAGUU | 20 | 14747 |
| BCL11A-12527 | + | ACGCGGAAUCCAGCCUAAGUU | 21 | 14748 |
| BCL11A-12528 | + | AACGCGGAAUCCAGCCUAAGUU | 22 | 14749 |
| BCL11A-12529 | + | CAACGCGGAAUCCAGCCUAAGUU | 23 | 14750 |
| BCL11A-12530 | + | GCAACGCGGAAUCCAGCCUAAGUU | 24 | 14751 |
| BCL11A-12531 | + | GAAUCAUUGCAUUCCUUU | 18 | 14752 |
| BCL11A-12532 | + | GGAAUCAUUGCAUUCCUUU | 19 | 14753 |
| BCL11A-12533 | + | UGGAAUCAUUGCAUUCCUUU | 20 | 14754 |
| BCL11A-12534 | + | GUGGAAUCAUUGCAUUCCUUU | 21 | 14755 |
| BCL11A-12535 | + | AGUGGAAUCAUUGCAUUCCUUU | 22 | 14756 |
| BCL11A-12536 | + | GAGUGGAAUCAUUGCAUUCCUUU | 23 | 14757 |
| BCL11A-12537 | + | GGAGUGGAAUCAUUGCAUUCCUUU | 24 | 14758 |
| BCL11A-12538 | − | CCACUCACCGUAAGAAAA | 18 | 14759 |
| BCL11A-12539 | − | CCCACUCACCGUAAGAAAA | 19 | 14760 |
| BCL11A-10024 | − | UCCCACUCACCGUAAGAAAA | 20 | 14761 |
| BCL11A-12540 | − | UUCCCACUCACCGUAAGAAAA | 21 | 14762 |
| BCL11A-12541 | − | CUUCCCACUCACCGUAAGAAAA | 22 | 14763 |
| BCL11A-12542 | − | GCUUCCCACUCACCGUAAGAAAA | 23 | 14764 |
| BCL11A-12543 | − | UGCUUCCCACUCACCGUAAGAAAA | 24 | 14765 |
| BCL11A-12544 | − | CCCACUCACCGUAAGAAA | 18 | 14766 |
| BCL11A-12545 | − | UCCCACUCACCGUAAGAAA | 19 | 14767 |
| BCL11A-12546 | − | UUCCCACUCACCGUAAGAAA | 20 | 14768 |
| BCL11A-12547 | − | CUUCCCACUCACCGUAAGAAA | 21 | 14769 |
| BCL11A-12548 | − | GCUUCCCACUCACCGUAAGAAA | 22 | 14770 |
| BCL11A-12549 | − | UGCUUCCCACUCACCGUAAGAAA | 23 | 14771 |
| BCL11A-12550 | − | UUGCUUCCCACUCACCGUAAGAAA | 24 | 14772 |
| BCL11A-12551 | − | UGGGAGCUGGUGGGGAAA | 18 | 14773 |

TABLE 19E-continued

5th Tier

| gRNA Name | DNA Strand | Targeting Domain | Target Site Length | SEQ ID NO: |
|---|---|---|---|---|
| BCL11A-12552 | - | GUGGGAGCUGGUGGGGAAA | 19 | 14774 |
| BCL11A-10028 | - | GGUGGGAGCUGGUGGGGAAA | 20 | 14775 |
| BCL11A-12553 | - | GGGUGGGAGCUGGUGGGGAAA | 21 | 14776 |
| BCL11A-12554 | - | GGGGUGGGAGCUGGUGGGGAAA | 22 | 14777 |
| BCL11A-12555 | - | GGGGGUGGGAGCUGGUGGGGAAA | 23 | 14778 |
| BCL11A-12556 | - | UGGGGGUGGGAGCUGGUGGGGAAA | 24 | 14779 |
| BCL11A-12557 | - | AACGAUUCCCGGGGAGAA | 18 | 14780 |
| BCL11A-12558 | - | AAACGAUUCCCGGGGAGAA | 19 | 14781 |
| BCL11A-12559 | - | AAAACGAUUCCCGGGGAGAA | 20 | 14782 |
| BCL11A-12560 | - | AAAAACGAUUCCCGGGGAGAA | 21 | 14783 |
| BCL11A-12561 | - | AAAAAACGAUUCCCGGGGAGAA | 22 | 14784 |
| BCL11A-12562 | - | UAAAAAACGAUUCCCGGGGAGAA | 23 | 14785 |
| BCL11A-12563 | - | CUAAAAAACGAUUCCCGGGGAGAA | 24 | 14786 |
| BCL11A-12564 | - | UUUAUUUCUCUUUUCGAA | 18 | 14787 |
| BCL11A-12565 | - | CUUUAUUUCUCUUUUCGAA | 19 | 14788 |
| BCL11A-12566 | - | GCUUUAUUUCUCUUUUCGAA | 20 | 14789 |
| BCL11A-12567 | - | CGCUUUAUUUCUCUUUUCGAA | 21 | 14790 |
| BCL11A-12568 | - | CCGCUUUAUUUCUCUUUUCGAA | 22 | 14791 |
| BCL11A-12569 | - | GCCGCUUUAUUUCUCUUUUCGAA | 23 | 14792 |
| BCL11A-12570 | - | CGCCGCUUUAUUUCUCUUUUCGAA | 24 | 14793 |
| BCL11A-12571 | - | GUGGGAGCUGGUGGGGAA | 18 | 14794 |
| BCL11A-12572 | - | GGUGGGAGCUGGUGGGGAA | 19 | 14795 |
| BCL11A-10032 | - | GGGUGGGAGCUGGUGGGGAA | 20 | 14796 |
| BCL11A-12573 | - | GGGGUGGGAGCUGGUGGGGAA | 21 | 14797 |
| BCL11A-12574 | - | GGGGGUGGGAGCUGGUGGGGAA | 22 | 14798 |
| BCL11A-12575 | - | UGGGGGUGGGAGCUGGUGGGGAA | 23 | 14799 |
| BCL11A-12576 | - | CUGGGGGUGGGAGCUGGUGGGGAA | 24 | 14800 |
| BCL11A-12577 | - | GAAAGUGGCACUGUGGAA | 18 | 14801 |
| BCL11A-12578 | - | AGAAAGUGGCACUGUGGAA | 19 | 14802 |
| BCL11A-10033 | - | GAGAAAGUGGCACUGUGGAA | 20 | 14803 |
| BCL11A-12579 | - | UGAGAAAGUGGCACUGUGGAA | 21 | 14804 |
| BCL11A-12580 | - | GUGAGAAAGUGGCACUGUGGAA | 22 | 14805 |
| BCL11A-12581 | - | AGUGAGAAAGUGGCACUGUGGAA | 23 | 14806 |
| BCL11A-12582 | - | UAGUGAGAAAGUGGCACUGUGGAA | 24 | 14807 |
| BCL11A-12583 | - | CUCACGGUCAAGUGUGCA | 18 | 14808 |
| BCL11A-12584 | - | GCUCACGGUCAAGUGUGCA | 19 | 14809 |
| BCL11A-12585 | - | CGCUCACGGUCAAGUGUGCA | 20 | 14810 |

TABLE 19E-continued

5th Tier

| gRNA Name | DNA Strand | Targeting Domain | Target Site Length | SEQ ID NO: |
|---|---|---|---|---|
| BCL11A-12586 | - | GCGCUCACGGUCAAGUGUGCA | 21 | 14811 |
| BCL11A-12587 | - | CGCGCUCACGGUCAAGUGUGCA | 22 | 14812 |
| BCL11A-12588 | - | GCGCGCUCACGGUCAAGUGUGCA | 23 | 14813 |
| BCL11A-12589 | - | AGCGCGCUCACGGUCAAGUGUGCA | 24 | 14814 |
| BCL11A-12590 | - | GGAGAGGGGCCGCGGCGA | 18 | 14815 |
| BCL11A-12591 | - | GGGAGAGGGGCCGCGGCGA | 19 | 14816 |
| BCL11A-10043 | - | CGGGAGAGGGGCCGCGGCGA | 20 | 14817 |
| BCL11A-12592 | - | UCGGGAGAGGGGCCGCGGCGA | 21 | 14818 |
| BCL11A-12593 | - | GUCGGGAGAGGGGCCGCGGCGA | 22 | 14819 |
| BCL11A-12594 | - | AGUCGGGAGAGGGGCCGCGGCGA | 23 | 14820 |
| BCL11A-12595 | - | GAGUCGGGAGAGGGGCCGCGGCGA | 24 | 14821 |
| BCL11A-12596 | - | CCGUGGGACCGGGAAGGA | 18 | 14822 |
| BCL11A-12597 | - | GCCGUGGGACCGGGAAGGA | 19 | 14823 |
| BCL11A-10045 | - | AGCCGUGGGACCGGGAAGGA | 20 | 14824 |
| BCL11A-12598 | - | GAGCCGUGGGACCGGGAAGGA | 21 | 14825 |
| BCL11A-12599 | - | AGAGCCGUGGGACCGGGAAGGA | 22 | 14826 |
| BCL11A-12600 | - | GAGAGCCGUGGGACCGGGAAGGA | 23 | 14827 |
| BCL11A-12601 | - | GGAGAGCCGUGGGACCGGGAAGGA | 24 | 14828 |
| BCL11A-12602 | - | GAGUCCGCGGAGUCGGGA | 18 | 14829 |
| BCL11A-12603 | - | UGAGUCCGCGGAGUCGGGA | 19 | 14830 |
| BCL11A-12604 | - | CUGAGUCCGCGGAGUCGGGA | 20 | 14831 |
| BCL11A-12605 | - | CCUGAGUCCGCGGAGUCGGGA | 21 | 14832 |
| BCL11A-12606 | - | UCCUGAGUCCGCGGAGUCGGGA | 22 | 14833 |
| BCL11A-12607 | - | CUCCUGAGUCCGCGGAGUCGGGA | 23 | 14834 |
| BCL11A-12608 | - | GCUCCUGAGUCCGCGGAGUCGGGA | 24 | 14835 |
| BCL11A-12609 | - | GGCGUCCACACGCGGGA | 18 | 14836 |
| BCL11A-12610 | - | UGGCGUCCACACGCGGGGA | 19 | 14837 |
| BCL11A-12611 | - | CUGGCGUCCACACGCGGGGA | 20 | 14838 |
| BCL11A-12612 | - | CCUGGCGUCCACACGCGGGGA | 21 | 14839 |
| BCL11A-12613 | - | CCCUGGCGUCCACACGCGGGGA | 22 | 14840 |
| BCL11A-12614 | - | CCCCUGGCGUCCACACGCGGGGA | 23 | 14841 |
| BCL11A-12615 | - | GCCCCUGGCGUCCACACGCGGGGA | 24 | 14842 |
| BCL11A-12616 | - | GCGCGGCGGCGGCGGGGA | 18 | 14843 |
| BCL11A-12617 | - | AGCGCGGCGGCGGCGGGGA | 19 | 14844 |
| BCL11A-10051 | - | GAGCGCGGCGGCGGCGGGGA | 20 | 14845 |
| BCL11A-12618 | - | CGAGCGCGGCGGCGGCGGGGA | 21 | 14846 |
| BCL11A-12619 | - | GCGAGCGCGGCGGCGGCGGGGA | 22 | 14847 |

TABLE 19E-continued

5th Tier

| gRNA Name | DNA Strand | Targeting Domain | Target Site Length | SEQ ID NO: |
|---|---|---|---|---|
| BCL11A-12620 | - | AGCGAGCGCGGCGGCGGCGGGGA | 23 | 14848 |
| BCL11A-12621 | - | GAGCGAGCGCGGCGGCGGCGGGGA | 24 | 14849 |
| BCL11A-12622 | - | GGUGGGAGCUGGUGGGGA | 18 | 14850 |
| BCL11A-12623 | - | GGGUGGGAGCUGGUGGGGA | 19 | 14851 |
| BCL11A-12624 | - | GGGGUGGGAGCUGGUGGGGA | 20 | 14852 |
| BCL11A-12625 | - | GGGGGUGGGAGCUGGUGGGGA | 21 | 14853 |
| BCL11A-12626 | - | UGGGGGUGGGAGCUGGUGGGGA | 22 | 14854 |
| BCL11A-12627 | - | CUGGGGGUGGGAGCUGGUGGGGA | 23 | 14855 |
| BCL11A-12628 | - | CCUGGGGGUGGGAGCUGGUGGGGA | 24 | 14856 |
| BCL11A-12629 | - | ACGGGGAGAGCCGUGGGA | 18 | 14857 |
| BCL11A-12630 | - | GACGGGGAGAGCCGUGGGA | 19 | 14858 |
| BCL11A-12631 | - | CGACGGGGAGAGCCGUGGGA | 20 | 14859 |
| BCL11A-12632 | - | GCGACGGGGAGAGCCGUGGGA | 21 | 14860 |
| BCL11A-12633 | - | GGCGACGGGGAGAGCCGUGGGA | 22 | 14861 |
| BCL11A-12634 | - | CGGCGACGGGGAGAGCCGUGGGA | 23 | 14862 |
| BCL11A-12635 | - | GCGGCGACGGGGAGAGCCGUGGGA | 24 | 14863 |
| BCL11A-12636 | - | AGAAAGUGGCACUGUGGA | 18 | 14864 |
| BCL11A-12637 | - | GAGAAAGUGGCACUGUGGA | 19 | 14865 |
| BCL11A-12638 | - | UGAGAAAGUGGCACUGUGGA | 20 | 14866 |
| BCL11A-12639 | - | GUGAGAAAGUGGCACUGUGGA | 21 | 14867 |
| BCL11A-12640 | - | AGUGAGAAAGUGGCACUGUGGA | 22 | 14868 |
| BCL11A-12641 | - | UAGUGAGAAAGUGGCACUGUGGA | 23 | 14869 |
| BCL11A-12642 | - | AUAGUGAGAAAGUGGCACUGUGGA | 24 | 14870 |
| BCL11A-12643 | - | CGCCAGUUUUGCAAAAUA | 18 | 14871 |
| BCL11A-12644 | - | CCGCCAGUUUUGCAAAAUA | 19 | 14872 |
| BCL11A-12645 | - | CCCGCCAGUUUUGCAAAAUA | 20 | 14873 |
| BCL11A-12646 | - | CCCCGCCAGUUUUGCAAAAUA | 21 | 14874 |
| BCL11A-12647 | - | GCCCCGCCAGUUUUGCAAAAUA | 22 | 14875 |
| BCL11A-12648 | - | CGCCCCGCCAGUUUUGCAAAAUA | 23 | 14876 |
| BCL11A-12649 | - | CCGCCCCGCCAGUUUUGCAAAAUA | 24 | 14877 |
| BCL11A-12650 | - | GUAGUCAUCCCCACAAUA | 18 | 14878 |
| BCL11A-12651 | - | AGUAGUCAUCCCCACAAUA | 19 | 14879 |
| BCL11A-12652 | - | AAGUAGUCAUCCCCACAAUA | 20 | 14880 |
| BCL11A-12653 | - | AAAGUAGUCAUCCCCACAAUA | 21 | 14881 |
| BCL11A-12654 | - | GAAAGUAGUCAUCCCCACAAUA | 22 | 14882 |
| BCL11A-12655 | - | GGAAAGUAGUCAUCCCCACAAUA | 23 | 14883 |
| BCL11A-12656 | - | AGGAAAGUAGUCAUCCCCACAAUA | 24 | 14884 |

TABLE 19E-continued

5th Tier

| gRNA Name | DNA Strand | Targeting Domain | Target Site Length | SEQ ID NO: |
|---|---|---|---|---|
| BCL11A-12657 | - | GGGAAGUGGGUGUGCGUA | 18 | 14885 |
| BCL11A-12658 | - | GGGGAAGUGGGUGUGCGUA | 19 | 14886 |
| BCL11A-10055 | - | AGGGGAAGUGGGUGUGCGUA | 20 | 14887 |
| BCL11A-12659 | - | GAGGGGAAGUGGGUGUGCGUA | 21 | 14888 |
| BCL11A-12660 | - | GGAGGGGAAGUGGGUGUGCGUA | 22 | 14889 |
| BCL11A-12661 | - | GGGAGGGGAAGUGGGUGUGCGUA | 23 | 14890 |
| BCL11A-12662 | - | GGGGAGGGGAAGUGGGUGUGCGUA | 24 | 14891 |
| BCL11A-12663 | - | UAAGAAAAUGGGGGGGUA | 18 | 14892 |
| BCL11A-12664 | - | GUAAGAAAAUGGGGGGGUA | 19 | 14893 |
| BCL11A-10056 | - | CGUAAGAAAAUGGGGGGGUA | 20 | 14894 |
| BCL11A-12665 | - | CCGUAAGAAAAUGGGGGGGUA | 21 | 14895 |
| BCL11A-12666 | - | ACCGUAAGAAAAUGGGGGGGUA | 22 | 14896 |
| BCL11A-12667 | - | CACCGUAAGAAAAUGGGGGGGUA | 23 | 14897 |
| BCL11A-12668 | - | UCACCGUAAGAAAAUGGGGGGGUA | 24 | 14898 |
| BCL11A-12669 | - | AACAACUCACAUGCAAAC | 18 | 14899 |
| BCL11A-12670 | - | GAACAACUCACAUGCAAAC | 19 | 14900 |
| BCL11A-12671 | - | CGAACAACUCACAUGCAAAC | 20 | 14901 |
| BCL11A-12672 | - | GCGAACAACUCACAUGCAAAC | 21 | 14902 |
| BCL11A-12673 | - | UGCGAACAACUCACAUGCAAAC | 22 | 14903 |
| BCL11A-12674 | - | UUGCGAACAACUCACAUGCAAAC | 23 | 14904 |
| BCL11A-12675 | - | GUUGCGAACAACUCACAUGCAAAC | 24 | 14905 |
| BCL11A-12676 | - | CCGCUGCGGAGCUGUAAC | 18 | 14906 |
| BCL11A-12677 | - | CCCGCUGCGGAGCUGUAAC | 19 | 14907 |
| BCL11A-12678 | - | GCCCGCUGCGGAGCUGUAAC | 20 | 14908 |
| BCL11A-12679 | - | CGCCCGCUGCGGAGCUGUAAC | 21 | 14909 |
| BCL11A-12680 | - | UCGCCCGCUGCGGAGCUGUAAC | 22 | 14910 |
| BCL11A-12681 | - | CUCGCCCGCUGCGGAGCUGUAAC | 23 | 14911 |
| BCL11A-12682 | - | CCUCGCCCGCUGCGGAGCUGUAAC | 24 | 14912 |
| BCL11A-12683 | - | GGCCCCUGGCGUCCACAC | 18 | 14913 |
| BCL11A-12684 | - | CGGCCCCUGGCGUCCACAC | 19 | 14914 |
| BCL11A-12685 | - | UCGGCCCCUGGCGUCCACAC | 20 | 14915 |
| BCL11A-12686 | - | UUCGGCCCCUGGCGUCCACAC | 21 | 14916 |
| BCL11A-12687 | - | CUUCGGCCCCUGGCGUCCACAC | 22 | 14917 |
| BCL11A-12688 | - | ACUUCGGCCCCUGGCGUCCACAC | 23 | 14918 |
| BCL11A-12689 | - | UACUUCGGCCCCUGGCGUCCACAC | 24 | 14919 |
| BCL11A-12690 | - | GCGCGGGCUCCUGGAGAC | 18 | 14920 |
| BCL11A-12691 | - | CGCGCGGGCUCCUGGAGAC | 19 | 14921 |

TABLE 19E-continued

| | | 5th Tier | | |
|---|---|---|---|---|
| gRNA Name | DNA Strand | Targeting Domain | Target Site Length | SEQ ID NO: |
| BCL11A-12692 | - | CCGCGCGGGCUCCUGGAGAC | 20 | 14922 |
| BCL11A-12693 | - | GCCGCGCGGGCUCCUGGAGAC | 21 | 14923 |
| BCL11A-12694 | - | GGCCGCGCGGGCUCCUGGAGAC | 22 | 14924 |
| BCL11A-12695 | - | AGGCCGCGCGGGCUCCUGGAGAC | 23 | 14925 |
| BCL11A-12696 | - | CAGGCCGCGCGGGCUCCUGGAGAC | 24 | 14926 |
| BCL11A-12697 | - | GAGAGGGGCCGCGGCGAC | 18 | 14927 |
| BCL11A-12698 | - | GGAGAGGGGCCGCGGCGAC | 19 | 14928 |
| BCL11A-10061 | - | GGGAGAGGGGCCGCGGCGAC | 20 | 14929 |
| BCL11A-12699 | - | CGGGAGAGGGGCCGCGGCGAC | 21 | 14930 |
| BCL11A-12700 | - | UCGGGAGAGGGGCCGCGGCGAC | 22 | 14931 |
| BCL11A-12701 | - | GUCGGGAGAGGGGCCGCGGCGAC | 23 | 14932 |
| BCL11A-12702 | - | AGUCGGGAGAGGGGCCGCGGCGAC | 24 | 14933 |
| BCL11A-12703 | - | CGUGGGACCGGGAAGGAC | 18 | 14934 |
| BCL11A-12704 | - | CCGUGGGACCGGGAAGGAC | 19 | 14935 |
| BCL11A-10062 | - | GCCGUGGGACCGGGAAGGAC | 20 | 14936 |
| BCL11A-12705 | - | AGCCGUGGGACCGGGAAGGAC | 21 | 14937 |
| BCL11A-12706 | - | GAGCCGUGGGACCGGGAAGGAC | 22 | 14938 |
| BCL11A-12707 | - | AGAGCCGUGGGACCGGGAAGGAC | 23 | 14939 |
| BCL11A-12708 | - | GAGAGCCGUGGGACCGGGAAGGAC | 24 | 14940 |
| BCL11A-12709 | - | CGGGGAGAGCCGUGGGAC | 18 | 14941 |
| BCL11A-12710 | - | ACGGGGAGAGCCGUGGGAC | 19 | 14942 |
| BCL11A-10065 | - | GACGGGGAGAGCCGUGGGAC | 20 | 14943 |
| BCL11A-12711 | - | CGACGGGGAGAGCCGUGGGAC | 21 | 14944 |
| BCL11A-12712 | - | GCGACGGGGAGAGCCGUGGGAC | 22 | 14945 |
| BCL11A-12713 | - | GGCGACGGGGAGAGCCGUGGGAC | 23 | 14946 |
| BCL11A-12714 | - | CGGCGACGGGGAGAGCCGUGGGAC | 24 | 14947 |
| BCL11A-12715 | - | ACAACUCACAUGCAAACC | 18 | 14948 |
| BCL11A-12716 | - | AACAACUCACAUGCAAACC | 19 | 14949 |
| BCL11A-10066 | - | GAACAACUCACAUGCAAACC | 20 | 14950 |
| BCL11A-12717 | - | CGAACAACUCACAUGCAAACC | 21 | 14951 |
| BCL11A-12718 | - | GCGAACAACUCACAUGCAAACC | 22 | 14952 |
| BCL11A-12719 | - | UGCGAACAACUCACAUGCAAACC | 23 | 14953 |
| BCL11A-12720 | - | UUGCGAACAACUCACAUGCAAACC | 24 | 14954 |
| BCL11A-12721 | - | GGGGAGAGCCGUGGGACC | 18 | 14955 |
| BCL11A-12722 | - | CGGGGAGAGCCGUGGGACC | 19 | 14956 |
| BCL11A-10070 | - | ACGGGGAGAGCCGUGGGACC | 20 | 14957 |
| BCL11A-12723 | - | GACGGGGAGAGCCGUGGGACC | 21 | 14958 |

TABLE 19E-continued

5th Tier

| gRNA Name | DNA Strand | Targeting Domain | Target Site Length | SEQ ID NO: |
|---|---|---|---|---|
| BCL11A-12724 | - | CGACGGGGAGAGCCGUGGGACC | 22 | 14959 |
| BCL11A-12725 | - | GCGACGGGGAGAGCCGUGGGACC | 23 | 14960 |
| BCL11A-12726 | - | GGCGACGGGGAGAGCCGUGGGACC | 24 | 14961 |
| BCL11A-12727 | - | UCGGCCUUGGGGGCGCCC | 18 | 14962 |
| BCL11A-12728 | - | CUCGGCCUUGGGGGCGCCC | 19 | 14963 |
| BCL11A-12729 | - | GCUCGGCCUUGGGGGCGCCC | 20 | 14964 |
| BCL11A-12730 | - | GGCUCGGCCUUGGGGGCGCCC | 21 | 14965 |
| BCL11A-12731 | - | UGGCUCGGCCUUGGGGGCGCCC | 22 | 14966 |
| BCL11A-12732 | - | CUGGCUCGGCCUUGGGGGCGCCC | 23 | 14967 |
| BCL11A-12733 | - | CCUGGCUCGGCCUUGGGGGCGCCC | 24 | 14968 |
| BCL11A-12734 | - | GUCUAAAAAACGAUUCCC | 18 | 14969 |
| BCL11A-12735 | - | AGUCUAAAAAACGAUUCCC | 19 | 14970 |
| BCL11A-10082 | - | AAGUCUAAAAAACGAUUCCC | 20 | 14971 |
| BCL11A-12736 | - | CAAGUCUAAAAAACGAUUCCC | 21 | 14972 |
| BCL11A-12737 | - | ACAAGUCUAAAAAACGAUUCCC | 22 | 14973 |
| BCL11A-12738 | - | UACAAGUCUAAAAAACGAUUCCC | 23 | 14974 |
| BCL11A-12739 | - | GUACAAGUCUAAAAAACGAUUCCC | 24 | 14975 |
| BCL11A-12740 | - | GCCCGCGCUUCCCCAGCC | 18 | 14976 |
| BCL11A-12741 | - | CGCCCGCGCUUCCCCAGCC | 19 | 14977 |
| BCL11A-10084 | - | CCGCCCGCGCUUCCCCAGCC | 20 | 14978 |
| BCL11A-12742 | - | UCCGCCCGCGCUUCCCCAGCC | 21 | 14979 |
| BCL11A-12743 | - | CUCCGCCCGCGCUUCCCCAGCC | 22 | 14980 |
| BCL11A-12744 | - | CCUCCGCCCGCGCUUCCCCAGCC | 23 | 14981 |
| BCL11A-12745 | - | CCCUCCGCCCGCGCUUCCCCAGCC | 24 | 14982 |
| BCL11A-12746 | - | AGUUUCCCGAGCGCAGCC | 18 | 14983 |
| BCL11A-12747 | - | AAGUUUCCCGAGCGCAGCC | 19 | 14984 |
| BCL11A-12748 | - | AAAGUUUCCCGAGCGCAGCC | 20 | 14985 |
| BCL11A-12749 | - | CAAAGUUUCCCGAGCGCAGCC | 21 | 14986 |
| BCL11A-12750 | - | GCAAAGUUUCCCGAGCGCAGCC | 22 | 14987 |
| BCL11A-12751 | - | GGCAAAGUUUCCCGAGCGCAGCC | 23 | 14988 |
| BCL11A-12752 | - | GGGCAAAGUUUCCCGAGCGCAGCC | 24 | 14989 |
| BCL11A-12753 | - | GCGGCGACGGGGAGAGCC | 18 | 14990 |
| BCL11A-12754 | - | CGCGGCGACGGGGAGAGCC | 19 | 14991 |
| BCL11A-12755 | - | CCGCGGCGACGGGGAGAGCC | 20 | 14992 |
| BCL11A-12756 | - | GCCGCGGCGACGGGGAGAGCC | 21 | 14993 |
| BCL11A-12757 | - | GGCCGCGGCGACGGGGAGAGCC | 22 | 14994 |
| BCL11A-12758 | - | GGGCCGCGGCGACGGGGAGAGCC | 23 | 14995 |

TABLE 19E-continued

| gRNA Name | DNA Strand | Targeting Domain | Target Site Length | SEQ ID NO: |
|---|---|---|---|---|
| | | 5th Tier | | |
| BCL11A-12759 | - | GGGGCCGCGGCGACGGGGAGAGCC | 24 | 14996 |
| BCL11A-12760 | - | CCGGUCCCUGGCUCGGCC | 18 | 14997 |
| BCL11A-12761 | - | CCCGGUCCCUGGCUCGGCC | 19 | 14998 |
| BCL11A-12762 | - | UCCCGGUCCCUGGCUCGGCC | 20 | 14999 |
| BCL11A-12763 | - | CCAGGCCGCGCGGGCUCC | 18 | 15000 |
| BCL11A-12764 | - | UCCAGGCCGCGCGGGCUCC | 19 | 15001 |
| BCL11A-10091 | - | UUCCAGGCCGCGCGGGCUCC | 20 | 15002 |
| BCL11A-12765 | - | UUUCCAGGCCGCGCGGGCUCC | 21 | 15003 |
| BCL11A-12766 | - | CUUUCCAGGCCGCGCGGGCUCC | 22 | 15004 |
| BCL11A-12767 | - | UCUUUCCAGGCCGCGCGGGCUCC | 23 | 15005 |
| BCL11A-12768 | - | CUCUUUCCAGGCCGCGCGGGCUCC | 24 | 15006 |
| BCL11A-12769 | - | UUCUUUGCUGUCCUCUCC | 18 | 15007 |
| BCL11A-12770 | - | UUUCUUUGCUGUCCUCUCC | 19 | 15008 |
| BCL11A-12771 | - | UUUUCUUUGCUGUCCUCUCC | 20 | 15009 |
| BCL11A-12772 | - | UUUUUCUUUGCUGUCCUCUCC | 21 | 15010 |
| BCL11A-12773 | - | AUUUUUCUUUGCUGUCCUCUCC | 22 | 15011 |
| BCL11A-12774 | - | GAUUUUUCUUUGCUGUCCUCUCC | 23 | 15012 |
| BCL11A-12775 | - | UGAUUUUUCUUUGCUGUCCUCUCC | 24 | 15013 |
| BCL11A-12776 | - | CCCGGCGCUCCUGAGUCC | 18 | 15014 |
| BCL11A-12777 | - | CCCCGGCGCUCCUGAGUCC | 19 | 15015 |
| BCL11A-12778 | - | CCCCCGGCGCUCCUGAGUCC | 20 | 15016 |
| BCL11A-12779 | - | GCCCCCGGCGCUCCUGAGUCC | 21 | 15017 |
| BCL11A-12780 | - | GGCCCCCGGCGCUCCUGAGUCC | 22 | 15018 |
| BCL11A-12781 | - | GGGCCCCCGGCGCUCCUGAGUCC | 23 | 15019 |
| BCL11A-12782 | - | GGGGCCCCCGGCGCUCCUGAGUCC | 24 | 15020 |
| BCL11A-12783 | - | GUACGGAGGAGGGUGUCC | 18 | 15021 |
| BCL11A-12784 | - | CGUACGGAGGAGGGUGUCC | 19 | 15022 |
| BCL11A-10094 | - | GCGUACGGAGGAGGGUGUCC | 20 | 15023 |
| BCL11A-12785 | - | UGCGUACGGAGGAGGGUGUCC | 21 | 15024 |
| BCL11A-12786 | - | GUGCGUACGGAGGAGGGUGUCC | 22 | 15025 |
| BCL11A-12787 | - | UGUGCGUACGGAGGAGGGUGUCC | 23 | 15026 |
| BCL11A-12788 | - | GUGUGCGUACGGAGGAGGGUGUCC | 24 | 15027 |
| BCL11A-12789 | - | AGUCUAAAAACGAUUCC | 18 | 15028 |
| BCL11A-12790 | - | AAGUCUAAAAACGAUUCC | 19 | 15029 |
| BCL11A-10095 | - | CAAGUCUAAAAACGAUUCC | 20 | 15030 |
| BCL11A-12791 | - | ACAAGUCUAAAAACGAUUCC | 21 | 15031 |
| BCL11A-12792 | - | UACAAGUCUAAAAACGAUUCC | 22 | 15032 |

TABLE 19E-continued

5th Tier

| gRNA Name | DNA Strand | Targeting Domain | Target Site Length | SEQ ID NO: |
|---|---|---|---|---|
| BCL11A-12793 | - | GUACAAGUCUAAAAAACGAUUCC | 23 | 15033 |
| BCL11A-12794 | - | AGUACAAGUCUAAAAAACGAUUCC | 24 | 15034 |
| BCL11A-12795 | - | CGCCCGCGCUUCCCCAGC | 18 | 15035 |
| BCL11A-12796 | - | CCGCCCGCGCUUCCCCAGC | 19 | 15036 |
| BCL11A-12797 | - | UCCGCCCGCGCUUCCCCAGC | 20 | 15037 |
| BCL11A-12798 | - | CUCCGCCCGCGCUUCCCCAGC | 21 | 15038 |
| BCL11A-12799 | - | CCUCCGCCCGCGCUUCCCCAGC | 22 | 15039 |
| BCL11A-12800 | - | CCCUCCGCCCGCGCUUCCCCAGC | 23 | 15040 |
| BCL11A-12801 | - | UCCCUCCGCCCGCGCUUCCCCAGC | 24 | 15041 |
| BCL11A-12802 | - | CACGGUCAAGUGUGCAGC | 18 | 15042 |
| BCL11A-12803 | - | UCACGGUCAAGUGUGCAGC | 19 | 15043 |
| BCL11A-10100 | - | CUCACGGUCAAGUGUGCAGC | 20 | 15044 |
| BCL11A-12804 | - | GCUCACGGUCAAGUGUGCAGC | 21 | 15045 |
| BCL11A-12805 | - | CGCUCACGGUCAAGUGUGCAGC | 22 | 15046 |
| BCL11A-12806 | - | GCGCUCACGGUCAAGUGUGCAGC | 23 | 15047 |
| BCL11A-12807 | - | CGCGCUCACGGUCAAGUGUGCAGC | 24 | 15048 |
| BCL11A-12808 | - | CCCCUGGCGUCCACACGC | 18 | 15049 |
| BCL11A-12809 | - | GCCCCUGGCGUCCACACGC | 19 | 15050 |
| BCL11A-10103 | - | GGCCCCUGGCGUCCACACGC | 20 | 15051 |
| BCL11A-12810 | - | CGGCCCCUGGCGUCCACACGC | 21 | 15052 |
| BCL11A-12811 | - | UCGGCCCCUGGCGUCCACACGC | 22 | 15053 |
| BCL11A-12812 | - | UUCGGCCCCUGGCGUCCACACGC | 23 | 15054 |
| BCL11A-12813 | - | CUUCGGCCCCUGGCGUCCACACGC | 24 | 15055 |
| BCL11A-12814 | - | CCCCUCUUUCCAGGCCGC | 18 | 15056 |
| BCL11A-12815 | - | UCCCCUCUUUCCAGGCCGC | 19 | 15057 |
| BCL11A-12816 | - | GUCCCCUCUUUCCAGGCCGC | 20 | 15058 |
| BCL11A-12817 | - | GGUCCCCUCUUUCCAGGCCGC | 21 | 15059 |
| BCL11A-12818 | - | CGGUCCCCUCUUUCCAGGCCGC | 22 | 15060 |
| BCL11A-12819 | - | CCGGUCCCCUCUUUCCAGGCCGC | 23 | 15061 |
| BCL11A-12820 | - | CCCGGUCCCCUCUUUCCAGGCCGC | 24 | 15062 |
| BCL11A-12821 | - | GCCGCCUUUUGUUCCGGC | 18 | 15063 |
| BCL11A-12822 | - | UGCCGCCUUUUGUUCCGGC | 19 | 15064 |
| BCL11A-12823 | - | CUGCCGCCUUUUGUUCCGGC | 20 | 15065 |
| BCL11A-12824 | - | ACUGCCGCCUUUUGUUCCGGC | 21 | 15066 |
| BCL11A-12825 | - | CACUGCCGCCUUUUGUUCCGGC | 22 | 15067 |
| BCL11A-12826 | - | GCACUGCCGCCUUUUGUUCCGGC | 23 | 15068 |
| BCL11A-12827 | - | GGCACUGCCGCCUUUUGUUCCGGC | 24 | 15069 |

TABLE 19E-continued

5th Tier

| gRNA Name | DNA Strand | Targeting Domain | Target Site Length | SEQ ID NO: |
|---|---|---|---|---|
| BCL11A-12828 | - | AGCGAGCGCGGCGGCGGC | 18 | 15070 |
| BCL11A-12829 | - | GAGCGAGCGCGGCGGCGGC | 19 | 15071 |
| BCL11A-10114 | - | GGAGCGAGCGCGGCGGCGGC | 20 | 15072 |
| BCL11A-12830 | - | GGGAGCGAGCGCGGCGGCGGC | 21 | 15073 |
| BCL11A-12831 | - | GGGGAGCGAGCGCGGCGGCGGC | 22 | 15074 |
| BCL11A-12832 | - | CGGGGAGCGAGCGCGGCGGCGGC | 23 | 15075 |
| BCL11A-12833 | - | GCGGGGAGCGAGCGCGGCGGCGGC | 24 | 15076 |
| BCL11A-12834 | - | CCGAGCGCAGCCGCGGGC | 18 | 15077 |
| BCL11A-12835 | - | CCCGAGCGCAGCCGCGGGC | 19 | 15078 |
| BCL11A-12836 | - | UCCCGAGCGCAGCCGCGGGC | 20 | 15079 |
| BCL11A-12837 | - | UUCCCGAGCGCAGCCGCGGGC | 21 | 15080 |
| BCL11A-12838 | - | UUUCCCGAGCGCAGCCGCGGGC | 22 | 15081 |
| BCL11A-12839 | - | GUUUCCCGAGCGCAGCCGCGGGC | 23 | 15082 |
| BCL11A-12840 | - | AGUUUCCCGAGCGCAGCCGCGGGC | 24 | 15083 |
| BCL11A-12841 | - | UCCAGGCCGCGCGGGCUC | 18 | 15084 |
| BCL11A-12842 | - | UUCCAGGCCGCGCGGGCUC | 19 | 15085 |
| BCL11A-12843 | - | UUUCCAGGCCGCGCGGGCUC | 20 | 15086 |
| BCL11A-12844 | - | CUUUCCAGGCCGCGCGGGCUC | 21 | 15087 |
| BCL11A-12845 | - | UCUUUCCAGGCCGCGCGGGCUC | 22 | 15088 |
| BCL11A-12846 | - | CUCUUUCCAGGCCGCGCGGGCUC | 23 | 15089 |
| BCL11A-12847 | - | CCUCUUUCCAGGCCGCGCGGGCUC | 24 | 15090 |
| BCL11A-12848 | - | UCCUGAGUCCGCGGAGUC | 18 | 15091 |
| BCL11A-12849 | - | CUCCUGAGUCCGCGGAGUC | 19 | 15092 |
| BCL11A-10128 | - | GCUCCUGAGUCCGCGGAGUC | 20 | 15093 |
| BCL11A-12850 | - | CGCUCCUGAGUCCGCGGAGUC | 21 | 15094 |
| BCL11A-12851 | - | GCGCUCCUGAGUCCGCGGAGUC | 22 | 15095 |
| BCL11A-12852 | - | GGCGCUCCUGAGUCCGCGGAGUC | 23 | 15096 |
| BCL11A-12853 | - | CGGCGCUCCUGAGUCCGCGGAGUC | 24 | 15097 |
| BCL11A-12854 | - | CGUACGGAGGAGGGUGUC | 18 | 15098 |
| BCL11A-12855 | - | GCGUACGGAGGAGGGUGUC | 19 | 15099 |
| BCL11A-10130 | - | UGCGUACGGAGGAGGGUGUC | 20 | 15100 |
| BCL11A-12856 | - | GUGCGUACGGAGGAGGGUGUC | 21 | 15101 |
| BCL11A-12857 | - | UGUGCGUACGGAGGAGGGUGUC | 22 | 15102 |
| BCL11A-12858 | - | GUGUGCGUACGGAGGAGGGUGUC | 23 | 15103 |
| BCL11A-12859 | - | GGUGUGCGUACGGAGGAGGGUGUC | 24 | 15104 |
| BCL11A-12860 | - | AAGUCUAAAAACGAUUC | 18 | 15105 |
| BCL11A-12861 | - | CAAGUCUAAAAACGAUUC | 19 | 15106 |

TABLE 19E-continued

5th Tier

| gRNA Name | DNA Strand | Targeting Domain | Target Site Length | SEQ ID NO: |
|---|---|---|---|---|
| BCL11A-12862 | - | ACAAGUCUAAAAAACGAUUC | 20 | 15107 |
| BCL11A-12863 | - | UACAAGUCUAAAAAACGAUUC | 21 | 15108 |
| BCL11A-12864 | - | GUACAAGUCUAAAAAACGAUUC | 22 | 15109 |
| BCL11A-12865 | - | AGUACAAGUCUAAAAAACGAUUC | 23 | 15110 |
| BCL11A-12866 | - | GAGUACAAGUCUAAAAAACGAUUC | 24 | 15111 |
| BCL11A-12867 | - | CUCCUCGGGCAAAGUUUC | 18 | 15112 |
| BCL11A-12868 | - | UCUCCUCGGGCAAAGUUUC | 19 | 15113 |
| BCL11A-12869 | - | CUCUCCUCGGGCAAAGUUUC | 20 | 15114 |
| BCL11A-12870 | - | CCUCUCCUCGGGCAAAGUUUC | 21 | 15115 |
| BCL11A-12871 | - | UCCUCUCCUCGGGCAAAGUUUC | 22 | 15116 |
| BCL11A-12872 | - | GUCCUCUCCUCGGGCAAAGUUUC | 23 | 15117 |
| BCL11A-12873 | - | UGUCCUCUCCUCGGGCAAAGUUUC | 24 | 15118 |
| BCL11A-12874 | - | UCACGGUCAAGUGUGCAG | 18 | 15119 |
| BCL11A-12875 | - | CUCACGGUCAAGUGUGCAG | 19 | 15120 |
| BCL11A-10145 | - | GCUCACGGUCAAGUGUGCAG | 20 | 15121 |
| BCL11A-12876 | - | CGCUCACGGUCAAGUGUGCAG | 21 | 15122 |
| BCL11A-12877 | - | GCGCUCACGGUCAAGUGUGCAG | 22 | 15123 |
| BCL11A-12878 | - | CGCGCUCACGGUCAAGUGUGCAG | 23 | 15124 |
| BCL11A-12879 | - | GCGCGCUCACGGUCAAGUGUGCAG | 24 | 15125 |
| BCL11A-12880 | - | UUCCCGGGGAGAAAAGAG | 18 | 15126 |
| BCL11A-12881 | - | AUUCCCGGGGAGAAAAGAG | 19 | 15127 |
| BCL11A-12882 | - | GAUUCCCGGGGAGAAAAGAG | 20 | 15128 |
| BCL11A-12883 | - | CGAUUCCCGGGGAGAAAAGAG | 21 | 15129 |
| BCL11A-12884 | - | ACGAUUCCCGGGGAGAAAAGAG | 22 | 15130 |
| BCL11A-12885 | - | AACGAUUCCCGGGGAGAAAAGAG | 23 | 15131 |
| BCL11A-12886 | - | AAACGAUUCCCGGGGAGAAAAGAG | 24 | 15132 |
| BCL11A-12887 | - | GCUCCUGAGUCCGCGGAG | 18 | 15133 |
| BCL11A-12888 | - | CGCUCCUGAGUCCGCGGAG | 19 | 15134 |
| BCL11A-12889 | - | GCGCUCCUGAGUCCGCGGAG | 20 | 15135 |
| BCL11A-12890 | - | GGCGCUCCUGAGUCCGCGGAG | 21 | 15136 |
| BCL11A-12891 | - | CGGCGCUCCUGAGUCCGCGGAG | 22 | 15137 |
| BCL11A-12892 | - | CCGGCGCUCCUGAGUCCGCGGAG | 23 | 15138 |
| BCL11A-12893 | - | CCCGGCGCUCCUGAGUCCGCGGAG | 24 | 15139 |
| BCL11A-12894 | - | AGUCCGCGGAGUCGGGAG | 18 | 15140 |
| BCL11A-12895 | - | GAGUCCGCGGAGUCGGGAG | 19 | 15141 |
| BCL11A-10150 | - | UGAGUCCGCGGAGUCGGGAG | 20 | 15142 |
| BCL11A-12896 | - | CUGAGUCCGCGGAGUCGGGAG | 21 | 15143 |

TABLE 19E-continued

5th Tier

| gRNA Name | DNA Strand | Targeting Domain | Target Site Length | SEQ ID NO: |
|---|---|---|---|---|
| BCL11A-12897 | - | CCUGAGUCCGCGGAGUCGGAG | 22 | 15144 |
| BCL11A-12898 | - | UCCUGAGUCCGCGGAGUCGGGAG | 23 | 15145 |
| BCL11A-12899 | - | CUCCUGAGUCCGCGGAGUCGGGAG | 24 | 15146 |
| BCL11A-12900 | - | CGCGGCGGCGGCGGGGAG | 18 | 15147 |
| BCL11A-12901 | - | GCGCGGCGGCGGCGGGGAG | 19 | 15148 |
| BCL11A-10152 | - | AGCGCGGCGGCGGCGGGGAG | 20 | 15149 |
| BCL11A-12902 | - | GAGCGCGGCGGCGGCGGGGAG | 21 | 15150 |
| BCL11A-12903 | - | CGAGCGCGGCGGCGGCGGGGAG | 22 | 15151 |
| BCL11A-12904 | - | GCGAGCGCGGCGGCGGCGGGGAG | 23 | 15152 |
| BCL11A-12905 | - | AGCGAGCGCGGCGGCGGCGGGGAG | 24 | 15153 |
| BCL11A-11434 | - | CGCGUGUGUGGGGGGGAG | 18 | 15154 |
| BCL11A-11435 | - | CCGCGUGUGUGGGGGGGAG | 19 | 15155 |
| BCL11A-11436 | - | UCCGCGUGUGUGGGGGGGAG | 20 | 15156 |
| BCL11A-11437 | - | GUCCGCGUGUGUGGGGGGGAG | 21 | 15157 |
| BCL11A-11438 | - | AGUCCGCGUGUGUGGGGGGGAG | 22 | 15158 |
| BCL11A-11439 | - | GAGUCCGCGUGUGUGGGGGGGAG | 23 | 15159 |
| BCL11A-11440 | - | AGAGUCCGCGUGUGUGGGGGGGAG | 24 | 15160 |
| BCL11A-12906 | - | GCCCUGGCGUCCACACG | 18 | 15161 |
| BCL11A-12907 | - | GGCCCUGGCGUCCACACG | 19 | 15162 |
| BCL11A-10156 | - | CGGCCCUGGCGUCCACACG | 20 | 15163 |
| BCL11A-12908 | - | UCGGCCCUGGCGUCCACACG | 21 | 15164 |
| BCL11A-12909 | - | UUCGGCCCUGGCGUCCACACG | 22 | 15165 |
| BCL11A-12910 | - | CUUCGGCCCUGGCGUCCACACG | 23 | 15166 |
| BCL11A-12911 | - | ACUUCGGCCCUGGCGUCCACACG | 24 | 15167 |
| BCL11A-12912 | - | AGAGGGGCCGCGGCGACG | 18 | 15168 |
| BCL11A-12913 | - | GAGAGGGGCCGCGGCGACG | 19 | 15169 |
| BCL11A-10158 | - | GGAGAGGGGCCGCGGCGACG | 20 | 15170 |
| BCL11A-12914 | - | GGGAGAGGGGCCGCGGCGACG | 21 | 15171 |
| BCL11A-12915 | - | CGGGAGAGGGGCCGCGGCGACG | 22 | 15172 |
| BCL11A-12916 | - | UCGGGAGAGGGGCCGCGGCGACG | 23 | 15173 |
| BCL11A-12917 | - | GUCGGGAGAGGGGCCGCGGCGACG | 24 | 15174 |
| BCL11A-12918 | - | GAAGUGGGUGUGCGUACG | 18 | 15175 |
| BCL11A-12919 | - | GGAAGUGGGUGUGCGUACG | 19 | 15176 |
| BCL11A-12920 | - | GGGAAGUGGGUGUGCGUACG | 20 | 15177 |
| BCL11A-12921 | - | GGGGAAGUGGGUGUGCGUACG | 21 | 15178 |
| BCL11A-12922 | - | AGGGGAAGUGGGUGUGCGUACG | 22 | 15179 |
| BCL11A-12923 | - | GAGGGGAAGUGGGUGUGCGUACG | 23 | 15180 |

TABLE 19E-continued

5th Tier

| gRNA Name | DNA Strand | Targeting Domain | Target Site Length | SEQ ID NO: |
|---|---|---|---|---|
| BCL11A-12924 | – | GGAGGGGAAGUGGGUGUGCGUACG | 24 | 15181 |
| BCL11A-12925 | – | UCUAAAAAACGAUUCCCG | 18 | 15182 |
| BCL11A-12926 | – | GUCUAAAAAACGAUUCCCG | 19 | 15183 |
| BCL11A-10164 | – | AGUCUAAAAAACGAUUCCCG | 20 | 15184 |
| BCL11A-12927 | – | AAGUCUAAAAAACGAUUCCCG | 21 | 15185 |
| BCL11A-12928 | – | CAAGUCUAAAAAACGAUUCCCG | 22 | 15186 |
| BCL11A-12929 | – | ACAAGUCUAAAAAACGAUUCCCG | 23 | 15187 |
| BCL11A-12930 | – | UACAAGUCUAAAAAACGAUUCCCG | 24 | 15188 |
| BCL11A-12931 | – | CGGCGACGGGGAGAGCCG | 18 | 15189 |
| BCL11A-12932 | – | GCGGCGACGGGGAGAGCCG | 19 | 15190 |
| BCL11A-10166 | – | CGCGGCGACGGGGAGAGCCG | 20 | 15191 |
| BCL11A-12933 | – | CCGCGGCGACGGGGAGAGCCG | 21 | 15192 |
| BCL11A-12934 | – | GCCGCGGCGACGGGGAGAGCCG | 22 | 15193 |
| BCL11A-12935 | – | GGCCGCGGCGACGGGGAGAGCCG | 23 | 15194 |
| BCL11A-12936 | – | GGGCCGCGGCGACGGGGAGAGCCG | 24 | 15195 |
| BCL11A-12937 | – | CCCUGGCGUCCACACGCG | 18 | 15196 |
| BCL11A-12938 | – | CCCCUGGCGUCCACACGCG | 19 | 15197 |
| BCL11A-10175 | – | GCCCCUGGCGUCCACACGCG | 20 | 15198 |
| BCL11A-12939 | – | GGCCCCUGGCGUCCACACGCG | 21 | 15199 |
| BCL11A-12940 | – | CGGCCCCUGGCGUCCACACGCG | 22 | 15200 |
| BCL11A-12941 | – | UCGGCCCCUGGCGUCCACACGCG | 23 | 15201 |
| BCL11A-12942 | – | UUCGGCCCCUGGCGUCCACACGCG | 24 | 15202 |
| BCL11A-12943 | – | GGGAGAGGGGCCGCGGCG | 18 | 15203 |
| BCL11A-12944 | – | CGGGAGAGGGGCCGCGGCG | 19 | 15204 |
| BCL11A-12945 | – | UCGGGAGAGGGGCCGCGGCG | 20 | 15205 |
| BCL11A-12946 | – | GUCGGGAGAGGGGCCGCGGCG | 21 | 15206 |
| BCL11A-12947 | – | AGUCGGGAGAGGGGCCGCGGCG | 22 | 15207 |
| BCL11A-12948 | – | GAGUCGGGAGAGGGGCCGCGGCG | 23 | 15208 |
| BCL11A-12949 | – | GGAGUCGGGAGAGGGGCCGCGGCG | 24 | 15209 |
| BCL11A-12950 | – | GGAGCGAGCGCGGCGGCG | 18 | 15210 |
| BCL11A-12951 | – | GGGAGCGAGCGCGGCGGCG | 19 | 15211 |
| BCL11A-12952 | – | GGGGAGCGAGCGCGGCGGCG | 20 | 15212 |
| BCL11A-12953 | – | CGGGGAGCGAGCGCGGCGGCG | 21 | 15213 |
| BCL11A-12954 | – | GCGGGGAGCGAGCGCGGCGGCG | 22 | 15214 |
| BCL11A-12955 | – | CGCGGGGAGCGAGCGCGGCGGCG | 23 | 15215 |
| BCL11A-12956 | – | ACGCGGGGAGCGAGCGCGGCGGCG | 24 | 15216 |
| BCL11A-12957 | – | GCGAGCGCGGCGGCGGCG | 18 | 15217 |

TABLE 19E-continued

5th Tier

| gRNA Name | DNA Strand | Targeting Domain | Target Site Length | SEQ ID NO: |
|---|---|---|---|---|
| BCL11A-12958 | - | AGCGAGCGCGGCGGCGGCG | 19 | 15218 |
| BCL11A-10179 | - | GAGCGAGCGCGGCGGCGGCG | 20 | 15219 |
| BCL11A-12959 | - | GGAGCGAGCGCGGCGGCGGCG | 21 | 15220 |
| BCL11A-12960 | - | GGGAGCGAGCGCGGCGGCGGCG | 22 | 15221 |
| BCL11A-12961 | - | GGGGAGCGAGCGCGGCGGCGGCG | 23 | 15222 |
| BCL11A-12962 | - | CGGGGAGCGAGCGCGGCGGCGGCG | 24 | 15223 |
| BCL11A-12963 | - | GCCGUGGGACCGGGAAGG | 18 | 15224 |
| BCL11A-12964 | - | AGCCGUGGGACCGGGAAGG | 19 | 15225 |
| BCL11A-12965 | - | GAGCCGUGGGACCGGGAAGG | 20 | 15226 |
| BCL11A-12966 | - | AGAGCCGUGGGACCGGGAAGG | 21 | 15227 |
| BCL11A-12967 | - | GAGAGCCGUGGGACCGGGAAGG | 22 | 15228 |
| BCL11A-12968 | - | GGAGAGCCGUGGGACCGGGAAGG | 23 | 15229 |
| BCL11A-12969 | - | GGGAGAGCCGUGGGACCGGGAAGG | 24 | 15230 |
| BCL11A-12970 | - | AGAAAAUGGGGGGUAGG | 18 | 15231 |
| BCL11A-12971 | - | AAGAAAAUGGGGGGUAGG | 19 | 15232 |
| BCL11A-12972 | - | UAAGAAAAUGGGGGGUAGG | 20 | 15233 |
| BCL11A-12973 | - | GUAAGAAAAUGGGGGGUAGG | 21 | 15234 |
| BCL11A-12974 | - | CGUAAGAAAAUGGGGGGUAGG | 22 | 15235 |
| BCL11A-12975 | - | CCGUAAGAAAAUGGGGGGUAGG | 23 | 15236 |
| BCL11A-12976 | - | ACCGUAAGAAAAUGGGGGGUAGG | 24 | 15237 |
| BCL11A-12977 | - | AAGUGGGUGUGCGUACGG | 18 | 15238 |
| BCL11A-12978 | - | GAAGUGGGUGUGCGUACGG | 19 | 15239 |
| BCL11A-10191 | - | GGAAGUGGGUGUGCGUACGG | 20 | 15240 |
| BCL11A-12979 | - | GGGAAGUGGGUGUGCGUACGG | 21 | 15241 |
| BCL11A-12980 | - | GGGGAAGUGGGUGUGCGUACGG | 22 | 15242 |
| BCL11A-12981 | - | AGGGGAAGUGGGUGUGCGUACGG | 23 | 15243 |
| BCL11A-12982 | - | GAGGGGAAGUGGGUGUGCGUACGG | 24 | 15244 |
| BCL11A-12983 | - | CGGUCAAGUGUGCAGCGG | 18 | 15245 |
| BCL11A-12984 | - | ACGGUCAAGUGUGCAGCGG | 19 | 15246 |
| BCL11A-12985 | - | CACGGUCAAGUGUGCAGCGG | 20 | 15247 |
| BCL11A-12986 | - | UCACGGUCAAGUGUGCAGCGG | 21 | 15248 |
| BCL11A-12987 | - | CUCACGGUCAAGUGUGCAGCGG | 22 | 15249 |
| BCL11A-12988 | - | GCUCACGGUCAAGUGUGCAGCGG | 23 | 15250 |
| BCL11A-12989 | - | CGCUCACGGUCAAGUGUGCAGCGG | 24 | 15251 |
| BCL11A-12990 | - | GAGCGAGCGCGGCGGCGG | 18 | 15252 |
| BCL11A-12991 | - | GGAGCGAGCGCGGCGGCGG | 19 | 15253 |
| BCL11A-10196 | - | GGGAGCGAGCGCGGCGGCGG | 20 | 15254 |

TABLE 19E-continued

5th Tier

| gRNA Name | DNA Strand | Targeting Domain | Target Site Length | SEQ ID NO: |
|---|---|---|---|---|
| BCL11A-12992 | − | GGGGAGCGAGCGCGGCGGCGG | 21 | 15255 |
| BCL11A-12993 | − | CGGGGAGCGAGCGCGGCGGCGG | 22 | 15256 |
| BCL11A-12994 | − | GCGGGGAGCGAGCGCGGCGGCGG | 23 | 15257 |
| BCL11A-12995 | − | CGCGGGGAGCGAGCGCGGCGGCGG | 24 | 15258 |
| BCL11A-12996 | − | CUGAGUCCGCGGAGUCGG | 18 | 15259 |
| BCL11A-12997 | − | CCUGAGUCCGCGGAGUCGG | 19 | 15260 |
| BCL11A-12998 | − | UCCUGAGUCCGCGGAGUCGG | 20 | 15261 |
| BCL11A-12999 | − | CUCCUGAGUCCGCGGAGUCGG | 21 | 15262 |
| BCL11A-13000 | − | GCUCCUGAGUCCGCGGAGUCGG | 22 | 15263 |
| BCL11A-13001 | − | CGCUCCUGAGUCCGCGGAGUCGG | 23 | 15264 |
| BCL11A-13002 | − | GCGCUCCUGAGUCCGCGGAGUCGG | 24 | 15265 |
| BCL11A-13003 | − | GAAAAUGGGGGGUAGGG | 18 | 15266 |
| BCL11A-13004 | − | AGAAAAUGGGGGGUAGGG | 19 | 15267 |
| BCL11A-10200 | − | AAGAAAAUGGGGGGUAGGG | 20 | 15268 |
| BCL11A-13005 | − | UAAGAAAAUGGGGGGUAGGG | 21 | 15269 |
| BCL11A-13006 | − | GUAAGAAAAUGGGGGGUAGGG | 22 | 15270 |
| BCL11A-13007 | − | CGUAAGAAAAUGGGGGGUAGGG | 23 | 15271 |
| BCL11A-13008 | − | CCGUAAGAAAAUGGGGGGUAGGG | 24 | 15272 |
| BCL11A-13009 | − | AGGGGCCGCGGCGACGGG | 18 | 15273 |
| BCL11A-13010 | − | GAGGGGCCGCGGCGACGGG | 19 | 15274 |
| BCL11A-13011 | − | AGAGGGGCCGCGGCGACGGG | 20 | 15275 |
| BCL11A-13012 | − | GAGAGGGGCCGCGGCGACGGG | 21 | 15276 |
| BCL11A-13013 | − | GGAGAGGGGCCGCGGCGACGGG | 22 | 15277 |
| BCL11A-13014 | − | GGGAGAGGGGCCGCGGCGACGGG | 23 | 15278 |
| BCL11A-13015 | − | CGGGAGAGGGGCCGCGGCGACGGG | 24 | 15279 |
| BCL11A-13016 | − | GAGAGCCGUGGGACCGGG | 18 | 15280 |
| BCL11A-13017 | − | GGAGAGCCGUGGGACCGGG | 19 | 15281 |
| BCL11A-13018 | − | GGGAGAGCCGUGGGACCGGG | 20 | 15282 |
| BCL11A-13019 | − | GGGGAGAGCCGUGGGACCGGG | 21 | 15283 |
| BCL11A-13020 | − | CGGGGAGAGCCGUGGGACCGGG | 22 | 15284 |
| BCL11A-13021 | − | ACGGGGAGAGCCGUGGGACCGGG | 23 | 15285 |
| BCL11A-13022 | − | GACGGGGAGAGCCGUGGGACCGGG | 24 | 15286 |
| BCL11A-13023 | − | UAAAAAACGAUUCCCGGG | 18 | 15287 |
| BCL11A-13024 | − | CUAAAAAACGAUUCCCGGG | 19 | 15288 |
| BCL11A-13025 | − | UCUAAAAAACGAUUCCCGGG | 20 | 15289 |
| BCL11A-13026 | − | GUCUAAAAAACGAUUCCCGGG | 21 | 15290 |
| BCL11A-13027 | − | AGUCUAAAAAACGAUUCCCGGG | 22 | 15291 |

TABLE 19E-continued

5th Tier

| gRNA Name | DNA Strand | Targeting Domain | Target Site Length | SEQ ID NO: |
|---|---|---|---|---|
| BCL11A-13028 | - | AAGUCUAAAAAACGAUUCCCGGG | 23 | 15292 |
| BCL11A-13029 | - | CAAGUCUAAAAAACGAUUCCCGGG | 24 | 15293 |
| BCL11A-13030 | - | GGUCAAGUGUGCAGCGGG | 18 | 15294 |
| BCL11A-13031 | - | CGGUCAAGUGUGCAGCGGG | 19 | 15295 |
| BCL11A-10202 | - | ACGGUCAAGUGUGCAGCGGG | 20 | 15296 |
| BCL11A-13032 | - | CACGGUCAAGUGUGCAGCGGG | 21 | 15297 |
| BCL11A-13033 | - | UCACGGUCAAGUGUGCAGCGGG | 22 | 15298 |
| BCL11A-13034 | - | CUCACGGUCAAGUGUGCAGCGGG | 23 | 15299 |
| BCL11A-13035 | - | GCUCACGGUCAAGUGUGCAGCGGG | 24 | 15300 |
| BCL11A-13036 | - | GAGCGCGGCGGCGGCGGG | 18 | 15301 |
| BCL11A-13037 | - | CGAGCGCGGCGGCGGCGGG | 19 | 15302 |
| BCL11A-13038 | - | GCGAGCGCGGCGGCGGCGGG | 20 | 15303 |
| BCL11A-13039 | - | AGCGAGCGCGGCGGCGGCGGG | 21 | 15304 |
| BCL11A-13040 | - | GAGCGAGCGCGGCGGCGGCGGG | 22 | 15305 |
| BCL11A-13041 | - | GGAGCGAGCGCGGCGGCGGCGGG | 23 | 15306 |
| BCL11A-13042 | - | GGGAGCGAGCGCGGCGGCGGCGGG | 24 | 15307 |
| BCL11A-13043 | - | AGCGCGGCGGCGGCGGGG | 18 | 15308 |
| BCL11A-13044 | - | GAGCGCGGCGGCGGCGGGG | 19 | 15309 |
| BCL11A-10206 | - | CGAGCGCGGCGGCGGCGGGG | 20 | 15310 |
| BCL11A-13045 | - | GCGAGCGCGGCGGCGGCGGGG | 21 | 15311 |
| BCL11A-13046 | - | AGCGAGCGCGGCGGCGGCGGGG | 22 | 15312 |
| BCL11A-13047 | - | GAGCGAGCGCGGCGGCGGCGGGG | 23 | 15313 |
| BCL11A-13048 | - | GGAGCGAGCGCGGCGGCGGCGGGG | 24 | 15314 |
| BCL11A-13049 | - | CGUAAGAAAAUGGGGGGG | 18 | 15315 |
| BCL11A-13050 | - | CCGUAAGAAAAUGGGGGGG | 19 | 15316 |
| BCL11A-13051 | - | ACCGUAAGAAAAUGGGGGGG | 20 | 15317 |
| BCL11A-13052 | - | CACCGUAAGAAAAUGGGGGGG | 21 | 15318 |
| BCL11A-13053 | - | UCACCGUAAGAAAAUGGGGGGG | 22 | 15319 |
| BCL11A-13054 | - | CUCACCGUAAGAAAAUGGGGGGG | 23 | 15320 |
| BCL11A-13055 | - | ACUCACCGUAAGAAAAUGGGGGGG | 24 | 15321 |
| BCL11A-13056 | - | CACAUGCAAACCUGGGGG | 18 | 15322 |
| BCL11A-13057 | - | UCACAUGCAAACCUGGGGG | 19 | 15323 |
| BCL11A-10210 | - | CUCACAUGCAAACCUGGGGG | 20 | 15324 |
| BCL11A-13058 | - | ACUCACAUGCAAACCUGGGGG | 21 | 15325 |
| BCL11A-13059 | - | AACUCACAUGCAAACCUGGGGG | 22 | 15326 |
| BCL11A-13060 | - | CAACUCACAUGCAAACCUGGGGG | 23 | 15327 |
| BCL11A-13061 | - | ACAACUCACAUGCAAACCUGGGGG | 24 | 15328 |

TABLE 19E-continued

5th Tier

| gRNA Name | DNA Strand | Targeting Domain | Target Site Length | SEQ ID NO: |
|---|---|---|---|---|
| BCL11A-13062 | - | UCACAUGCAAACCUGGGG | 18 | 15329 |
| BCL11A-13063 | - | CUCACAUGCAAACCUGGGG | 19 | 15330 |
| BCL11A-13064 | - | ACUCACAUGCAAACCUGGGG | 20 | 15331 |
| BCL11A-13065 | - | AACUCACAUGCAAACCUGGGG | 21 | 15332 |
| BCL11A-13066 | - | CAACUCACAUGCAAACCUGGGG | 22 | 15333 |
| BCL11A-13067 | - | ACAACUCACAUGCAAACCUGGGG | 23 | 15334 |
| BCL11A-13068 | - | AACAACUCACAUGCAAACCUGGGG | 24 | 15335 |
| BCL11A-11486 | - | GAGUCCGCGUGUGUGGGG | 18 | 15336 |
| BCL11A-11487 | - | AGAGUCCGCGUGUGUGGGG | 19 | 15337 |
| BCL11A-9577 | - | UAGAGUCCGCGUGUGUGGGG | 20 | 15338 |
| BCL11A-11488 | - | UUAGAGUCCGCGUGUGUGGGG | 21 | 15339 |
| BCL11A-11489 | - | UUUAGAGUCCGCGUGUGUGGGG | 22 | 15340 |
| BCL11A-11490 | - | UUUUAGAGUCCGCGUGUGUGGGG | 23 | 15341 |
| BCL11A-11491 | - | AUUUUAGAGUCCGCGUGUGUGGGG | 24 | 15342 |
| BCL11A-11492 | - | AGAGUCCGCGUGUGUGGG | 18 | 15343 |
| BCL11A-11493 | - | UAGAGUCCGCGUGUGUGGG | 19 | 15344 |
| BCL11A-9769 | - | UUAGAGUCCGCGUGUGUGGG | 20 | 15345 |
| BCL11A-11494 | - | UUUAGAGUCCGCGUGUGUGGG | 21 | 15346 |
| BCL11A-11495 | - | UUUUAGAGUCCGCGUGUGUGGG | 22 | 15347 |
| BCL11A-11496 | - | AUUUUAGAGUCCGCGUGUGUGGG | 23 | 15348 |
| BCL11A-11497 | - | CAUUUUAGAGUCCGCGUGUGUGGG | 24 | 15349 |
| BCL11A-13069 | - | CCUGGGGGUGGGAGCUGG | 18 | 15350 |
| BCL11A-13070 | - | ACCUGGGGGUGGGAGCUGG | 19 | 15351 |
| BCL11A-10217 | - | AACCUGGGGGUGGGAGCUGG | 20 | 15352 |
| BCL11A-13071 | - | AAACCUGGGGGUGGGAGCUGG | 21 | 15353 |
| BCL11A-13072 | - | CAAACCUGGGGGUGGGAGCUGG | 22 | 15354 |
| BCL11A-13073 | - | GCAAACCUGGGGGUGGGAGCUGG | 23 | 15355 |
| BCL11A-13074 | - | UGCAAACCUGGGGGUGGGAGCUGG | 24 | 15356 |
| BCL11A-11498 | - | UAGAGUCCGCGUGUGUGG | 18 | 15357 |
| BCL11A-11499 | - | UUAGAGUCCGCGUGUGUGG | 19 | 15358 |
| BCL11A-9578 | - | UUUAGAGUCCGCGUGUGUGG | 20 | 15359 |
| BCL11A-11500 | - | UUUUAGAGUCCGCGUGUGUGG | 21 | 15360 |
| BCL11A-11501 | - | AUUUUAGAGUCCGCGUGUGUGG | 22 | 15361 |
| BCL11A-11502 | - | CAUUUUAGAGUCCGCGUGUGUGG | 23 | 15362 |
| BCL11A-11503 | - | UCAUUUUAGAGUCCGCGUGUGUGG | 24 | 15363 |
| BCL11A-13075 | - | ACUCACCGUAAGAAAAUG | 18 | 15364 |
| BCL11A-13076 | - | CACUCACCGUAAGAAAAUG | 19 | 15365 |

TABLE 19E-continued

5th Tier

| gRNA Name | DNA Strand | Targeting Domain | Target Site Length | SEQ ID NO: |
|---|---|---|---|---|
| BCL11A-10221 | - | CCACUCACCGUAAGAAAAUG | 20 | 15366 |
| BCL11A-13077 | - | CCCACUCACCGUAAGAAAAUG | 21 | 15367 |
| BCL11A-13078 | - | UCCCACUCACCGUAAGAAAAUG | 22 | 15368 |
| BCL11A-13079 | - | UUCCCACUCACCGUAAGAAAAUG | 23 | 15369 |
| BCL11A-13080 | - | CUUCCCACUCACCGUAAGAAAAUG | 24 | 15370 |
| BCL11A-13081 | - | AGUGAGAAAGUGGCACUG | 18 | 15371 |
| BCL11A-13082 | - | UAGUGAGAAAGUGGCACUG | 19 | 15372 |
| BCL11A-10222 | - | AUAGUGAGAAAGUGGCACUG | 20 | 15373 |
| BCL11A-13083 | - | AAUAGUGAGAAAGUGGCACUG | 21 | 15374 |
| BCL11A-13084 | - | CAAUAGUGAGAAAGUGGCACUG | 22 | 15375 |
| BCL11A-13085 | - | ACAAUAGUGAGAAAGUGGCACUG | 23 | 15376 |
| BCL11A-13086 | - | CACAAUAGUGAGAAAGUGGCACUG | 24 | 15377 |
| BCL11A-13087 | - | ACCUGGGGUGGGAGCUG | 18 | 15378 |
| BCL11A-13088 | - | AACCUGGGGUGGGAGCUG | 19 | 15379 |
| BCL11A-13089 | - | AAACCUGGGGUGGGAGCUG | 20 | 15380 |
| BCL11A-13090 | - | CAAACCUGGGGUGGGAGCUG | 21 | 15381 |
| BCL11A-13091 | - | GCAAACCUGGGGUGGGAGCUG | 22 | 15382 |
| BCL11A-13092 | - | UGCAAACCUGGGGUGGGAGCUG | 23 | 15383 |
| BCL11A-13093 | - | AUGCAAACCUGGGGUGGGAGCUG | 24 | 15384 |
| BCL11A-13094 | - | ACCUCCCCUCGCCCGCUG | 18 | 15385 |
| BCL11A-13095 | - | CACCUCCCCUCGCCCGCUG | 19 | 15386 |
| BCL11A-10224 | - | CCACCUCCCCUCGCCCGCUG | 20 | 15387 |
| BCL11A-13096 | - | CCCACCUCCCCUCGCCCGCUG | 21 | 15388 |
| BCL11A-13097 | - | UCCCACCUCCCCUCGCCCGCUG | 22 | 15389 |
| BCL11A-13098 | - | CUCCCACCUCCCCUCGCCCGCUG | 23 | 15390 |
| BCL11A-13099 | - | CCUCCCACCUCCCCUCGCCCGCUG | 24 | 15391 |
| BCL11A-13100 | - | UGGGGGUGGGAGCUGGUG | 18 | 15392 |
| BCL11A-13101 | - | CUGGGGGUGGGAGCUGGUG | 19 | 15393 |
| BCL11A-10228 | - | CCUGGGGGUGGGAGCUGGUG | 20 | 15394 |
| BCL11A-13102 | - | ACCUGGGGGUGGGAGCUGGUG | 21 | 15395 |
| BCL11A-13103 | - | AACCUGGGGGUGGGAGCUGGUG | 22 | 15396 |
| BCL11A-13104 | - | AAACCUGGGGGUGGGAGCUGGUG | 23 | 15397 |
| BCL11A-13105 | - | CAAACCUGGGGGUGGGAGCUGGUG | 24 | 15398 |
| BCL11A-11518 | - | UUUUAGAGUCCGCGUGUG | 18 | 15399 |
| BCL11A-11519 | - | AUUUUAGAGUCCGCGUGUG | 19 | 15400 |
| BCL11A-9581 | - | CAUUUUAGAGUCCGCGUGUG | 20 | 15401 |
| BCL11A-11520 | - | UCAUUUUAGAGUCCGCGUGUG | 21 | 15402 |

TABLE 19E-continued

5th Tier

| gRNA Name | DNA Strand | Targeting Domain | Target Site Length | SEQ ID NO: |
|---|---|---|---|---|
| BCL11A-11521 | - | UUCAUUUUAGAGUCCGCGUGUG | 22 | 15403 |
| BCL11A-11522 | - | UUUCAUUUUAGAGUCCGCGUGUG | 23 | 15404 |
| BCL11A-11523 | - | CUUUCAUUUUAGAGUCCGCGUGUG | 24 | 15405 |
| BCL11A-11524 | - | UUAGAGUCCGCGUGUGUG | 18 | 15406 |
| BCL11A-11525 | - | UUUAGAGUCCGCGUGUGUG | 19 | 15407 |
| BCL11A-9776 | - | UUUUAGAGUCCGCGUGUGUG | 20 | 15408 |
| BCL11A-11526 | - | AUUUUAGAGUCCGCGUGUGUG | 21 | 15409 |
| BCL11A-11527 | - | CAUUUUAGAGUCCGCGUGUGUG | 22 | 15410 |
| BCL11A-11528 | - | UCAUUUUAGAGUCCGCGUGUGUG | 23 | 15411 |
| BCL11A-11529 | - | UUCAUUUUAGAGUCCGCGUGUGUG | 24 | 15412 |
| BCL11A-13106 | - | CACUCACCGUAAGAAAAU | 18 | 15413 |
| BCL11A-13107 | - | CCACUCACCGUAAGAAAAU | 19 | 15414 |
| BCL11A-10232 | - | CCCACUCACCGUAAGAAAAU | 20 | 15415 |
| BCL11A-13108 | - | UCCCACUCACCGUAAGAAAAU | 21 | 15416 |
| BCL11A-13109 | - | UUCCCACUCACCGUAAGAAAAU | 22 | 15417 |
| BCL11A-13110 | - | CUUCCCACUCACCGUAAGAAAAU | 23 | 15418 |
| BCL11A-13111 | - | GCUUCCCACUCACCGUAAGAAAAU | 24 | 15419 |
| BCL11A-13112 | - | CGCUGCGGAGCUGUAACU | 18 | 15420 |
| BCL11A-13113 | - | CCGCUGCGGAGCUGUAACU | 19 | 15421 |
| BCL11A-10233 | - | CCCGCUGCGGAGCUGUAACU | 20 | 15422 |
| BCL11A-13114 | - | GCCCGCUGCGGAGCUGUAACU | 21 | 15423 |
| BCL11A-13115 | - | CGCCCGCUGCGGAGCUGUAACU | 22 | 15424 |
| BCL11A-13116 | - | UCGCCCGCUGCGGAGCUGUAACU | 23 | 15425 |
| BCL11A-13117 | - | CUCGCCCGCUGCGGAGCUGUAACU | 24 | 15426 |
| BCL11A-13118 | - | UAGUGAGAAAGUGGCACU | 18 | 15427 |
| BCL11A-13119 | - | AUAGUGAGAAAGUGGCACU | 19 | 15428 |
| BCL11A-13120 | - | AAUAGUGAGAAAGUGGCACU | 20 | 15429 |
| BCL11A-13121 | - | CAAUAGUGAGAAAGUGGCACU | 21 | 15430 |
| BCL11A-13122 | - | ACAAUAGUGAGAAAGUGGCACU | 22 | 15431 |
| BCL11A-13123 | - | CACAAUAGUGAGAAAGUGGCACU | 23 | 15432 |
| BCL11A-13124 | - | CCACAAUAGUGAGAAAGUGGCACU | 24 | 15433 |
| BCL11A-13125 | - | CGGUCCCUGGCUCGGCCU | 18 | 15434 |
| BCL11A-13126 | - | CCGGUCCCUGGCUCGGCCU | 19 | 15435 |
| BCL11A-10237 | - | CCCGGUCCCUGGCUCGGCCU | 20 | 15436 |
| BCL11A-13127 | - | CACCUCCCCUCGCCCGCU | 18 | 15437 |
| BCL11A-13128 | - | CCACCUCCCCUCGCCCGCU | 19 | 15438 |
| BCL11A-13129 | - | CCCACCUCCCCUCGCCCGCU | 20 | 15439 |

TABLE 19E-continued

5th Tier

| gRNA Name | DNA Strand | Targeting Domain | Target Site Length | SEQ ID NO: |
|---|---|---|---|---|
| BCL11A-13130 | - | UCCCACCUCCCCUCGCCCGCU | 21 | 15440 |
| BCL11A-13131 | - | CUCCCACCUCCCCUCGCCCGCU | 22 | 15441 |
| BCL11A-13132 | - | CCUCCCACCUCCCCUCGCCCGCU | 23 | 15442 |
| BCL11A-13133 | - | CCCUCCCACCUCCCCUCGCCCGCU | 24 | 15443 |
| BCL11A-13134 | - | CGAGCGCAGCCGCGGGCU | 18 | 15444 |
| BCL11A-13135 | - | CCGAGCGCAGCCGCGGGCU | 19 | 15445 |
| BCL11A-10241 | - | CCCGAGCGCAGCCGCGGGCU | 20 | 15446 |
| BCL11A-13136 | - | UCCCGAGCGCAGCCGCGGGCU | 21 | 15447 |
| BCL11A-13137 | - | UUCCCGAGCGCAGCCGCGGGCU | 22 | 15448 |
| BCL11A-13138 | - | UUUCCCGAGCGCAGCCGCGGGCU | 23 | 15449 |
| BCL11A-13139 | - | GUUUCCCGAGCGCAGCCGCGGGCU | 24 | 15450 |
| BCL11A-13140 | - | CUCCUGAGUCCGCGGAGU | 18 | 15451 |
| BCL11A-13141 | - | GCUCCUGAGUCCGCGGAGU | 19 | 15452 |
| BCL11A-10243 | - | CGCUCCUGAGUCCGCGGAGU | 20 | 15453 |
| BCL11A-13142 | - | GCGCUCCUGAGUCCGCGGAGU | 21 | 15454 |
| BCL11A-13143 | - | GGCGCUCCUGAGUCCGCGGAGU | 22 | 15455 |
| BCL11A-13144 | - | CGGCGCUCCUGAGUCCGCGGAGU | 23 | 15456 |
| BCL11A-13145 | - | CCGGCGCUCCUGAGUCCGCGGAGU | 24 | 15457 |
| BCL11A-13146 | - | AGUCAUCCCCACAAUAGU | 18 | 15458 |
| BCL11A-13147 | - | UAGUCAUCCCCACAAUAGU | 19 | 15459 |
| BCL11A-13148 | - | GUAGUCAUCCCCACAAUAGU | 20 | 15460 |
| BCL11A-13149 | - | AGUAGUCAUCCCCACAAUAGU | 21 | 15461 |
| BCL11A-13150 | - | AAGUAGUCAUCCCCACAAUAGU | 22 | 15462 |
| BCL11A-13151 | - | AAAGUAGUCAUCCCCACAAUAGU | 23 | 15463 |
| BCL11A-13152 | - | GAAAGUAGUCAUCCCCACAAUAGU | 24 | 15464 |
| BCL11A-13153 | - | UUGCUUCCCACUCACCGU | 18 | 15465 |
| BCL11A-13154 | - | GUUGCUUCCCACUCACCGU | 19 | 15466 |
| BCL11A-13155 | - | GGUUGCUUCCCACUCACCGU | 20 | 15467 |
| BCL11A-13156 | - | AGGUUGCUUCCCACUCACCGU | 21 | 15468 |
| BCL11A-13157 | - | GAGGUUGCUUCCCACUCACCGU | 22 | 15469 |
| BCL11A-13158 | - | GGAGGUUGCUUCCCACUCACCGU | 23 | 15470 |
| BCL11A-13159 | - | GGGAGGUUGCUUCCCACUCACCGU | 24 | 15471 |
| BCL11A-13160 | - | GGGGAAGUGGGUGUGCGU | 18 | 15472 |
| BCL11A-13161 | - | AGGGGAAGUGGGUGUGCGU | 19 | 15473 |
| BCL11A-13162 | - | GAGGGGAAGUGGGUGUGCGU | 20 | 15474 |
| BCL11A-13163 | - | GGAGGGGAAGUGGGUGUGCGU | 21 | 15475 |
| BCL11A-13164 | - | GGGAGGGGAAGUGGGUGUGCGU | 22 | 15476 |

TABLE 19E-continued

5th Tier

| gRNA Name | DNA Strand | Targeting Domain | Target Site Length | SEQ ID NO: |
|---|---|---|---|---|
| BCL11A-13165 | - | GGGGAGGGGAAGUGGGUGUGCGU | 23 | 15477 |
| BCL11A-13166 | - | CGGGGAGGGGAAGUGGGUGUGCGU | 24 | 15478 |
| BCL11A-13167 | - | GUAAGAAAAUGGGGGGU | 18 | 15479 |
| BCL11A-13168 | - | CGUAAGAAAAUGGGGGGU | 19 | 15480 |
| BCL11A-10248 | - | CCGUAAGAAAAUGGGGGGU | 20 | 15481 |
| BCL11A-13169 | - | ACCGUAAGAAAAUGGGGGGU | 21 | 15482 |
| BCL11A-13170 | - | CACCGUAAGAAAAUGGGGGGU | 22 | 15483 |
| BCL11A-13171 | - | UCACCGUAAGAAAAUGGGGGGU | 23 | 15484 |
| BCL11A-13172 | - | CUCACCGUAAGAAAAUGGGGGGU | 24 | 15485 |
| BCL11A-13173 | - | ACAUGCAAACCUGGGGU | 18 | 15486 |
| BCL11A-13174 | - | CACAUGCAAACCUGGGGU | 19 | 15487 |
| BCL11A-10249 | - | UCACAUGCAAACCUGGGGU | 20 | 15488 |
| BCL11A-13175 | - | CUCACAUGCAAACCUGGGGU | 21 | 15489 |
| BCL11A-13176 | - | ACUCACAUGCAAACCUGGGGU | 22 | 15490 |
| BCL11A-13177 | - | AACUCACAUGCAAACCUGGGGU | 23 | 15491 |
| BCL11A-13178 | - | CAACUCACAUGCAAACCUGGGGU | 24 | 15492 |
| BCL11A-13179 | - | CUGGGGGUGGGAGCUGGU | 18 | 15493 |
| BCL11A-13180 | - | CCUGGGGGUGGGAGCUGGU | 19 | 15494 |
| BCL11A-10250 | - | ACCUGGGGGUGGGAGCUGGU | 20 | 15495 |
| BCL11A-13181 | - | AACCUGGGGGUGGGAGCUGGU | 21 | 15496 |
| BCL11A-13182 | - | AAACCUGGGGGUGGGAGCUGGU | 22 | 15497 |
| BCL11A-13183 | - | CAAACCUGGGGGUGGGAGCUGGU | 23 | 15498 |
| BCL11A-13184 | - | GCAAACCUGGGGGUGGGAGCUGGU | 24 | 15499 |
| BCL11A-11572 | - | AUUUUAGAGUCCGCGUGU | 18 | 15500 |
| BCL11A-11573 | - | CAUUUUAGAGUCCGCGUGU | 19 | 15501 |
| BCL11A-11574 | - | UCAUUUUAGAGUCCGCGUGU | 20 | 15502 |
| BCL11A-11575 | - | UUCAUUUUAGAGUCCGCGUGU | 21 | 15503 |
| BCL11A-11576 | - | UUUCAUUUUAGAGUCCGCGUGU | 22 | 15504 |
| BCL11A-11577 | - | CUUUCAUUUUAGAGUCCGCGUGU | 23 | 15505 |
| BCL11A-11578 | - | UCUUUCAUUUUAGAGUCCGCGUGU | 24 | 15506 |
| BCL11A-13185 | - | GCGUACGGAGGAGGGUGU | 18 | 15507 |
| BCL11A-13186 | - | UGCGUACGGAGGAGGGUGU | 19 | 15508 |
| BCL11A-13187 | - | GUGCGUACGGAGGAGGGUGU | 20 | 15509 |
| BCL11A-13188 | - | UGUGCGUACGGAGGAGGGUGU | 21 | 15510 |
| BCL11A-13189 | - | GUGUGCGUACGGAGGAGGGUGU | 22 | 15511 |
| BCL11A-13190 | - | GGUGUGCGUACGGAGGAGGGUGU | 23 | 15512 |
| BCL11A-13191 | - | GGGUGUGCGUACGGAGGAGGGUGU | 24 | 15513 |

TABLE 19E-continued

5th Tier

| gRNA Name | DNA Strand | Targeting Domain | Target Site Length | SEQ ID NO: |
|---|---|---|---|---|
| BCL11A-11579 | - | UUUAGAGUCCGCGUGUGU | 18 | 15514 |
| BCL11A-11580 | - | UUUUAGAGUCCGCGUGUGU | 19 | 15515 |
| BCL11A-9586 | - | AUUUUAGAGUCCGCGUGUGU | 20 | 15516 |
| BCL11A-11581 | - | CAUUUUAGAGUCCGCGUGUGU | 21 | 15517 |
| BCL11A-11582 | - | UCAUUUUAGAGUCCGCGUGUGU | 22 | 15518 |
| BCL11A-11583 | - | UUCAUUUUAGAGUCCGCGUGUGU | 23 | 15519 |
| BCL11A-11584 | - | UUUCAUUUUAGAGUCCGCGUGUGU | 24 | 15520 |
| BCL11A-13192 | - | GACUUGGGCGCUGCCCUU | 18 | 15521 |
| BCL11A-13193 | - | AGACUUGGGCGCUGCCCUU | 19 | 15522 |
| BCL11A-13194 | - | GAGACUUGGGCGCUGCCCUU | 20 | 15523 |
| BCL11A-13195 | - | GGAGACUUGGGCGCUGCCCUU | 21 | 15524 |
| BCL11A-13196 | - | UGGAGACUUGGGCGCUGCCCUU | 22 | 15525 |
| BCL11A-13197 | - | CUGGAGACUUGGGCGCUGCCCUU | 23 | 15526 |
| BCL11A-13198 | - | CCUGGAGACUUGGGCGCUGCCCUU | 24 | 15527 |
| BCL11A-13199 | - | GGUCCCUGGCUCGGCCUU | 18 | 15528 |
| BCL11A-13200 | - | CGGUCCCUGGCUCGGCCUU | 19 | 15529 |
| BCL11A-10256 | - | CCGGUCCCUGGCUCGGCCUU | 20 | 15530 |
| BCL11A-13201 | - | AAGAGGUGAGACUGGCUU | 18 | 15531 |
| BCL11A-13202 | - | AAAGAGGUGAGACUGGCUU | 19 | 15532 |
| BCL11A-13203 | - | AAAAGAGGUGAGACUGGCUU | 20 | 15533 |
| BCL11A-13204 | - | GAAAAGAGGUGAGACUGGCUU | 21 | 15534 |
| BCL11A-13205 | - | AGAAAAGAGGUGAGACUGGCUU | 22 | 15535 |
| BCL11A-13206 | - | GAGAAAAGAGGUGAGACUGGCUU | 23 | 15536 |
| BCL11A-13207 | - | GGAGAAAAGAGGUGAGACUGGCUU | 24 | 15537 |
| BCL11A-13208 | - | AUGAACAAUGCUAAGGUU | 18 | 15538 |
| BCL11A-13209 | - | AAUGAACAAUGCUAAGGUU | 19 | 15539 |
| BCL11A-13210 | - | UAAUGAACAAUGCUAAGGUU | 20 | 15540 |
| BCL11A-13211 | - | AUAAUGAACAAUGCUAAGGUU | 21 | 15541 |
| BCL11A-13212 | - | AAUAAUGAACAAUGCUAAGGUU | 22 | 15542 |
| BCL11A-13213 | - | AAAUAAUGAACAAUGCUAAGGUU | 23 | 15543 |
| BCL11A-13214 | - | AAAAUAAUGAACAAUGCUAAGGUU | 24 | 15544 |
| BCL11A-13215 | - | GCCGCUUUAUUUCUCUUU | 18 | 15545 |
| BCL11A-13216 | - | CGCCGCUUUAUUUCUCUUU | 19 | 15546 |
| BCL11A-13217 | - | CCGCCGCUUUAUUUCUCUUU | 20 | 15547 |

TABLE 19E-continued

5th Tier

| gRNA Name | DNA Strand | Targeting Domain | Target Site Length | SEQ ID NO: |
|---|---|---|---|---|
| BCL11A-13218 | − | UCCGCCGCUUUAUUUCUCUUU | 21 | 15548 |
| BCL11A-13219 | − | UUCCGCCGCUUUAUUUCUCUUU | 22 | 15549 |
| BCL11A-13220 | − | UUUCCGCCGCUUUAUUUCUCUUU | 23 | 15550 |
| BCL11A-13221 | − | CUUUCCGCCGCUUUAUUUCUCUUU | 24 | 15551 |

Table 20A provides exemplary targeting domains for knocking down the BCL11A gene selected according to the first tier parameters. The targeting domains bind within 500 bp (e.g., upstream or downstream) of a transcription start site (TSS) and have a high level of orthogonality. It is contemplated herein that in an embodiment the targeting domain hybridizes to the target domain through complementary base pairing. Any of the targeting domains in the table can be used with a N. meningitidis eiCas9 molecule or eiCas9 fusion protein (e.g., an eiCas9 fused to a transcription repressor domain) to alter the BCL11A gene (e.g., reduce or eliminate BCL11A gene expression, BCL11A protein function, or the level of BCL11A protein). One or more gRNA may be used to target an eiCas9 to the promoter region of the BCL11A gene.

Table 20B provides exemplary targeting domains for knocking down the BCL11A gene selected according to the second tier parameters. The targeting domains bind within 500 bp (e.g., upstream or downstream) of a transcription start site (TSS). It is contemplated herein that in an embodiment the targeting domain hybridizes to the target domain through complementary base pairing. Any of the targeting domains in the table can be used with a N. meningitidis eiCas9 molecule or eiCas9 fusion protein (e.g., an eiCas9 fused to a transcription repressor domain) to alter the BCL11A gene (e.g., reduce or eliminate BCL11A gene expression, BCL11A protein function, or the level of BCL11A protein). One or More gRNA may be used to target an eiCas9 to the promoter region of the BCL11A gene.

TABLE 20A

1st Tier

| gRNA Name | DNA Strand | Targeting Domain | Target Site Length | SEQ ID NO: |
|---|---|---|---|---|
| BCL11A-13222 | + | ACACACCCCUCUCUCCC | 17 | 15552 |
| BCL11A-9477 | + | CUUACGCGAGAAUUCCC | 17 | 15553 |
| BCL11A-13223 | + | CCCUCUCUCCCCCUCGC | 17 | 15554 |
| BCL11A-13224 | + | UCUAGUCCUGCGCGCUC | 17 | 15555 |
| BCL11A-9638 | − | UUGAACUUGCAGCUCAG | 17 | 15556 |
| BCL11A-9482 | + | UUAAGUGCUGGGGUUUG | 17 | 15557 |
| BCL11A-13225 | + | CACGCGGACUCUAAAAU | 17 | 15558 |
| BCL11A-13226 | + | AAUUGUGGGAGAGCCGU | 17 | 15559 |
| BCL11A-13227 | − | GAUGUGUGUCCAUUGGU | 17 | 15560 |
| BCL11A-13228 | + | UGCACACACCCCUCUCUCCC | 20 | 15561 |
| BCL11A-9487 | + | UUACUUACGCGAGAAUUCCC | 20 | 15562 |
| BCL11A-13229 | + | CACCCCUCUCUCCCCCUCGC | 20 | 15563 |
| BCL11A-13230 | + | GCUUCUAGUCCUGCGCGCUC | 20 | 15564 |
| BCL11A-9738 | − | CACUUGAACUUGCAGCUCAG | 20 | 15565 |
| BCL11A-9491 | + | UGCUUAAGUGCUGGGGUUUG | 20 | 15566 |
| BCL11A-13231 | + | AUGAAUUGUGGGAGAGCCGU | 20 | 15567 |
| BCL11A-11567 | − | CCUGAUGUGUGUCCAUUGGU | 20 | 15568 |

TABLE 20B

2nd Tier

| gRNA Name | DNA Strand | Targeting Domain | Target Site Length | SEQ ID NO: |
|---|---|---|---|---|
| BCL11A-13232 | − | CCCUCCCCGCACUGGCC | 17 | 15569 |
| BCL11A-13233 | − | UUUUUUUUUUUUUUUU | 17 | 15570 |
| BCL11A-13234 | − | UCCCCCUCCCCGCACUGGCC | 20 | 15571 |
| BCL11A-13235 | + | ACACACGCGGACUCUAAAAU | 20 | 15572 |
| BCL11A-13236 | − | UUUUUUUUUUUUUUUUUUUU | 20 | 15573 |

Table 20C provides exemplary targeting domains for knocking down the BCL11A gene selected according to the third tier parameters. The targeting domains bind within the additional 500 bp (e.g., upstream or downstream) of a transcription start site (TSS), e.g., extending to 1 kb upstream and downstream of a TSS. It is contemplated herein that in an embodiment the targeting domain hybridizes to the target domain through complementary base pairing. Any of the targeting domains in the table can be used with a *N. meningitidis* eiCas9 molecule or eiCas9 fusion protein (e.g., an eiCas9 fused to a transcription repressor domain) to alter the BCL11A gene (e.g., reduce or eliminate BCL11A gene expression, BCL11A protein function, or the level of BCL11A protein). One or more gRNA may be used to target an eiCas9 to the promoter region of the BCL11A gene.

TABLE 20C

3rd Tier

| gRNA Name | DNA Strand | Targeting Domain | Target Site Length | SEQ ID NO: |
|---|---|---|---|---|
| BCL11A-13237 | − | GUGAGUACAAGUCUAAA | 17 | 15574 |
| BCL11A-13238 | − | GCUGGUGGGGAAAGGGA | 17 | 15575 |
| BCL11A-13239 | − | GUCCGGGAGCAACUCUA | 17 | 15576 |
| BCL11A-13240 | − | CCUUUUGUGCCGGCUCC | 17 | 15577 |
| BCL11A-13241 | − | ACCUGGCUUCCCUCCGC | 17 | 15578 |
| BCL11A-9896 | − | GCUCAGCUCUCAACUUC | 17 | 15579 |
| BCL11A-13242 | − | UCCUCUUUCCUCCUUUC | 17 | 15580 |
| BCL11A-13243 | − | GGGAGAAAAGAGGUGAG | 17 | 15581 |
| BCL11A-13244 | − | CAGCCCUCCAAACUUAG | 17 | 15582 |
| BCL11A-13245 | − | CUUUUCGAAAAGGAAUG | 17 | 15583 |
| BCL11A-13225 | + | CACGCGGACUCUAAAAU | 17 | 15584 |
| BCL11A-10006 | − | GAGCGCAGCCGCGGGCU | 17 | 15585 |
| BCL11A-13246 | − | GGAGUGAGUACAAGUCUAAA | 20 | 15586 |
| BCL11A-13247 | − | GGAGCUGGUGGGGAAAGGGA | 20 | 15587 |
| BCL11A-13248 | − | GGUGUCCGGGAGCAACUCUA | 20 | 15588 |
| BCL11A-13249 | − | CUGCCUUUUGUGCCGGCUCC | 20 | 15589 |
| BCL11A-13250 | − | UCUACCUGGCUUCCCUCCGC | 20 | 15590 |
| BCL11A-10131 | − | GAGGCUCAGCUCUCAACUUC | 20 | 15591 |
| BCL11A-13251 | − | UCCUCCUCUUUCCUCCUUUC | 20 | 15592 |
| BCL11A-13252 | − | CCGGGGAGAAAAGAGGUGAG | 20 | 15593 |
| BCL11A-13253 | − | CCGCAGCCCUCCAAACUUAG | 20 | 15594 |
| BCL11A-13254 | − | UCUCUUUUCGAAAAGGAAUG | 20 | 15595 |

TABLE 20C-continued

3rd Tier

| gRNA Name | DNA Strand | Targeting Domain | Target Site Length | SEQ ID NO: |
|---|---|---|---|---|
| BCL11A-13235 | + | ACACACGCGGACUCUAAAAU | 20 | 15596 |
| BCL11A-10241 | − | CCCGAGCGCAGCCGCGGGCU | 20 | 15597 |

Table 21A provides exemplary targeting domains for removing (e.g., deleting) the enhancer region of the BCL11A gene selected according to the first tier parameters. The targeting domains bind within a region 5' (51.5 to 51.7 kb downstream of TSS) or 3' (65.1 to 65.3 kb downstream of TSS), and have a high level of orthogonality and starts with 5'G. It is contemplated herein that in an embodiment the targeting domain hybridizes to the target domain through complementary base pairing. Any of the targeting domains in the table can be used with a S. pyogenes Cas9 molecule that generates a double stranded break (Cas9 nuclease) or a single-stranded break (Cas9 nickase).

TABLE 21A

1st Tier

| gRNA Name | DNA Strand | Targeting Domain | Target Site Length | 5' or 3' | SEQ ID NO: |
|---|---|---|---|---|---|
| BCL11A-13255 | + | GCACUAGGUGAAAUCUC | 17 | 5' | 15598 |
| BCL11A-13256 | − | GAAAGCAGUGUAAGGCU | 17 | 5' | 15599 |
| BCL11A-13257 | − | GUAAUUAAGAAAGCAGUGUA | 20 | 5' | 15600 |
| BCL11A-13258 | + | GUUGCACUAGGUGAAAUCUC | 20 | 5' | 15601 |
| BCL11A-13259 | − | GGCUGUUUUGGAAUGUAGAG | 20 | 5' | 15602 |
| BCL11A-13260 | − | GGCUGUUUUGGAUCUU | 17 | 3' | 15603 |
| BCL11A-13261 | + | GUGCUACUUAUACAAUUCAC | 20 | 3' | 15604 |
| BCL11A-13262 | + | GAAAAUACUUACUGUACUGC | 20 | 3' | 15605 |

Table 21B provides exemplary targeting domains for removing (e.g., deleting) the enhancer region of the BCL11A gene selected according to the second tier parameters. The targeting domains bind within a region 5' (51.5 to 51.7 kb downstream of TSS) or 3' (65.1 to 65.3 kb downstream of TSS) and have a high level of orthogonality. It is contemplated herein that in an embodiment the targeting domain hybridizes to the target domain through complementary base pairing. Any of the targeting domains in the table can be used with a S. pyogenes Cas9 molecule that generates a double stranded break (Cas9 nuclease) or a single-stranded break (Cas9 nickase).

TABLE 21B

2nd Tier

| gRNA Name | DNA Strand | Targeting Domain | Target Site Length | 5' or 3' | SEQ ID NO: |
|---|---|---|---|---|---|
| BCL11A-13263 | − | AUUAAGAAAGCAGUGUA | 17 | 5' | 15606 |
| BCL11A-13264 | + | AUUUUACUAGUGAAUUA | 17 | 5' | 15607 |
| BCL11A-13265 | + | AUUUAAGACGGGAAAAC | 17 | 5' | 15608 |
| BCL11A-13266 | − | AGAAAGCAGUGUAAGGC | 17 | 5' | 15609 |
| BCL11A-13267 | − | UGUUUUGGAAUGUAGAG | 17 | 5' | 15610 |

TABLE 21B-continued

2nd Tier

| gRNA Name | DNA Strand | Targeting Domain | Target Site Length | 5' or 3' | SEQ ID NO: |
|---|---|---|---|---|---|
| BCL11A-13268 | + | ACAACUUGUGUUGCACU | 17 | 5' | 15611 |
| BCL11A-13269 | + | UCUCACAUAAAAAUUUAAGA | 20 | 5' | 15612 |
| BCL11A-13270 | − | UUGGAAUGUAGAGAGGCAGA | 20 | 5' | 15613 |
| BCL11A-13271 | + | AUUAUUUUACUAGUGAAUUA | 20 | 5' | 15614 |
| BCL11A-13272 | + | AAAAUUUAAGACGGGAAAAC | 20 | 5' | 15615 |
| BCL11A-13273 | + | CUCACAUAAAAAUUUAAGAC | 20 | 5' | 15616 |
| BCL11A-13274 | + | UACACAACUUGUGUUGCACU | 20 | 5' | 15617 |
| BCL11A-13275 | − | UAAGAAAGCAGUGUAAGGCU | 20 | 5' | 15618 |
| BCL11A-13276 | − | AUUAGAAUAAAAGGCUGUUU | 20 | 5' | 15619 |
| BCL11A-13277 | − | UAUUUACAGCCAUAACA | 17 | 3' | 15620 |
| BCL11A-13278 | + | AUACUUACUGUACUGCA | 17 | 3' | 15621 |
| BCL11A-13279 | + | CACUGGAAACCCUGUUA | 17 | 3' | 15622 |
| BCL11A-13280 | − | CUAUUUACAGCCAUAAC | 17 | 3' | 15623 |
| BCL11A-13281 | + | CUACUUAUACAAUUCAC | 17 | 3' | 15624 |
| BCL11A-13282 | + | AAUACUUACUGUACUGC | 17 | 3' | 15625 |
| BCL11A-13283 | + | UACUUACUGUACUGCAG | 17 | 3' | 15626 |
| BCL11A-13284 | + | UGUACUGCAGGGGAAUU | 17 | 3' | 15627 |
| BCL11A-13285 | − | UGGGUAGCAGUGGCUUU | 17 | 3' | 15628 |
| BCL11A-13286 | − | UGGCUUUAGGCUGUUUU | 17 | 3' | 15629 |
| BCL11A-13287 | − | AACUAUUUACAGCCAUAACA | 20 | 3' | 15630 |
| BCL11A-13288 | + | AAAAUACUUACUGUACUGCA | 20 | 3' | 15631 |
| BCL11A-13289 | + | AUUCACUGGAAACCCUGUUA | 20 | 3' | 15632 |
| BCL11A-13290 | − | AAACUAUUUACAGCCAUAAC | 20 | 3' | 15633 |
| BCL11A-13291 | + | AAAUACUUACUGUACUGCAG | 20 | 3' | 15634 |
| BCL11A-13292 | + | UACUGUACUGCAGGGGAAUU | 20 | 3' | 15635 |
| BCL11A-13293 | − | UUAGGCUGUUUUUGGAUCUU | 20 | 3' | 15636 |
| BCL11A-13294 | − | CAGUGGCUUUAGGCUGUUUU | 20 | 3' | 15637 |

Table 21C provides exemplary targeting domains for removing (e.g., deleting) the enhancer region of the BCL11A gene selected according to the third tier parameters. The targeting domains bind within a region 5' (51.5 to 51.7 kb downstream of TSS) or 3' (65.1 to 65.3 kb downstream of TSS) and starts with 5'G. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 21C

| | | 3rd Tier | | | |
|---|---|---|---|---|---|
| gRNA Name | DNA Strand | Targeting Domain | Target Site Length | 5' or 3' | SEQ ID NO: |
| BCL11A-13295 | − | GAAUGUAGAGAGGCAGA | 17 | 5' | 15638 |
| BCL11A-13296 | − | GGAAUGUAGAGAGGCAG | 17 | 5' | 15639 |
| BCL11A-13297 | − | GUAUUUUCUUUCAUUGG | 17 | 3' | 15640 |
| BCL11A-13298 | − | GUAAGUAUUUUCUUUCAUUG | 20 | 3' | 15641 |

Table 21D provides exemplary targeting domains for removing (e.g., deleting) the enhancer region of the BCL11A gene selected according to the fourth tier parameters. The targeting domains bind within a region 5' (51.5 to 51.7 kb downstream of TSS) or 3' (65.1 to 65.3 kb downstream of TSS). It is contemplated herein that in an embodiment the targeting domain hybridizes to the target domain through complementary base pairing. Any of the targeting domains in the table can be used with a S. pyogenes Cas9 molecule that generates a double stranded break (Cas9 nuclease) or a single-stranded break (Cas9 nickase).

Table 21E provides targeting domains for removing (e.g., deleting) the enhancer region of the BCL11A gene by dual targeting (e.g., dual double strand cleavage). It is contemplated herein that an upstream gRNA can be paired with a downstream gRNA to guide Cas9 nuclease pairs. Exemplary nickase pairs include a targeting domain from Group A and a second targeting domain from Group B, or include a targeting domain from Group C and a second targeting domain from Group D. It is contemplated herein that in an embodiment a targeting domain of Group A can be combined with any of the targeting domains of Group B; in an

TABLE 21D

| | | 4th Tier | | | |
|---|---|---|---|---|---|
| gRNA Name | DNA Strand | Targeting Domain | Target Site Length | 5' or 3' | SEQ ID NO: |
| BCL11A-13299 | − | AAAAUAAUUAGAAUAAA | 17 | 5' | 15642 |
| BCL11A-13300 | + | CACAUAAAAAUUUAAGA | 17 | 5' | 15643 |
| BCL11A-13301 | + | ACAUAAAAAUUUAAGAC | 17 | 5' | 15644 |
| BCL11A-13302 | − | UGUAAGGCUGGGCGCAG | 17 | 5' | 15645 |
| BCL11A-13303 | − | AAUGUAGAGAGGCAGAG | 17 | 5' | 15646 |
| BCL11A-13304 | − | AGAAUAAAAGGCUGUUU | 17 | 5' | 15647 |
| BCL11A-13305 | − | AGUAAAAUAAUUAGAAUAAA | 20 | 5' | 15648 |
| BCL11A-13306 | − | UUAAGAAAGCAGUGUAAGGC | 20 | 5' | 15649 |
| BCL11A-13307 | − | CAGUGUAAGGCUGGGCGCAG | 20 | 5' | 15650 |
| BCL11A-13308 | − | UUUGGAAUGUAGAGAGGCAG | 20 | 5' | 15651 |
| BCL11A-13309 | − | UGGAAUGUAGAGAGGCAGAG | 20 | 5' | 15652 |
| BCL11A-13310 | − | AGUAUUUUCUUUCAUUG | 17 | 3' | 15653 |
| BCL11A-13311 | − | UAAGUAUUUUCUUUCAU | 17 | 3' | 15654 |
| BCL11A-13312 | − | AAGUAUUUUCUUUCAUU | 17 | 3' | 15655 |
| BCL11A-13313 | − | UAAGUAUUUUCUUUCAUUGG | 20 | 3' | 15656 |
| BCL11A-13314 | − | CAGUAAGUAUUUUCUUUCAU | 20 | 3' | 15657 |
| BCL11A-13315 | − | AGUAAGUAUUUUCUUUCAUU | 20 | 3' | 15658 | embodiment a targeting domain of Group C can be combined with any of the targeting domains of Group D. For example, BCL11A-13271 or BCL11A-13264 can be combined with BCL11A-13276; or BCL11A-13262 or BCL11A-13282 can be combined with BCL11A-13290 or BCL11A-13280.

TABLE 21E

| Group A | Group B |
|---|---|
| BCL11A-13271, BCL11A-13264 | BCL11A-13276 |

TABLE 21E-continued

| Group C | Group D |
|---|---|
| BCL11A-13262, BCL11A-13282 | BCL11A-13290, BCL11A-13280 |

Table 22A provides exemplary targeting domains for removing (e.g., deleting) the enhancer region of the BCL11A gene selected according to the first tier parameters. The targeting domains bind within a region 5' (51.5 to 51.7 kb downstream of TSS) or 3' (65.1 to 65.3 kb downstream of TSS), have a high level of orthogonality, and start with 5'G. The PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 22A

1st Tier

| gRNA Name | DNA Strand | Targeting Domain | Target Site Length | 5' or 3' | SEQ ID NO: |
|---|---|---|---|---|---|
| BCL11A-13316 | – | GGGGCUGAUAUAACUUCU | 18 | 5' | 15659 |
| BCL11A-13317 | – | GAGGGGCUGAUAUAACUUCU | 20 | 5' | 15660 |
| BCL11A-13318 | – | GCAGAGGGGCUGAUAUAACUUCU | 23 | 5' | 15661 |
| BCL11A-13319 | – | GGCAGAGGGGCUGAUAUAACUUCU | 24 | 5' | 15662 |
| BCL11A-13320 | – | GCAAACUAUUUACAGCCAUAA | 21 | 3' | 15663 |
| BCL11A-13321 | – | GAAGCAAACUAUUUACAGCCAUAA | 24 | 3' | 15664 |
| BCL11A-13322 | – | GCCAUAACAGGGUUUCCA | 18 | 3' | 15665 |
| BCL11A-13323 | – | GUGAAUUGUAUAAGUAGCA | 19 | 3' | 15666 |
| BCL11A-13324 | – | GCAAAACUAGAAAGUUUUA | 19 | 3' | 15667 |
| BCL11A-13325 | – | GCAGUGGCUUUAGGCUGUUU | 20 | 3' | 15668 |
| BCL11A-13326 | – | GUAGCAGUGGCUUUAGGCUGUUU | 23 | 3' | 15669 |
| BCL11A-13327 | – | GGUAGCAGUGGCUUUAGGCUGUUU | 24 | 3' | 15670 |

Table 22B provides exemplary targeting domains for removing (e.g., deleting) the enhancer region of the BCL11A gene selected according to the second tier parameters. The targeting domains bind within a region 5' (51.5 to 51.7 kb downstream of TSS) or 3' (65.1 to 65.3 kb downstream of TSS), and have a high level of orthogonality. The PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 22B

2nd Tier

| gRNA Name | DNA Strand | Targeting Domain | Target Site Length | 5' or 3' | SEQ ID NO: |
|---|---|---|---|---|---|
| BCL11A-13328 | + | UUUAUUCUAAUUAUUUACUA | 21 | 5' | 15671 |
| BCL11A-13329 | + | UUUUAUUCUAAUUAUUUACUA | 22 | 5' | 15672 |

TABLE 22B-continued

2nd Tier

| gRNA Name | DNA Strand | Targeting Domain | Target Site Length | 5' or 3' | SEQ ID NO: |
|---|---|---|---|---|---|
| BCL11A-13330 | + | CUUUUAUUCUAAUUAUUUUACUA | 23 | 5' | 15673 |
| BCL11A-13331 | + | CCUUUUAUUCUAAUUAUUUUACUA | 24 | 5' | 15674 |
| BCL11A-13332 | + | UAUUUUACUAGUGAAUUA | 18 | 5' | 15675 |
| BCL11A-13333 | + | UUAUUUUACUAGUGAAUUA | 19 | 5' | 15676 |
| BCL11A-13334 | + | AUUAUUUUACUAGUGAAUUA | 20 | 5' | 15677 |
| BCL11A-13335 | + | AAUUAUUUUACUAGUGAAUUA | 21 | 5' | 15678 |
| BCL11A-13336 | + | UAAUUAUUUUACUAGUGAAUUA | 22 | 5' | 15679 |
| BCL11A-13337 | + | CUAAUUAUUUUACUAGUGAAUUA | 23 | 5' | 15680 |
| BCL11A-13338 | + | UCUAAUUAUUUUACUAGUGAAUUA | 24 | 5' | 15681 |
| BCL11A-13339 | - | AUUCACUAGUAAAAUAAU | 18 | 5' | 15682 |
| BCL11A-13340 | - | AAUUCACUAGUAAAAUAAU | 19 | 5' | 15683 |
| BCL11A-13341 | - | UAAUUCACUAGUAAAAUAAU | 20 | 5' | 15684 |
| BCL11A-13342 | - | AGGGGCUGAUAUAACUUCU | 19 | 5' | 15685 |
| BCL11A-13343 | - | AGAGGGGCUGAUAUAACUUCU | 21 | 5' | 15686 |
| BCL11A-13344 | - | CAGAGGGGCUGAUAUAACUUCU | 22 | 5' | 15687 |
| BCL11A-13345 | - | UAGAAUAAAAGGCUGUUU | 18 | 5' | 15688 |
| BCL11A-13346 | - | UUAGAAUAAAAGGCUGUUU | 19 | 5' | 15689 |
| BCL11A-13347 | - | AUUAGAAUAAAAGGCUGUUU | 20 | 5' | 15690 |
| BCL11A-13348 | - | AAUUAGAAUAAAAGGCUGUUU | 21 | 5' | 15691 |
| BCL11A-13349 | - | UAAUUAGAAUAAAAGGCUGUUU | 22 | 5' | 15692 |
| BCL11A-13350 | - | AUAAUUAGAAUAAAAGGCUGUUU | 23 | 5' | 15693 |
| BCL11A-13351 | - | AAUAAUUAGAAUAAAAGGCUGUUU | 24 | 5' | 15694 |
| BCL11A-13352 | + | AUACUUACUGUACUGCAG | 18 | 3' | 15695 |
| BCL11A-13353 | + | AAUACUUACUGUACUGCAG | 19 | 3' | 15696 |
| BCL11A-13354 | + | AAAUACUUACUGUACUGCAG | 20 | 3' | 15697 |
| BCL11A-13355 | - | AACUAUUUACAGCCAUAA | 18 | 3' | 15698 |
| BCL11A-13356 | - | AAACUAUUUACAGCCAUAA | 19 | 3' | 15699 |
| BCL11A-13357 | - | CAAACUAUUUACAGCCAUAA | 20 | 3' | 15700 |
| BCL11A-13358 | - | AGCAAACUAUUUACAGCCAUAA | 22 | 3' | 15701 |
| BCL11A-13359 | - | AAGCAAACUAUUUACAGCCAUAA | 23 | 3' | 15702 |
| BCL11A-13360 | - | AGCCAUAACAGGGUUUCCA | 19 | 3' | 15703 |
| BCL11A-13361 | - | CAGCCAUAACAGGGUUUCCA | 20 | 3' | 15704 |
| BCL11A-13362 | - | ACAGCCAUAACAGGGUUUCCA | 21 | 3' | 15705 |
| BCL11A-13363 | - | UACAGCCAUAACAGGGUUUCCA | 22 | 3' | 15706 |
| BCL11A-13364 | - | UUACAGCCAUAACAGGGUUUCCA | 23 | 3' | 15707 |
| BCL11A-13365 | - | UUUACAGCCAUAACAGGGUUUCCA | 24 | 3' | 15708 |
| BCL11A-13366 | - | UGAAUUGUAUAAGUAGCA | 18 | 3' | 15709 |

TABLE 22B-continued

2nd Tier

| gRNA Name | DNA Strand | Targeting Domain | Target Site Length | 5' or 3' | SEQ ID NO: |
|---|---|---|---|---|---|
| BCL11A-13367 | − | AGUGAAUUGUAUAAGUAGCA | 20 | 3' | 15710 |
| BCL11A-13368 | − | CAGUGAAUUGUAUAAGUAGCA | 21 | 3' | 15711 |
| BCL11A-13369 | − | CCAGUGAAUUGUAUAAGUAGCA | 22 | 3' | 15712 |
| BCL11A-13370 | − | UCCAGUGAAUUGUAUAAGUAGCA | 23 | 3' | 15713 |
| BCL11A-13371 | − | UUCCAGUGAAUUGUAUAAGUAGCA | 24 | 3' | 15714 |
| BCL11A-13372 | − | CAAAACUAGAAAGUUUUA | 18 | 3' | 15715 |
| BCL11A-13373 | − | AGCAAAACUAGAAAGUUUUA | 20 | 3' | 15716 |
| BCL11A-13374 | − | AGUGGCUUUAGGCUGUUU | 18 | 3' | 15717 |
| BCL11A-13375 | − | CAGUGGCUUUAGGCUGUUU | 19 | 3' | 15718 |
| BCL11A-13376 | − | AGCAGUGGCUUUAGGCUGUUU | 21 | 3' | 15719 |
| BCL11A-13377 | − | UAGCAGUGGCUUUAGGCUGUUU | 22 | 3' | 15720 |

Table 22C provides exemplary targeting domains for removing (e.g., deleting) the enhancer region of the BCL11A gene selected according to the third tier parameters. The targeting domains bind within a region 5' (51.5 to 51.7 kb downstream of TSS) or 3' (65.1 to 65.3 kb downstream of TSS), and start with 5'G. The PAM is NNGRRT.

It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 22C

3rd Tier

| gRNA Name | DNA Strand | Targeting Domain | Target Site Length | 5' or 3' | SEQ ID NO: |
|---|---|---|---|---|---|
| BCL11A-13378 | + | GAAAAUACUUACUGUACUGCAG | 22 | 3' | 15721 |
| BCL11A-13379 | − | GUUAAGCAAAACUAGAAAGUUUUA | 24 | 3' | 15722 |

Table 22D provides exemplary targeting domains for removing (e.g., deleting) the enhancer region of the BCL11A gene selected according to the second tier parameters. The targeting domains bind within a region 5' (51.5 to 51.7 kb downstream of TSS) or 3' (65.1 to 65.3 kb downstream of TSS), and the PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 22D

4th Tier

| gRNA Name | DNA Strand | Targeting Domain | Target Site Length | 5' or 3' | SEQ ID NO: |
|---|---|---|---|---|---|
| BCL11A-13380 | + | AUUCUAAUUAUUUUACUA | 18 | 5' | 15723 |
| BCL11A-13381 | + | UAUUCUAAUUAUUUUACUA | 19 | 5' | 15724 |

TABLE 22D-continued

4th Tier

| gRNA Name | DNA Strand | Targeting Domain | Target Site Length | 5' or 3' | SEQ ID NO: |
|---|---|---|---|---|---|
| BCL11A-13382 | + | UUAUUCUAAUUAUUUUACUA | 20 | 5' | 15725 |
| BCL11A-13383 | − | AUAAUUCACUAGUAAAAUAAU | 21 | 5' | 15726 |
| BCL11A-13384 | − | CAUAAUUCACUAGUAAAAUAAU | 22 | 5' | 15727 |
| BCL11A-13385 | − | CCAUAAUUCACUAGUAAAAUAAU | 23 | 5' | 15728 |
| BCL11A-13386 | − | UCCAUAAUUCACUAGUAAAAUAAU | 24 | 5' | 15729 |
| BCL11A-13387 | + | AAAAUACUUACUGUACUGCAG | 21 | 3' | 15730 |
| BCL11A-13388 | + | AGAAAAUACUUACUGUACUGCAG | 23 | 3' | 15731 |
| BCL11A-13389 | + | AAGAAAAUACUUACUGUACUGCAG | 24 | 3' | 15732 |
| BCL11A-13390 | − | AAGCAAAACUAGAAAGUUUUA | 21 | 3' | 15733 |
| BCL11A-13391 | − | UAAGCAAAACUAGAAAGUUUUA | 22 | 3' | 15734 |
| BCL11A-13392 | − | UUAAGCAAAACUAGAAAGUUUUA | 23 | 3' | 15735 |

Table 22E provides exemplary targeting domains for removing (e.g., deleting) the enhancer region of the BCL11A gene selected according to the third tier parameters. The targeting domains bind within a region 5' (51.5 to 51.7 kb downstream of TSS) or 3' (65.1 to 65.3 kb downstream of TSS), and the PAM is NNGRRV. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 22E

5th Tier

| gRNA Name | DNA Strand | Targeting Domain | Target Site Length | 5' or 3' | SEQ ID NO: |
|---|---|---|---|---|---|
| BCL11A-13393 | + | AAAUUUAAGACGGGAAAA | 18 | 5' | 15736 |
| BCL11A-13394 | + | AAAAUUUAAGACGGGAAAA | 19 | 5' | 15737 |
| BCL11A-13395 | + | AAAAAUUUAAGACGGGAAAA | 20 | 5' | 15738 |
| BCL11A-13396 | + | UAAAAAUUUAAGACGGGAAAA | 21 | 5' | 15739 |
| BCL11A-13397 | + | AUAAAAAUUUAAGACGGGAAAA | 22 | 5' | 15740 |
| BCL11A-13398 | + | CAUAAAAAUUUAAGACGGGAAAA | 23 | 5' | 15741 |
| BCL11A-13399 | + | ACAUAAAAAUUUAAGACGGGAAAA | 24 | 5' | 15742 |
| BCL11A-13400 | + | UCACAUAAAAAUUUAAGA | 18 | 5' | 15743 |
| BCL11A-13401 | + | CUCACAUAAAAAUUUAAGA | 19 | 5' | 15744 |
| BCL11A-13402 | + | UCUCACAUAAAAAUUUAAGA | 20 | 5' | 15745 |
| BCL11A-13403 | + | AUCUCACAUAAAAAUUUAAGA | 21 | 5' | 15746 |
| BCL11A-13404 | + | CAUCUCACAUAAAAAUUUAAGA | 22 | 5' | 15747 |
| BCL11A-13405 | + | UCAUCUCACAUAAAAAUUUAAGA | 23 | 5' | 15748 |
| BCL11A-13406 | + | CUCAUCUCACAUAAAAAUUUAAGA | 24 | 5' | 15749 |
| BCL11A-13407 | + | AAUUUAAGACGGGAAAAC | 18 | 5' | 15750 |
| BCL11A-13408 | + | AAAUUUAAGACGGGAAAAC | 19 | 5' | 15751 |

TABLE 22E-continued

5th Tier

| gRNA Name | DNA Strand | Targeting Domain | Target Site Length | 5' or 3' | SEQ ID NO: |
|---|---|---|---|---|---|
| BCL11A-13409 | + | AAAAUUUAAGACGGGAAAAC | 20 | 5' | 15752 |
| BCL11A-13410 | + | AAAAAUUUAAGACGGGAAAAC | 21 | 5' | 15753 |
| BCL11A-13411 | + | UAAAAAUUUAAGACGGGAAAAC | 22 | 5' | 15754 |
| BCL11A-13412 | + | AUAAAAAUUUAAGACGGGAAAAC | 23 | 5' | 15755 |
| BCL11A-13413 | + | CAUAAAAAUUUAAGACGGGAAAAC | 24 | 5' | 15756 |
| BCL11A-13414 | + | CACAUAAAAAUUUAAGAC | 18 | 5' | 15757 |
| BCL11A-13415 | + | UCACAUAAAAAUUUAAGAC | 19 | 5' | 15758 |
| BCL11A-13416 | + | CUCACAUAAAAAUUUAAGAC | 20 | 5' | 15759 |
| BCL11A-13417 | + | UCUCACAUAAAAAUUUAAGAC | 21 | 5' | 15760 |
| BCL11A-13418 | + | AUCUCACAUAAAAAUUUAAGAC | 22 | 5' | 15761 |
| BCL11A-13419 | + | CAUCUCACAUAAAAAUUUAAGAC | 23 | 5' | 15762 |
| BCL11A-13420 | + | UCAUCUCACAUAAAAAUUUAAGAC | 24 | 5' | 15763 |
| BCL11A-13421 | + | CUCACAUAAAAAUUUAAG | 18 | 5' | 15764 |
| BCL11A-13422 | + | UCUCACAUAAAAAUUUAAG | 19 | 5' | 15765 |
| BCL11A-13423 | + | AUCUCACAUAAAAAUUUAAG | 20 | 5' | 15766 |
| BCL11A-13424 | + | CAUCUCACAUAAAAAUUUAAG | 21 | 5' | 15767 |
| BCL11A-13425 | + | UCAUCUCACAUAAAAAUUUAAG | 22 | 5' | 15768 |
| BCL11A-13426 | + | CUCAUCUCACAUAAAAAUUUAAG | 23 | 5' | 15769 |
| BCL11A-13427 | + | GCUCAUCUCACAUAAAAAUUUAAG | 24 | 5' | 15770 |
| BCL11A-13428 | + | CAACUUGUGUUGCACUAG | 18 | 5' | 15771 |
| BCL11A-13429 | + | ACAACUUGUGUUGCACUAG | 19 | 5' | 15772 |
| BCL11A-13430 | + | CACAACUUGUGUUGCACUAG | 20 | 5' | 15773 |
| BCL11A-13431 | + | ACACAACUUGUGUUGCACUAG | 21 | 5' | 15774 |
| BCL11A-13432 | + | UACACAACUUGUGUUGCACUAG | 22 | 5' | 15775 |
| BCL11A-13433 | + | CUACACAACUUGUGUUGCACUAG | 23 | 5' | 15776 |
| BCL11A-13434 | + | UCUACACAACUUGUGUUGCACUAG | 24 | 5' | 15777 |
| BCL11A-13435 | + | AACAGGAAGAUGCAUUCU | 18 | 5' | 15778 |
| BCL11A-13436 | + | AAACAGGAAGAUGCAUUCU | 19 | 5' | 15779 |
| BCL11A-13437 | + | AAAACAGGAAGAUGCAUUCU | 20 | 5' | 15780 |
| BCL11A-13438 | + | GAAAACAGGAAGAUGCAUUCU | 21 | 5' | 15781 |
| BCL11A-13439 | + | GGAAAACAGGAAGAUGCAUUCU | 22 | 5' | 15782 |
| BCL11A-13440 | + | GGGAAAACAGGAAGAUGCAUUCU | 23 | 5' | 15783 |
| BCL11A-13441 | + | CGGGAAAACAGGAAGAUGCAUUCU | 24 | 5' | 15784 |
| BCL11A-13442 | + | UUAUUUUACUAGUGAAUU | 18 | 5' | 15785 |
| BCL11A-13443 | + | AUUAUUUUACUAGUGAAUU | 19 | 5' | 15786 |
| BCL11A-13444 | + | AAUUAUUUUACUAGUGAAUU | 20 | 5' | 15787 |
| BCL11A-13445 | + | UAAUUAUUUUACUAGUGAAUU | 21 | 5' | 15788 |

TABLE 22E-continued

5th Tier

| gRNA Name | DNA Strand | Targeting Domain | Target Site Length | 5' or 3' | SEQ ID NO: |
|---|---|---|---|---|---|
| BCL11A-13446 | + | CUAAUUAUUUUACUAGUGAAUU | 22 | 5' | 15789 |
| BCL11A-13447 | + | UCUAAUUAUUUUACUAGUGAAUU | 23 | 5' | 15790 |
| BCL11A-13448 | + | UUCUAAUUAUUUUACUAGUGAAUU | 24 | 5' | 15791 |
| BCL11A-13449 | + | AAAACAGGAAGAUGCAUU | 18 | 5' | 15792 |
| BCL11A-13450 | + | GAAAACAGGAAGAUGCAUU | 19 | 5' | 15793 |
| BCL11A-13451 | + | GGAAAACAGGAAGAUGCAUU | 20 | 5' | 15794 |
| BCL11A-13452 | + | GGGAAAACAGGAAGAUGCAUU | 21 | 5' | 15795 |
| BCL11A-13453 | + | CGGGAAAACAGGAAGAUGCAUU | 22 | 5' | 15796 |
| BCL11A-13454 | + | ACGGGAAAACAGGAAGAUGCAUU | 23 | 5' | 15797 |
| BCL11A-13455 | + | GACGGGAAAACAGGAAGAUGCAUU | 24 | 5' | 15798 |
| BCL11A-13456 | − | UUGGAAUGUAGAGAGGCA | 18 | 5' | 15799 |
| BCL11A-13457 | − | UUUGGAAUGUAGAGAGGCA | 19 | 5' | 15800 |
| BCL11A-13458 | − | UUUUGGAAUGUAGAGAGGCA | 20 | 5' | 15801 |
| BCL11A-13459 | − | GUUUUGGAAUGUAGAGAGGCA | 21 | 5' | 15802 |
| BCL11A-13460 | − | UGUUUUGGAAUGUAGAGAGGCA | 22 | 5' | 15803 |
| BCL11A-13461 | − | CUGUUUUGGAAUGUAGAGAGGCA | 23 | 5' | 15804 |
| BCL11A-13462 | − | GCUGUUUUGGAAUGUAGAGAGGCA | 24 | 5' | 15805 |
| BCL11A-13463 | − | CAACACAAGUUGUGUAGA | 18 | 5' | 15806 |
| BCL11A-13464 | − | GCAACACAAGUUGUGUAGA | 19 | 5' | 15807 |
| BCL11A-13465 | − | UGCAACACAAGUUGUGUAGA | 20 | 5' | 15808 |
| BCL11A-13466 | − | GUGCAACACAAGUUGUGUAGA | 21 | 5' | 15809 |
| BCL11A-13467 | − | AGUGCAACACAAGUUGUGUAGA | 22 | 5' | 15810 |
| BCL11A-13468 | − | UAGUGCAACACAAGUUGUGUAGA | 23 | 5' | 15811 |
| BCL11A-13469 | − | CUAGUGCAACACAAGUUGUGUAGA | 24 | 5' | 15812 |
| BCL11A-13470 | − | AGGCUGUUUUGGAAUGUA | 18 | 5' | 15813 |
| BCL11A-13471 | − | AAGGCUGUUUUGGAAUGUA | 19 | 5' | 15814 |
| BCL11A-13472 | − | AAAGGCUGUUUUGGAAUGUA | 20 | 5' | 15815 |
| BCL11A-13473 | − | AAAAGGCUGUUUUGGAAUGUA | 21 | 5' | 15816 |
| BCL11A-13474 | − | UAAAAGGCUGUUUUGGAAUGUA | 22 | 5' | 15817 |
| BCL11A-13475 | − | AUAAAAGGCUGUUUUGGAAUGUA | 23 | 5' | 15818 |
| BCL11A-13476 | − | AAUAAAAGGCUGUUUUGGAAUGUA | 24 | 5' | 15819 |
| BCL11A-13477 | − | UGGAAUGUAGAGAGGCAG | 18 | 5' | 15820 |
| BCL11A-13478 | − | UUGGAAUGUAGAGAGGCAG | 19 | 5' | 15821 |
| BCL11A-13479 | − | UUUGGAAUGUAGAGAGGCAG | 20 | 5' | 15822 |
| BCL11A-13480 | − | UUUUGGAAUGUAGAGAGGCAG | 21 | 5' | 15823 |
| BCL11A-13481 | − | GUUUUGGAAUGUAGAGAGGCAG | 22 | 5' | 15824 |
| BCL11A-13482 | − | UGUUUUGGAAUGUAGAGAGGCAG | 23 | 5' | 15825 |

TABLE 22E-continued

5th Tier

| gRNA Name | DNA Strand | Targeting Domain | Target Site Length | 5' or 3' | SEQ ID NO: |
|---|---|---|---|---|---|
| BCL11A-13483 | − | CUGUUUUGGAAUGUAGAGAGGCAG | 24 | 5' | 15826 |
| BCL11A-13484 | − | CUUAAAUUUUUAUGUGAG | 18 | 5' | 15827 |
| BCL11A-13485 | − | UCUUAAAUUUUUAUGUGAG | 19 | 5' | 15828 |
| BCL11A-13486 | − | GUCUUAAAUUUUUAUGUGAG | 20 | 5' | 15829 |
| BCL11A-13487 | − | CGUCUUAAAUUUUUAUGUGAG | 21 | 5' | 15830 |
| BCL11A-13488 | − | CCGUCUUAAAUUUUUAUGUGAG | 22 | 5' | 15831 |
| BCL11A-13489 | − | CCCGUCUUAAAUUUUUAUGUGAG | 23 | 5' | 15832 |
| BCL11A-13490 | − | UCCCGUCUUAAAUUUUUAUGUGAG | 24 | 5' | 15833 |
| BCL11A-13491 | − | UAAGAAAGCAGUGUAAGG | 18 | 5' | 15834 |
| BCL11A-13492 | − | UUAAGAAAGCAGUGUAAGG | 19 | 5' | 15835 |
| BCL11A-13493 | − | AUUAAGAAAGCAGUGUAAGG | 20 | 5' | 15836 |
| BCL11A-13494 | − | AAUUAAGAAAGCAGUGUAAGG | 21 | 5' | 15837 |
| BCL11A-13495 | − | UAAUUAAGAAAGCAGUGUAAGG | 22 | 5' | 15838 |
| BCL11A-13496 | − | GUAAUUAAGAAAGCAGUGUAAGG | 23 | 5' | 15839 |
| BCL11A-13497 | − | UGUAAUUAAGAAAGCAGUGUAAGG | 24 | 5' | 15840 |
| BCL11A-13498 | − | UUUUGGAAUGUAGAGAGG | 18 | 5' | 15841 |
| BCL11A-13499 | − | GUUUUGGAAUGUAGAGAGG | 19 | 5' | 15842 |
| BCL11A-13500 | − | UGUUUUGGAAUGUAGAGAGG | 20 | 5' | 15843 |
| BCL11A-13501 | − | CUGUUUUGGAAUGUAGAGAGG | 21 | 5' | 15844 |
| BCL11A-13502 | − | GCUGUUUUGGAAUGUAGAGAGG | 22 | 5' | 15845 |
| BCL11A-13503 | − | GGCUGUUUUGGAAUGUAGAGAGG | 23 | 5' | 15846 |
| BCL11A-13504 | − | AGGCUGUUUUGGAAUGUAGAGAGG | 24 | 5' | 15847 |
| BCL11A-13505 | − | AAAGGCUGUUUUGGAAUG | 18 | 5' | 15848 |
| BCL11A-13506 | − | AAAAGGCUGUUUUGGAAUG | 19 | 5' | 15849 |
| BCL11A-13507 | − | UAAAAGGCUGUUUUGGAAUG | 20 | 5' | 15850 |
| BCL11A-13508 | − | AUAAAAGGCUGUUUUGGAAUG | 21 | 5' | 15851 |
| BCL11A-13509 | − | AAUAAAAGGCUGUUUUGGAAUG | 22 | 5' | 15852 |
| BCL11A-13510 | − | GAAUAAAAGGCUGUUUUGGAAUG | 23 | 5' | 15853 |
| BCL11A-13511 | − | AGAAUAAAAGGCUGUUUUGGAAUG | 24 | 5' | 15854 |
| BCL11A-13512 | − | AGUGCAACACAAGUUGUG | 18 | 5' | 15855 |
| BCL11A-13513 | − | UAGUGCAACACAAGUUGUG | 19 | 5' | 15856 |
| BCL11A-13514 | − | CUAGUGCAACACAAGUUGUG | 20 | 5' | 15857 |
| BCL11A-13515 | − | CCUAGUGCAACACAAGUUGUG | 21 | 5' | 15858 |
| BCL11A-13516 | − | ACCUAGUGCAACACAAGUUGUG | 22 | 5' | 15859 |
| BCL11A-13517 | − | CACCUAGUGCAACACAAGUUGUG | 23 | 5' | 15860 |
| BCL11A-13518 | − | UCACCUAGUGCAACACAAGUUGUG | 24 | 5' | 15861 |
| BCL11A-13519 | − | CCCGUCUUAAAUUUUUAU | 18 | 5' | 15862 |

TABLE 22E-continued

5th Tier

| gRNA Name | DNA Strand | Targeting Domain | Target Site Length | 5' or 3' | SEQ ID NO: |
|---|---|---|---|---|---|
| BCL11A-13520 | − | UCCCGUCUUAAAUUUUAU | 19 | 5' | 15863 |
| BCL11A-13521 | − | UUCCCGUCUUAAAUUUUAU | 20 | 5' | 15864 |
| BCL11A-13522 | − | UUUCCCGUCUUAAAUUUUAU | 21 | 5' | 15865 |
| BCL11A-13523 | − | UUUUCCCGUCUUAAAUUUUAU | 22 | 5' | 15866 |
| BCL11A-13524 | − | GUUUUCCCGUCUUAAAUUUUAU | 23 | 5' | 15867 |
| BCL11A-13525 | − | UGUUUUCCCGUCUUAAAUUUUAU | 24 | 5' | 15868 |
| BCL11A-13526 | − | GAGCACACUGCUGUAAUU | 18 | 5' | 15869 |
| BCL11A-13527 | − | UGAGCACACUGCUGUAAUU | 19 | 5' | 15870 |
| BCL11A-13528 | − | AUGAGCACACUGCUGUAAUU | 20 | 5' | 15871 |
| BCL11A-13529 | − | GAUGAGCACACUGCUGUAAUU | 21 | 5' | 15872 |
| BCL11A-13530 | − | AGAUGAGCACACUGCUGUAAUU | 22 | 5' | 15873 |
| BCL11A-13531 | − | GAGAUGAGCACACUGCUGUAAUU | 23 | 5' | 15874 |
| BCL11A-13532 | − | UGAGAUGAGCACACUGCUGUAAUU | 24 | 5' | 15875 |
| BCL11A-13533 | − | UUAGAAUAAAAGGCUGUU | 18 | 5' | 15876 |
| BCL11A-13534 | − | AUUAGAAUAAAAGGCUGUU | 19 | 5' | 15877 |
| BCL11A-13535 | − | AAUUAGAAUAAAAGGCUGUU | 20 | 5' | 15878 |
| BCL11A-13536 | − | UAAUUAGAAUAAAAGGCUGUU | 21 | 5' | 15879 |
| BCL11A-13537 | − | AUAAUUAGAAUAAAAGGCUGUU | 22 | 5' | 15880 |
| BCL11A-13538 | − | AAUAAUUAGAAUAAAAGGCUGUU | 23 | 5' | 15881 |
| BCL11A-13539 | − | AAAUAAUUAGAAUAAAAGGCUGUU | 24 | 5' | 15882 |
| BCL11A-13540 | + | UUUCAUUUUUGCUGACA | 18 | 3' | 15883 |
| BCL11A-13541 | + | GUUUCAUUUUUGCUGACA | 19 | 3' | 15884 |
| BCL11A-13542 | + | UGUUUCAUUUUUGCUGACA | 20 | 3' | 15885 |
| BCL11A-13543 | + | UUGUUUCAUUUUUGCUGACA | 21 | 3' | 15886 |
| BCL11A-13544 | + | UUUGUUUCAUUUUUGCUGACA | 22 | 3' | 15887 |
| BCL11A-13545 | + | UUUUGUUUCAUUUUUGCUGACA | 23 | 3' | 15888 |
| BCL11A-13546 | + | UUUUUGUUUCAUUUUUGCUGACA | 24 | 3' | 15889 |
| BCL11A-13547 | + | AAUAGUUUGCUUCCCCA | 18 | 3' | 15890 |
| BCL11A-13548 | + | AAAUAGUUUGCUUCCCCA | 19 | 3' | 15891 |
| BCL11A-13549 | + | UAAAUAGUUUGCUUCCCCA | 20 | 3' | 15892 |
| BCL11A-13550 | + | GUAAAUAGUUUGCUUCCCCA | 21 | 3' | 15893 |
| BCL11A-13551 | + | UGUAAAUAGUUUGCUUCCCCA | 22 | 3' | 15894 |
| BCL11A-13552 | + | CUGUAAAUAGUUUGCUUCCCCA | 23 | 3' | 15895 |
| BCL11A-13553 | + | GCUGUAAAUAGUUUGCUUCCCCA | 24 | 3' | 15896 |
| BCL11A-13554 | + | AAUACUUACUGUACUGCA | 18 | 3' | 15897 |
| BCL11A-13555 | + | AAAUACUUACUGUACUGCA | 19 | 3' | 15898 |
| BCL11A-13556 | + | AAAAUACUUACUGUACUGCA | 20 | 3' | 15899 |

TABLE 22E-continued

5th Tier

| gRNA Name | DNA Strand | Targeting Domain | Target Site Length | 5' or 3' | SEQ ID NO: |
|---|---|---|---|---|---|
| BCL11A-13557 | + | GAAAAUACUUACUGUACUGCA | 21 | 3' | 15900 |
| BCL11A-13558 | + | AGAAAAUACUUACUGUACUGCA | 22 | 3' | 15901 |
| BCL11A-13559 | + | AAGAAAAUACUUACUGUACUGCA | 23 | 3' | 15902 |
| BCL11A-13560 | + | AAAGAAAAUACUUACUGUACUGCA | 24 | 3' | 15903 |
| BCL11A-13561 | + | UGCUACUUAUACAAUUCA | 18 | 3' | 15904 |
| BCL11A-13562 | + | GUGCUACUUAUACAAUUCA | 19 | 3' | 15905 |
| BCL11A-13563 | + | AGUGCUACUUAUACAAUUCA | 20 | 3' | 15906 |
| BCL11A-13564 | + | CAGUGCUACUUAUACAAUUCA | 21 | 3' | 15907 |
| BCL11A-13565 | + | UCAGUGCUACUUAUACAAUUCA | 22 | 3' | 15908 |
| BCL11A-13566 | + | CUCAGUGCUACUUAUACAAUUCA | 23 | 3' | 15909 |
| BCL11A-13567 | + | ACUCAGUGCUACUUAUACAAUUCA | 24 | 3' | 15910 |
| BCL11A-13568 | + | GUUUGCUUCCCCCAAUGA | 18 | 3' | 15911 |
| BCL11A-13569 | + | AGUUUGCUUCCCCCAAUGA | 19 | 3' | 15912 |
| BCL11A-13570 | + | UAGUUUGCUUCCCCCAAUGA | 20 | 3' | 15913 |
| BCL11A-13571 | + | AUAGUUUGCUUCCCCCAAUGA | 21 | 3' | 15914 |
| BCL11A-13572 | + | AAUAGUUUGCUUCCCCCAAUGA | 22 | 3' | 15915 |
| BCL11A-13573 | + | AAAUAGUUUGCUUCCCCCAAUGA | 23 | 3' | 15916 |
| BCL11A-13574 | + | UAAAUAGUUUGCUUCCCCCAAUGA | 24 | 3' | 15917 |
| BCL11A-13575 | + | UUUCUAGUUUUGCUUAAC | 18 | 3' | 15918 |
| BCL11A-13576 | + | CUUUCUAGUUUUGCUUAAC | 19 | 3' | 15919 |
| BCL11A-13577 | + | ACUUUCUAGUUUUGCUUAAC | 20 | 3' | 15920 |
| BCL11A-13578 | + | AACUUUCUAGUUUUGCUUAAC | 21 | 3' | 15921 |
| BCL11A-13579 | + | AAACUUUCUAGUUUUGCUUAAC | 22 | 3' | 15922 |
| BCL11A-13580 | + | AAAACUUUCUAGUUUUGCUUAAC | 23 | 3' | 15923 |
| BCL11A-13581 | + | UAAAACUUUCUAGUUUUGCUUAAC | 24 | 3' | 15924 |
| BCL11A-13582 | + | GCUACUUAUACAAUUCAC | 18 | 3' | 15925 |
| BCL11A-13583 | + | UGCUACUUAUACAAUUCAC | 19 | 3' | 15926 |
| BCL11A-13584 | + | GUGCUACUUAUACAAUUCAC | 20 | 3' | 15927 |
| BCL11A-13585 | + | AGUGCUACUUAUACAAUUCAC | 21 | 3' | 15928 |
| BCL11A-13586 | + | CAGUGCUACUUAUACAAUUCAC | 22 | 3' | 15929 |
| BCL11A-13587 | + | UCAGUGCUACUUAUACAAUUCAC | 23 | 3' | 15930 |
| BCL11A-13588 | + | CUCAGUGCUACUUAUACAAUUCAC | 24 | 3' | 15931 |
| BCL11A-13589 | + | AAAUACUUACUGUACUGC | 18 | 3' | 15932 |
| BCL11A-13590 | + | AAAAUACUUACUGUACUGC | 19 | 3' | 15933 |
| BCL11A-13591 | + | GAAAAUACUUACUGUACUGC | 20 | 3' | 15934 |
| BCL11A-13592 | + | AGAAAAUACUUACUGUACUGC | 21 | 3' | 15935 |
| BCL11A-13593 | + | AAGAAAAUACUUACUGUACUGC | 22 | 3' | 15936 |

TABLE 22E-continued

5th Tier

| gRNA Name | DNA Strand | Targeting Domain | Target Site Length | 5' or 3' | SEQ ID NO: |
|---|---|---|---|---|---|
| BCL11A-13594 | + | AAAGAAAAUACUUACUGUACUGC | 23 | 3' | 15937 |
| BCL11A-13595 | + | GAAAGAAAAUACUUACUGUACUGC | 24 | 3' | 15938 |
| BCL11A-13596 | + | AAAAUACUUACUGUACUG | 18 | 3' | 15939 |
| BCL11A-13597 | + | GAAAAUACUUACUGUACUG | 19 | 3' | 15940 |
| BCL11A-13598 | + | AGAAAAUACUUACUGUACUG | 20 | 3' | 15941 |
| BCL11A-13599 | + | AAGAAAAUACUUACUGUACUG | 21 | 3' | 15942 |
| BCL11A-13600 | + | AAAGAAAAUACUUACUGUACUG | 22 | 3' | 15943 |
| BCL11A-13601 | + | GAAAGAAAAUACUUACUGUACUG | 23 | 3' | 15944 |
| BCL11A-13602 | + | UGAAAGAAAAUACUUACUGUACUG | 24 | 3' | 15945 |
| BCL11A-13603 | − | GUUCUGUGUCAGCAAAAA | 18 | 3' | 15946 |
| BCL11A-13604 | − | AGUUCUGUGUCAGCAAAAA | 19 | 3' | 15947 |
| BCL11A-13605 | − | GAGUUCUGUGUCAGCAAAAA | 20 | 3' | 15948 |
| BCL11A-13606 | − | UGAGUUCUGUGUCAGCAAAAA | 21 | 3' | 15949 |
| BCL11A-13607 | − | CUGAGUUCUGUGUCAGCAAAAA | 22 | 3' | 15950 |
| BCL11A-13608 | − | ACUGAGUUCUGUGUCAGCAAAAA | 23 | 3' | 15951 |
| BCL11A-13609 | − | CACUGAGUUCUGUGUCAGCAAAAA | 24 | 3' | 15952 |
| BCL11A-13610 | − | AGUAAGUAUUUUCUUUCA | 18 | 3' | 15953 |
| BCL11A-13611 | − | CAGUAAGUAUUUUCUUUCA | 19 | 3' | 15954 |
| BCL11A-13612 | − | ACAGUAAGUAUUUUCUUUCA | 20 | 3' | 15955 |
| BCL11A-13613 | − | UACAGUAAGUAUUUUCUUUCA | 21 | 3' | 15956 |
| BCL11A-13614 | − | GUACAGUAAGUAUUUUCUUUCA | 22 | 3' | 15957 |
| BCL11A-13615 | − | AGUACAGUAAGUAUUUUCUUUCA | 23 | 3' | 15958 |
| BCL11A-13616 | − | CAGUACAGUAAGUAUUUUCUUUCA | 24 | 3' | 15959 |
| BCL11A-13617 | − | UUUCAUGUUAAGCAAAAC | 18 | 3' | 15960 |
| BCL11A-13618 | − | UUUUCAUGUUAAGCAAAAC | 19 | 3' | 15961 |
| BCL11A-13619 | − | AUUUUCAUGUUAAGCAAAAC | 20 | 3' | 15962 |
| BCL11A-13620 | − | UAUUUUCAUGUUAAGCAAAAC | 21 | 3' | 15963 |
| BCL11A-13621 | − | UUAUUUUCAUGUUAAGCAAAAC | 22 | 3' | 15964 |
| BCL11A-13622 | − | AUUAUUUUCAUGUUAAGCAAAAC | 23 | 3' | 15965 |
| BCL11A-13623 | − | UAUUAUUUUCAUGUUAAGCAAAAC | 24 | 3' | 15966 |
| BCL11A-13624 | − | AGUAUUUUCUUUCAUUGG | 18 | 3' | 15967 |
| BCL11A-13625 | − | AAGUAUUUUCUUUCAUUGG | 19 | 3' | 15968 |
| BCL11A-13626 | − | UAAGUAUUUUCUUUCAUUGG | 20 | 3' | 15969 |
| BCL11A-13627 | − | GUAAGUAUUUUCUUUCAUUGG | 21 | 3' | 15970 |
| BCL11A-13628 | − | AGUAAGUAUUUUCUUUCAUUGG | 22 | 3' | 15971 |
| BCL11A-13629 | − | CAGUAAGUAUUUUCUUUCAUUGG | 23 | 3' | 15972 |
| BCL11A-13630 | − | ACAGUAAGUAUUUUCUUUCAUUGG | 24 | 3' | 15973 |

TABLE 22E-continued

5th Tier

| gRNA Name | DNA Strand | Targeting Domain | Target Site Length | 5' or 3' | SEQ ID NO: |
|---|---|---|---|---|---|
| BCL11A-13631 | - | AAGUAUUUCUUUCAUUG | 18 | 3' | 15974 |
| BCL11A-13632 | - | UAAGUAUUUCUUUCAUUG | 19 | 3' | 15975 |
| BCL11A-13633 | - | GUAAGUAUUUCUUUCAUUG | 20 | 3' | 15976 |
| BCL11A-13634 | - | AGUAAGUAUUUCUUUCAUUG | 21 | 3' | 15977 |
| BCL11A-13635 | - | CAGUAAGUAUUUCUUUCAUUG | 22 | 3' | 15978 |
| BCL11A-13636 | - | ACAGUAAGUAUUUCUUUCAUUG | 23 | 3' | 15979 |
| BCL11A-13637 | - | UACAGUAAGUAUUUCUUUCAUUG | 24 | 3' | 15980 |
| BCL11A-13638 | - | GUAAGUAUUUCUUUCAU | 18 | 3' | 15981 |
| BCL11A-13639 | - | AGUAAGUAUUUCUUUCAU | 19 | 3' | 15982 |
| BCL11A-13640 | - | CAGUAAGUAUUUCUUUCAU | 20 | 3' | 15983 |
| BCL11A-13641 | - | ACAGUAAGUAUUUCUUUCAU | 21 | 3' | 15984 |
| BCL11A-13642 | - | UACAGUAAGUAUUUCUUUCAU | 22 | 3' | 15985 |
| BCL11A-13643 | - | GUACAGUAAGUAUUUCUUUCAU | 23 | 3' | 15986 |
| BCL11A-13644 | - | AGUACAGUAAGUAUUUCUUUCAU | 24 | 3' | 15987 |
| BCL11A-13645 | - | UUGGCUAUUGAUACUGAU | 18 | 3' | 15988 |
| BCL11A-13646 | - | UUUGGCUAUUGAUACUGAU | 19 | 3' | 15989 |
| BCL11A-13647 | - | CUUUGGCUAUUGAUACUGAU | 20 | 3' | 15990 |
| BCL11A-13648 | - | UCUUUGGCUAUUGAUACUGAU | 21 | 3' | 15991 |
| BCL11A-13649 | - | AUCUUUGGCUAUUGAUACUGAU | 22 | 3' | 15992 |
| BCL11A-13650 | - | GAUCUUUGGCUAUUGAUACUGAU | 23 | 3' | 15993 |
| BCL11A-13651 | - | GGAUCUUUGGCUAUUGAUACUGAU | 24 | 3' | 15994 |
| BCL11A-13652 | - | UAAGUAUUUCUUUCAUU | 18 | 3' | 15995 |
| BCL11A-13653 | - | GUAAGUAUUUCUUUCAUU | 19 | 3' | 15996 |
| BCL11A-13654 | - | AGUAAGUAUUUCUUUCAUU | 20 | 3' | 15997 |
| BCL11A-13655 | - | CAGUAAGUAUUUCUUUCAUU | 21 | 3' | 15998 |
| BCL11A-13656 | - | ACAGUAAGUAUUUCUUUCAUU | 22 | 3' | 15999 |
| BCL11A-13657 | - | UACAGUAAGUAUUUCUUUCAUU | 23 | 3' | 16000 |
| BCL11A-13658 | - | GUACAGUAAGUAUUUCUUUCAUU | 24 | 3' | 16001 |

Table 23A provides exemplary targeting domains for removing (e.g., deleting) the enhancer region of the BCL11A gene selected according to the first tier parameters. The targeting domains bind within a region 5' (51.5 to 51.7 kb downstream of TSS) or 3' (65.1 to 65.3 kb downstream of TSS), have a high level of orthogonality, and start with 5'G. It is contemplated herein that in an embodiment the targeting domain hybridizes to the target domain through complementary base pairing. Any of the targeting domains in the table can be used with a N. meningitidis Cas9 molecule that generates a double stranded break (Cas9 nuclease) or a single-stranded break (Cas9 nickase).

TABLE 23A

1st Tier

| gRNA Name | DNA Strand | Targeting Domain | Target Site Length | 5' or 3' | SEQ ID NO: |
|---|---|---|---|---|---|
| BCL11A-13659 | − | GGAUCUUUGGCUAUUGA | 17 | 3' | 16002 |

Table 23B provides exemplary targeting domains for removing (e.g., deleting) the enhancer region of the BCL11A gene selected according to the second tier parameters. The targeting domains bind within a region 5' (51.5 to 51.7 kb downstream of TSS) or 3' (65.1 to 65.3 kb downstream of TSS) and have a high level of orthogonality. It is contemplated herein that in an embodiment the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 23B

2nd Tier

| gRNA Name | DNA Strand | Targeting Domain | Target Site Length | 5' or 3' | SEQ ID NO: |
|---|---|---|---|---|---|
| BCL11A-13660 | + | UCGGUAAAACUUUCUAG | 17 | 3' | 16003 |
| BCL11A-13661 | − | UUUGGAUCUUUGGCUAUUGA | 20 | 3' | 16004 |
| BCL11A-13662 | + | CCCUGUUAUGGCUGUAAAUA | 20 | 3' | 16005 |
| BCL11A-13663 | + | AAUUCGGUAAAACUUUCUAG | 20 | 3' | 16006 |

Table 23C provides exemplary targeting domains for removing (e.g., deleting) the enhancer region of the BCL11A gene selected according to the fourth tier parameters. The targeting domains bind within a region 5' (51.5 to 51.7 kb downstream of TSS) or 3' (65.1 to 65.3 kb downstream of TSS). It is contemplated herein that in an embodiment the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 23C

4th Tier

| gRNA Name | DNA Strand | Targeting Domain | Target Site Length | 5' or 3' | SEQ ID NO: |
|---|---|---|---|---|---|
| BCL11A-13664 | + | CACUGCGCCCAGCCUUA | 17 | 5' | 16007 |
| BCL11A-13665 | + | AGCCACUGCGCCCAGCCUUA | 20 | 5' | 16008 |
| BCL11A-13666 | + | UGUUAUGGCUGUAAAUA | 17 | 3' | 16009 |

Table 24A provides exemplary targeting domains for correcting a mutation (e.g., E6V) in the HBB gene selected according to the first tier parameters. The targeting domains bind within 200 bp to a mutation (e.g., E6V) and have a high level of orthogonality. It is contemplated herein that the targeting domain hybridizes to the target domain through complementary base pairing. Any of the targeting domains in the table can be used with a *S. pyogenes* Cas9 molecule that generates a double strand break (Cas9 nuclease) or a single-strand break (Cas9 nickase).

TABLE 24A

1st Tier

| gRNA Name | DNA Strand | Targeting Domain | Target Site Length | SEQ ID NO: |
|---|---|---|---|---|
| HBB-19 | + | GUUCACCUUGCCCCACA | 17 | 16010 |
| HBB-5 | + | AGGAGUCAGGUGCACCA | 17 | 16011 |

TABLE 24A-continued

1st Tier

| gRNA Name | DNA Strand | Targeting Domain | Target Site Length | SEQ ID NO: |
|---|---|---|---|---|
| HBB-40 | - | UACUGCCCUGUGGGCA | 17 | 16012 |
| HBB-70 | - | GCUGGGCAUAAAAGUCA | 17 | 16013 |
| HBB-71 | - | GUUACAAGACAGGUUUA | 17 | 16014 |
| HBB-72 | - | AGGAGACCAAUAGAAAC | 17 | 16015 |
| HBB-37 | + | CGUUCACCUUGCCCCAC | 17 | 16016 |
| HBB-3 | + | ACGGCAGACUUCUCCAC | 17 | 16017 |
| HBB-41 | - | UAUCAAGGUUACAAGAC | 17 | 16018 |
| HBB-73 | + | ACUUUUAUGCCCAGCCC | 17 | 16019 |
| HBB-74 | - | GGCUGGGCAUAAAAGUC | 17 | 16020 |
| HBB-4 | + | ACUUCUCCACAGGAGUC | 17 | 16021 |
| HBB-75 | - | AAUAGAAACUGGGCAUG | 17 | 16022 |
| HBB-38 | - | CUGCCGUUACUGCCCUG | 17 | 16023 |
| HBB-13 | - | GGAUGAAGUUGGUGGUG | 17 | 16024 |
| HBB-12 | - | GCCGUUACUGCCCUGUG | 17 | 16025 |
| HBB-76 | + | ACAUGCCCAGUUUCUAU | 17 | 16026 |
| HBB-77 | - | GGAGACCAAUAGAAACU | 17 | 16027 |
| HBB-15 | - | GUGAACGUGGAUGAAGU | 17 | 16028 |
| HBB-47 | - | UGCCGUUACUGCCCUGU | 17 | 16029 |
| HBB-39 | + | CUUGCCCACAGGGCAGUAA | 20 | 16030 |
| HBB-30 | + | CACGUUCACCUUGCCCCACA | 20 | 16031 |
| HBB-7 | + | CACAGGAGUCAGGUGCACCA | 20 | 16032 |
| HBB-78 | - | AGCAGGGAGGGCAGGAGCCA | 20 | 16033 |
| HBB-36 | - | CGUUACUGCCCUGUGGGGCA | 20 | 16034 |
| HBB-79 | - | AGGGCUGGGCAUAAAAGUCA | 20 | 16035 |
| HBB-22 | + | AAGCAAAUGUAAGCAAUAGA | 20 | 16036 |
| HBB-80 | - | AAGGUUACAAGACAGGUUUA | 20 | 16037 |
| HBB-81 | - | UUAAGGAGACCAAUAGAAAC | 20 | 16038 |
| HBB-2 | + | GUAACGGCAGACUUCUCCAC | 20 | 16039 |
| HBB-49 | - | UGGUAUCAAGGUUACAAGAC | 20 | 16040 |
| HBB-82 | + | CUGACUUUUAUGCCCAGCCC | 20 | 16041 |
| HBB-43 | - | UGAAGUUGGUGGUGAGGCCC | 20 | 16042 |
| HBB-83 | - | GAGCAGGGAGGGCAGGAGCC | 20 | 16043 |
| HBB-84 | - | CAGGGCUGGGCAUAAAAGUC | 20 | 16044 |
| HBB-8 | + | CAGACUUCUCCACAGGAGUC | 20 | 16045 |
| HBB-16 | - | GUGAACGUGGAUGAAGUUGG | 20 | 16046 |
| HBB-85 | - | ACCAAUAGAAACUGGGCAUG | 20 | 16047 |
| HBB-27 | - | AGUCUGCCGUUACUGCCCUG | 20 | 16048 |
| HBB-35 | - | CGUGGAUGAAGUUGGUGGUG | 20 | 16049 |
| HBB-42 | - | UCUGCCGUUACUGCCCUGUG | 20 | 16050 |
| HBB-86 | - | UAAGGAGACCAAUAGAAACU | 20 | 16051 |
| HBB-9 | - | GAAGUUGGUGGUGAGGCCCU | 20 | 16052 |
| HBB-87 | - | GGAGGGCAGGAGCCAGGGCU | 20 | 16053 |
| HBB-23 | - | AAGGUGAACGUGGAUGAAGU | 20 | 16054 |
| HBB-14 | - | GUCUGCCGUUACUGCCCUGU | 20 | 16055 |

Table 24B provides exemplary targeting domains for correcting a mutation (e.g., E6V) in the HBB gene selected according to the second tier parameters. The targeting domains bind within 200 bp to a mutation (e.g., E6V) and start with a 5'G. It is contemplated herein that the targeting domain hybridizes to the target domain through complementary base pairing. Any of the targeting domains in the table can be used with a S. pyogenes Cas9 molecule that generates a double strand break (Cas9 nuclease) or a single-strand break (Cas9 nickase).

TABLE 24B

2nd Tier

| gRNA Name | DNA Strand | Targeting Domain | Target Site Length | SEQ ID NO: |
|---|---|---|---|---|
| HBB-11 | + | GCCCCACAGGGCAGUAA | 17 | 16056 |
| HBB-18 | - | GUGGUGAGGCCCUGGGC | 17 | 16057 |
| HBB-17 | - | GUGGGGCAAGGUGAACG | 17 | 16058 |
| HBB-1 | - | GGUGCACCUGACUCCUG | 17 | 16059 |
| HBB-20 | - | GUUGGUGGUGAGGCCCU | 17 | 16060 |
| HBB-88 | - | GGGCAGGAGCCAGGGCU | 17 | 16061 |
| HBB-10 | - | GCAACCUCAAACAGACACCA | 20 | 16062 |
| HBB-89 | - | GGGAGGGCAGGAGCCAGGGC | 20 | 16063 |

Table 24C provides exemplary targeting domains for correcting a mutation (e.g., E6V) in the HBB gene selected according to the third tier parameters. The targeting domains bind within 200 bp to a mutation (e.g., E6V). It is contemplated herein that the targeting domain hybridizes to the target domain through complementary base pairing. Any of the targeting domains in the table can be used with a S. pyogenes Cas9 molecule that generates a double strand break (Cas9 nuclease) or a single-strand break (Cas9 nickase).

TABLE 24C

3rd Tier

| gRNA Name | DNA Strand | Targeting Domain | Target Site Length | SEQ ID NO: |
|---|---|---|---|---|
| HBB-25 | - | ACCUCAAACAGACACCA | 17 | 16064 |
| HBB-45 | + | UGAUACCAACCUGCCCA | 17 | 16065 |
| HBB-90 | - | AGGGAGGGCAGGAGCCA | 17 | 16066 |
| HBB-48 | - | UGGGCAGGUUGGUAUCA | 17 | 16067 |
| HBB-29 | + | CAAAUGUAAGCAAUAGA | 17 | 16068 |
| HBB-28 | - | AGUUGGUGGUGAGGCCC | 17 | 16069 |
| HBB-51 | + | UUGAUACCAACCUGCCC | 17 | 16070 |
| HBB-91 | - | CAGGGAGGGCAGGAGCC | 17 | 16071 |
| HBB-92 | - | AGGGCAGGAGCCAGGGC | 17 | 16072 |
| HBB-21 | - | AACGUGGAUGAAGUUGG | 17 | 16073 |
| HBB-24 | + | ACCAUGGUGUCUGUUUG | 17 | 16074 |
| HBB-44 | - | UGAGGCCCUGGGCAGGU | 17 | 16075 |
| HBB-34 | + | CCUUGAUACCAACCUGCCCA | 20 | 16076 |
| HBB-32 | - | CCCUGGGCAGGUUGGUAUCA | 20 | 16077 |
| HBB-31 | + | CCACGUUCACCUUGCCCCAC | 20 | 16078 |
| HBB-26 | + | ACCUUGAUACCAACCUGCCC | 20 | 16079 |
| HBB-52 | - | UUGGUGGUGAGGCCCUGGGC | 20 | 16080 |
| HBB-33 | - | CCUGUGGGGCAAGGUGAACG | 20 | 16081 |
| HBB-6 | - | CAUGGUGCACCUGACUCCUG | 20 | 16082 |
| HBB-46 | + | UGCACCAUGGUGUCUGUUUG | 20 | 16083 |
| HBB-50 | - | UGGUGAGGCCCUGGGCAGGU | 20 | 16084 |

Table 24D provides targeting domains for correcting a mutation (e.g., E6V) in the HBB gene by dual targeting (e.g., dual single strand cleavages). In an embodiment, dual targeting (e.g., dual nicking) is used to create two nicks on opposite DNA strands by using S. pyogenes Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. Exemplary nickase pairs include a targeting domain from Group A and a second targeting domain from Group B in Table 24D (for S. pyogenes). It is contemplated herein that in an embodiment a targeting domain of Group A can be combined with any of the targeting domains of Group B in Table 24D (for S. pyogenes). For example, HBB-9 or HBB-20 can be combined with HBB-11 or HBB-39.

TABLE 24D

| Group A | Group B |
|---|---|
| HBB-9, HBB-20 | HBB-11, HBB-39 |

Table 25A provides exemplary targeting domains for correcting a mutation (e.g., E6V) in the HBB gene selected according to the first tier parameters. The targeting domains bind within 200 bp to a mutation (e.g., E6V), and have a high level of orthogonality. The PAM is NNGRRT. It is contemplated herein that the targeting domain hybridizes to the target domain through complementary base pairing. Any of the targeting domains in the table can be used with a S. pyogenes Cas9 molecule that generates a double strand break (Cas9 nuclease) or a single-strand break (Cas9 nickase).

TABLE 25A

1st Tier

| gRNA Name | DNA Strand | Targeting Domain | Target Site Length | SEQ ID NO: |
|---|---|---|---|---|
| HBB-93 | + | AACGGCAGACUUCUCCAC | 18 | 16085 |
| HBB-94 | + | UAACGGCAGACUUCUCCAC | 19 | 16086 |
| HBB-2 | + | GUAACGGCAGACUUCUCCAC | 20 | 16087 |
| HBB-95 | + | AGUAACGGCAGACUUCUCCAC | 21 | 16088 |
| HBB-96 | + | CAGUAACGGCAGACUUCUCCAC | 22 | 16089 |
| HBB-97 | + | GCAGUAACGGCAGACUUCUCCAC | 23 | 16090 |
| HBB-98 | + | GGCAGUAACGGCAGACUUCUCCAC | 24 | 16091 |
| HBB-99 | - | CUGUGGGGCAAGGUGAAC | 18 | 16092 |
| HBB-100 | - | CCUGUGGGGCAAGGUGAAC | 19 | 16093 |
| HBB-101 | - | CCCUGUGGGGCAAGGUGAAC | 20 | 16094 |
| HBB-102 | - | GCCCUGUGGGGCAAGGUGAAC | 21 | 16095 |
| HBB-103 | - | UGCCCUGUGGGGCAAGGUGAAC | 22 | 16096 |
| HBB-104 | - | CUGCCCUGUGGGGCAAGGUGAAC | 23 | 16097 |
| HBB-105 | - | ACUGCCCUGUGGGGCAAGGUGAAC | 24 | 16098 |

Table 25B provides exemplary targeting domains for correcting a mutation (e.g., E6V) in the HBB gene selected according to the fourth tier parameters. The targeting domains bind within 200 bp to a mutation (e.g., E6V), and the PAM is NNGRRV. It is contemplated herein that the targeting domain hybridizes to the target domain through complementary base pairing. Any of the targeting domains in the table can be used with a S. pyogenes Cas9 molecule that generates a double strand break (Cas9 nuclease) or a single-strand break (Cas9 nickase).

TABLE 25B

| | | 4th Tier | | |
|---|---|---|---|---|
| gRNA Name | DNA Strand | Targeting Domain | Target Site Length | SEQ ID NO: |
| HBB-106 | + | CACGUUCACCUUGCCCCA | 18 | 16099 |
| HBB-107 | + | CCACGUUCACCUUGCCCCA | 19 | 16100 |
| HBB-58 | + | UCCACGUUCACCUUGCCCCA | 20 | 16101 |
| HBB-108 | + | AUCCACGUUCACCUUGCCCCA | 21 | 16102 |
| HBB-109 | + | CAUCCACGUUCACCUUGCCCCA | 22 | 16103 |
| HBB-110 | + | UCAUCCACGUUCACCUUGCCCCA | 23 | 16104 |
| HBB-111 | + | UUCAUCCACGUUCACCUUGCCCCA | 24 | 16105 |
| HBB-112 | + | UAACGGCAGACUUCUCCA | 18 | 16106 |
| HBB-113 | + | GUAACGGCAGACUUCUCCA | 19 | 16107 |
| HBB-69 | + | AGUAACGGCAGACUUCUCCA | 20 | 16108 |
| HBB-114 | + | CAGUAACGGCAGACUUCUCCA | 21 | 16109 |
| HBB-115 | + | GCAGUAACGGCAGACUUCUCCA | 22 | 16110 |
| HBB-116 | + | GGCAGUAACGGCAGACUUCUCCA | 23 | 16111 |
| HBB-117 | + | GGGCAGUAACGGCAGACUUCUCCA | 24 | 16112 |
| HBB-118 | + | GUCUGUUUGAGGUUGCUA | 18 | 16113 |
| HBB-119 | + | UGUCUGUUUGAGGUUGCUA | 19 | 16114 |
| HBB-66 | + | GUGUCUGUUUGAGGUUGCUA | 20 | 16115 |
| HBB-120 | + | GGUGUCUGUUUGAGGUUGCUA | 21 | 16116 |
| HBB-121 | + | UGGUGUCUGUUUGAGGUUGCUA | 22 | 16117 |
| HBB-122 | + | AUGGUGUCUGUUUGAGGUUGCUA | 23 | 16118 |
| HBB-123 | + | CAUGGUGUCUGUUUGAGGUUGCUA | 24 | 16119 |
| HBB-124 | + | CCUUGAUACCAACCUGCC | 18 | 16120 |
| HBB-125 | + | ACCUUGAUACCAACCUGCC | 19 | 16121 |
| HBB-57 | + | AACCUUGAUACCAACCUGCC | 20 | 16122 |
| HBB-126 | + | UAACCUUGAUACCAACCUGCC | 21 | 16123 |
| HBB-127 | + | GUAACCUUGAUACCAACCUGCC | 22 | 16124 |
| HBB-128 | + | UGUAACCUUGAUACCAACCUGCC | 23 | 16125 |
| HBB-129 | + | UUGUAACCUUGAUACCAACCUGCC | 24 | 16126 |
| HBB-130 | + | GUGCACCAUGGUGUCUGU | 18 | 16127 |
| HBB-131 | + | GGUGCACCAUGGUGUCUGU | 19 | 16128 |
| HBB-62 | + | AGGUGCACCAUGGUGUCUGU | 20 | 16129 |
| HBB-132 | + | CAGGUGCACCAUGGUGUCUGU | 21 | 16130 |
| HBB-133 | + | UCAGGUGCACCAUGGUGUCUGU | 22 | 16131 |
| HBB-134 | + | GUCAGGUGCACCAUGGUGUCUGU | 23 | 16132 |
| HBB-135 | + | AGUCAGGUGCACCAUGGUGUCUGU | 24 | 16133 |
| HBB-136 | + | UAGUGAACACAGUUGUGU | 18 | 16134 |
| HBB-137 | + | CUAGUGAACACAGUUGUGU | 19 | 16135 |
| HBB-59 | + | GCUAGUGAACACAGUUGUGU | 20 | 16136 |

TABLE 25B-continued

4th Tier

| gRNA Name | DNA Strand | Targeting Domain | Target Site Length | SEQ ID NO: |
|---|---|---|---|---|
| HBB-138 | + | UGCUAGUGAACACAGUUGUGU | 21 | 16137 |
| HBB-139 | + | UUGCUAGUGAACACAGUUGUGU | 22 | 16138 |
| HBB-140 | + | GUUGCUAGUGAACACAGUUGUGU | 23 | 16139 |
| HBB-141 | + | GGUUGCUAGUGAACACAGUUGUGU | 24 | 16140 |
| HBB-142 | - | UAAGGAGACCAAUAGAAA | 18 | 16141 |
| HBB-143 | - | UUAAGGAGACCAAUAGAAA | 19 | 16142 |
| HBB-144 | - | UUUAAGGAGACCAAUAGAAA | 20 | 16143 |
| HBB-145 | - | GUUUAAGGAGACCAAUAGAAA | 21 | 16144 |
| HBB-146 | - | GGUUUAAGGAGACCAAUAGAAA | 22 | 16145 |
| HBB-147 | - | AGGUUUAAGGAGACCAAUAGAAA | 23 | 16146 |
| HBB-148 | - | CAGGUUUAAGGAGACCAAUAGAAA | 24 | 16147 |
| HBB-149 | - | CAGGUUUAAGGAGACCAA | 18 | 16148 |
| HBB-150 | - | ACAGGUUUAAGGAGACCAA | 19 | 16149 |
| HBB-151 | - | GACAGGUUUAAGGAGACCAA | 20 | 16150 |
| HBB-152 | - | AGACAGGUUUAAGGAGACCAA | 21 | 16151 |
| HBB-153 | - | AAGACAGGUUUAAGGAGACCAA | 22 | 16152 |
| HBB-154 | - | CAAGACAGGUUUAAGGAGACCAA | 23 | 16153 |
| HBB-155 | - | ACAAGACAGGUUUAAGGAGACCAA | 24 | 16154 |
| HBB-156 | - | GGUUACAAGACAGGUUUA | 18 | 16155 |
| HBB-157 | - | AGGUUACAAGACAGGUUUA | 19 | 16156 |
| HBB-80 | - | AAGGUUACAAGACAGGUUUA | 20 | 16157 |
| HBB-158 | - | CAAGGUUACAAGACAGGUUUA | 21 | 16158 |
| HBB-159 | - | UCAAGGUUACAAGACAGGUUUA | 22 | 16159 |
| HBB-160 | - | AUCAAGGUUACAAGACAGGUUUA | 23 | 16160 |
| HBB-161 | - | UAUCAAGGUUACAAGACAGGUUUA | 24 | 16161 |
| HBB-162 | - | GAAGUUGGUGGUGAGGCC | 18 | 16162 |
| HBB-163 | - | UGAAGUUGGUGGUGAGGCC | 19 | 16163 |
| HBB-68 | - | AUGAAGUUGGUGGUGAGGCC | 20 | 16164 |
| HBB-164 | - | GAUGAAGUUGGUGGUGAGGCC | 21 | 16165 |
| HBB-165 | - | GGAUGAAGUUGGUGGUGAGGCC | 22 | 16166 |
| HBB-166 | - | UGGAUGAAGUUGGUGGUGAGGCC | 23 | 16167 |
| HBB-167 | - | GUGGAUGAAGUUGGUGGUGAGGCC | 24 | 16168 |
| HBB-168 | - | ACUGCCCUGUGGGGCAAG | 18 | 16169 |
| HBB-169 | - | UACUGCCCUGUGGGGCAAG | 19 | 16170 |
| HBB-65 | - | UUACUGCCCUGUGGGGCAAG | 20 | 16171 |
| HBB-170 | - | GUUACUGCCCUGUGGGGCAAG | 21 | 16172 |
| HBB-171 | - | CGUUACUGCCCUGUGGGGCAAG | 22 | 16173 |

TABLE 25B-continued

| 4th Tier | | | | |
|---|---|---|---|---|
| gRNA Name | DNA Strand | Targeting Domain | Target Site Length | SEQ ID NO: |
| HBB-172 | − | CCGUUACUGCCCUGUGGGGCAAG | 23 | 16174 |
| HBB-173 | − | GCCGUUACUGCCCUGUGGGGCAAG | 24 | 16175 |
| HBB-174 | − | GGAGGGCAGGAGCCAGGG | 18 | 16176 |
| HBB-175 | − | GGGAGGGCAGGAGCCAGGG | 19 | 16177 |
| HBB-176 | − | AGGGAGGGCAGGAGCCAGGG | 20 | 16178 |
| HBB-177 | − | CAGGGAGGGCAGGAGCCAGGG | 21 | 16179 |
| HBB-178 | − | GCAGGGAGGGCAGGAGCCAGGG | 22 | 16180 |
| HBB-179 | − | AGCAGGGAGGGCAGGAGCCAGGG | 23 | 16181 |
| HBB-180 | − | GAGCAGGGAGGGCAGGAGCCAGGG | 24 | 16182 |
| HBB-181 | − | UGGGCAUAAAAGUCAGGG | 18 | 16183 |
| HBB-182 | − | CUGGGCAUAAAAGUCAGGG | 19 | 16184 |
| HBB-183 | − | GCUGGGCAUAAAAGUCAGGG | 20 | 16185 |
| HBB-184 | − | GGCUGGGCAUAAAAGUCAGGG | 21 | 16186 |
| HBB-185 | − | GGGCUGGGCAUAAAAGUCAGGG | 22 | 16187 |
| HBB-186 | − | AGGGCUGGGCAUAAAAGUCAGGG | 23 | 16188 |
| HBB-187 | − | CAGGGCUGGGCAUAAAAGUCAGGG | 24 | 16189 |
| HBB-188 | − | GGGGCAAGGUGAACGUGG | 18 | 16190 |
| HBB-189 | − | UGGGGCAAGGUGAACGUGG | 19 | 16191 |
| HBB-67 | − | GUGGGGCAAGGUGAACGUGG | 20 | 16192 |
| HBB-190 | − | UGUGGGGCAAGGUGAACGUGG | 21 | 16193 |
| HBB-191 | − | CUGUGGGGCAAGGUGAACGUGG | 22 | 16194 |
| HBB-192 | − | CCUGUGGGGCAAGGUGAACGUGG | 23 | 16195 |
| HBB-193 | − | CCCUGUGGGGCAAGGUGAACGUGG | 24 | 16196 |
| HBB-194 | − | UCUGCCGUUACUGCCCUG | 18 | 16197 |
| HBB-195 | − | GUCUGCCGUUACUGCCCUG | 19 | 16198 |
| HBB-27 | − | AGUCUGCCGUUACUGCCCUG | 20 | 16199 |
| HBB-196 | − | AAGUCUGCCGUUACUGCCCUG | 21 | 16200 |
| HBB-197 | − | GAAGUCUGCCGUUACUGCCCUG | 22 | 16201 |
| HBB-198 | − | AGAAGUCUGCCGUUACUGCCCUG | 23 | 16202 |
| HBB-199 | − | GAGAAGUCUGCCGUUACUGCCCUG | 24 | 16203 |
| HBB-200 | − | UGGUGCACCUGACUCCUG | 18 | 16204 |
| HBB-201 | − | AUGGUGCACCUGACUCCUG | 19 | 16205 |
| HBB-6 | − | CAUGGUGCACCUGACUCCUG | 20 | 16206 |
| HBB-202 | − | CCAUGGUGCACCUGACUCCUG | 21 | 16207 |
| HBB-203 | − | ACCAUGGUGCACCUGACUCCUG | 22 | 16208 |
| HBB-204 | − | CACCAUGGUGCACCUGACUCCUG | 23 | 16209 |
| HBB-205 | − | ACACCAUGGUGCACCUGACUCCUG | 24 | 16210 |
| HBB-206 | − | ACGUGGAUGAAGUUGGUG | 18 | 16211 |

TABLE 25B-continued

| | 4th Tier | | |
|---|---|---|---|
| gRNA Name | DNA Strand Targeting Domain | Target Site Length | SEQ ID NO: |
| HBB-207 | - AACGUGGAUGAAGUUGGUG | 19 | 16212 |
| HBB-64 | - GAACGUGGAUGAAGUUGGUG | 20 | 16213 |
| HBB-208 | - UGAACGUGGAUGAAGUUGGUG | 21 | 16214 |
| HBB-209 | - GUGAACGUGGAUGAAGUUGGUG | 22 | 16215 |
| HBB-210 | - GGUGAACGUGGAUGAAGUUGGUG | 23 | 16216 |
| HBB-211 | - AGGUGAACGUGGAUGAAGUUGGUG | 24 | 16217 |
| HBB-212 | - GUGCACCUGACUCCUGUG | 18 | 16218 |
| HBB-213 | - GGUGCACCUGACUCCUGUG | 19 | 16219 |
| HBB-63 | - UGGUGCACCUGACUCCUGUG | 20 | 16220 |
| HBB-214 | - AUGGUGCACCUGACUCCUGUG | 21 | 16221 |
| HBB-215 | - CAUGGUGCACCUGACUCCUGUG | 22 | 16222 |
| HBB-216 | - CCAUGGUGCACCUGACUCCUGUG | 23 | 16223 |
| HBB-217 | - ACCAUGGUGCACCUGACUCCUGUG | 24 | 16224 |
| HBB-218 | - GUCUGCCGUUACUGCCCU | 18 | 16225 |
| HBB-219 | - AGUCUGCCGUUACUGCCCU | 19 | 16226 |
| HBB-56 | - AAGUCUGCCGUUACUGCCCU | 20 | 16227 |
| HBB-220 | - GAAGUCUGCCGUUACUGCCCU | 21 | 16228 |
| HBB-221 | - AGAAGUCUGCCGUUACUGCCCU | 22 | 16229 |
| HBB-222 | - GAGAAGUCUGCCGUUACUGCCCU | 23 | 16230 |
| HBB-223 | - GGAGAAGUCUGCCGUUACUGCCCU | 24 | 16231 |
| HBB-224 | - AUGGUGCACCUGACUCCU | 18 | 16232 |
| HBB-225 | - CAUGGUGCACCUGACUCCU | 19 | 16233 |
| HBB-60 | - CCAUGGUGCACCUGACUCCU | 20 | 16234 |
| HBB-226 | - ACCAUGGUGCACCUGACUCCU | 21 | 16235 |
| HBB-227 | - CACCAUGGUGCACCUGACUCCU | 22 | 16236 |
| HBB-228 | - ACACCAUGGUGCACCUGACUCCU | 23 | 16237 |
| HBB-229 | - GACACCAUGGUGCACCUGACUCCU | 24 | 16238 |
| HBB-230 | - AGGGCUGGGCAUAAAAGU | 18 | 16239 |
| HBB-231 | - CAGGGCUGGGCAUAAAAGU | 19 | 16240 |
| HBB-232 | - CCAGGGCUGGGCAUAAAAGU | 20 | 16241 |
| HBB-233 | - GCCAGGGCUGGGCAUAAAAGU | 21 | 16242 |
| HBB-234 | - AGCCAGGGCUGGGCAUAAAAGU | 22 | 16243 |
| HBB-235 | - GAGCCAGGGCUGGGCAUAAAAGU | 23 | 16244 |
| HBB-236 | - GGAGCCAGGGCUGGGCAUAAAAGU | 24 | 16245 |
| HBB-237 | - AGGUUACAAGACAGGUUU | 18 | 16246 |
| HBB-238 | - AAGGUUACAAGACAGGUUU | 19 | 16247 |
| HBB-239 | - CAAGGUUACAAGACAGGUUU | 20 | 16248 |

TABLE 25B-continued

4th Tier

| gRNA Name | DNA Strand | Targeting Domain | Target Site Length | SEQ ID NO: |
|---|---|---|---|---|
| HBB-240 | − | UCAAGGUUACAAGACAGGUUU | 21 | 16249 |
| HBB-241 | − | AUCAAGGUUACAAGACAGGUUU | 22 | 16250 |
| HBB-242 | − | UAUCAAGGUUACAAGACAGGUUU | 23 | 16251 |
| HBB-243 | − | GUAUCAAGGUUACAAGACAGGUUU | 24 | 16252 |

Table 26 provides exemplary targeting domains for correcting a mutation (e.g., E6V) in the HBB gene selected according to the first tier parameters. The targeting domains bind within 200 bp to a mutation (e.g., E6V) and have a high level of orthogonality. It is contemplated herein that the targeting domain hybridizes to the target domain through complementary base pairing. Any of the targeting domains in the table can be used with a *N. meningitidis* Cas9 molecule that generates a double strand break (Cas9 nuclease) or a single-strand break (Cas9 nickase).

TABLE 26

1st Tier

| gRNA Name | DNA Strand | Targeting Domain | Target Site Length | SEQ ID NO: |
|---|---|---|---|---|
| HBB-244 | − | AGCCAUCUAUUGCUUAC | 17 | 16253 |
| HBB-245 | − | GUCAGGGCAGAGCCAUC | 17 | 16254 |
| HBB-246 | − | CAGAGCCAUCUAUUGCUUAC | 20 | 16255 |
| HBB-247 | − | AAAGUCAGGGCAGAGCCAUC | 20 | 16256 |

III. Cas9 Molecules

Cas9 molecules of a variety of species can be used in the methods and compositions described herein. While the *S. pyogenes*, *S. aureus*, and *S. thermophilus* Cas9 molecules are the subject of much of the disclosure herein, Cas9 molecules of, derived from, or based on the Cas9 proteins of other species listed herein can be used as well. In other words, while the much of the description herein uses *S. pyogenes* and *S. thermophilus* Cas9 molecules, Cas9 molecules from the other species can replace them, e.g., *Staphylococcus aureus* and *Neisseria meningitidis* Cas9 molecules. Additional Cas9 species include: *Acidovorax avenue, Actinobacillus pleuropneumoniae, Actinobacillus succinogenes, Actinobacillus suis, Actinomyces sp., Cycliphilus denitrificans, Aminomonas paucivorans, Bacillus cereus, Bacillus smithii, Bacillus thuringiensis, Bacteroides sp., Blastopirellula marina, Bradyrhizobium sp., Brevibacillus laterosporus, Campylobacter coli, Campylobacter jejuni, Campylobacter lari, Candidatus puniceispirillum, Clostridium cellulolyticum, Clostridium perfringens, Corynebacterium accolens, Corynebacterium diphtheria, Corynebacterium matruchotii, Dinoroseobacter shibae, Eubacterium dolichum, Gamma proteobacterium, Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis sp., Methylosinus trichosporium, Mobiluncus mulieris, Neisseria bacilliformis, Neisseria cinerea, Neisseria flavescens, Neisseria lactamica, Neisseria sp., Neisseria wadsworthii, Nitrosomonas sp., Parvibaculum lavamentivorans, Pasteurella multocida, Phascolarciobacterium succinatutens, Ralstonia syzygii, Rhodopseudomonas palustris, Rhodovulum sp., Simonsiella muelleri, Sphingomonas sp., Sporolactobacillus vineae, Staphylococcus lugdunensis, Streptococcus sp., Subdoligranulum sp., Tistrella mobilis, Treponema sp.,* or *Verminephrobacter eiseniae.*

A Cas9 molecule, or Cas9 polypeptide, as that term is used herein, refers to a molecule or a polypeptide that can interact with a guide RNA (gRNA) molecule and, in concert with the gRNA molecule, localizes to a site which comprises a target domain, and in an embodiment, a PAM sequence. Cas9 molecule and Cas9 polypeptide, as those terms are used herein, refer to naturally occurring Cas9 molecules and to engineered, altered, or modified Cas9 molecules or Cas9 polypeptides that differ, e.g., by at least one amino acid residue, from a reference sequence, e.g., the most similar naturally occurring Cas9 molecule or a sequence of Table 28.

Cas9 Domains

Crystal structures have been determined for two different naturally occurring bacterial Cas9 molecules (Jinek et al., Science, 343(6176):1247997, 2014) and for *S. pyogenes* Cas9 with a guide RNA (e.g., a synthetic fusion of crRNA and tracrRNA) (Nishimasu et al., Cell, 156:935-949, 2014; and Anders et al., Nature, 2014, doi: 10.1038/nature13579).

Figures 9A, 9B:
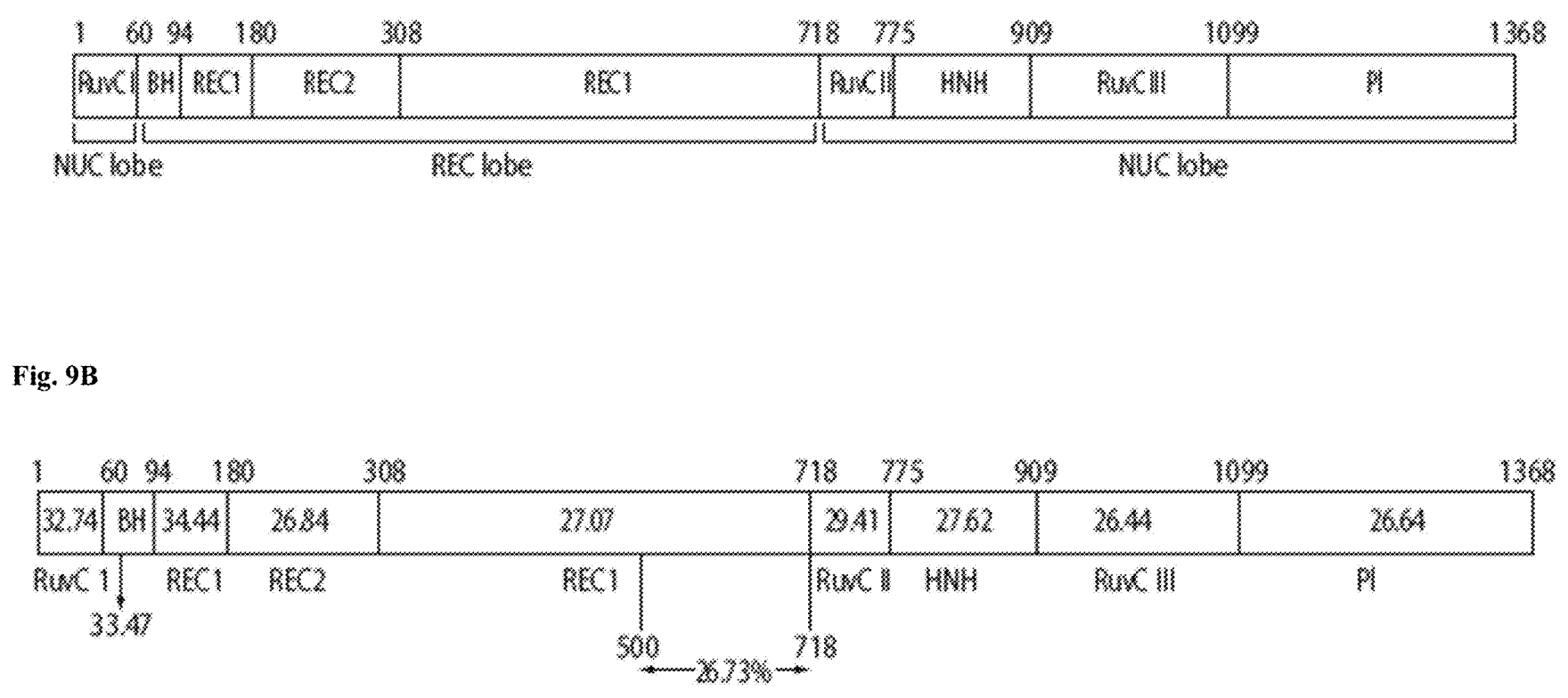

A naturally occurring Cas9 molecule comprises two lobes: a recognition (REC) lobe and a nuclease (NUC) lobe; each of which further comprise domains described herein. FIGS. 9A-9B provide a schematic of the organization of important Cas9 domains in the primary structure. The domain nomenclature and the numbering of the amino acid residues encompassed by each domain used throughout this disclosure is as described in Nishimasu et al. The numbering of the amino acid residues is with reference to Cas9 from *S. pyogenes.*

The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long α helix and arginine rich region and comprises amino acids 60-93 of the sequence of *S. pyogenes* Cas9. The REC1 domain is important for recognition of the repeat:anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of *S. pyogenes* Cas9. These two REC1 domains, though separated by the REC2 domain in the linear primary structure, assemble in the tertiary structure to form the REC1 domain. The REC2 domain, or parts thereof, may also play a role in the recognition of the repeat:anti-repeat duplex. The REC2 domain comprises amino acids 180-307 of the sequence of S. pyogenes Cas9.

The NUC lobe comprises the RuvC domain, the HNH domain, and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of S. pyogenes Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases, and cleaves a single strand, e.g., the complementary strand of the target nucleic acid molecule. The HNH domain lies between the RuvC II-III motifs and comprises amino acids 775-908 of the sequence of S. pyogenes Cas9. The PI domain interacts with the PAM of the target nucleic acid molecule, and comprises amino acids 1099-1368 of the sequence of S. pyogenes Cas9.

A RuvC-Like Domain and an HNH-Like Domain

In an embodiment, a Cas9 molecule or Cas9 polypeptide comprises an HNH-like domain and a RuvC-like domain. In an embodiment, cleavage activity is dependent on a RuvC-like domain and an HNH-like domain. A Cas9 molecule or Cas9 polypeptide, e.g., an eaCas9 molecule or eaCas9 polypeptide, can comprise one or more of the following domains: a RuvC-like domain and an HNH-like domain. In an embodiment, a Cas9 molecule or Cas9 polypeptide is an eaCas9 molecule or eaCas9 polypeptide and the eaCas9 molecule or eaCas9 polypeptide comprises a RuvC-like domain, e.g., a RuvC-like domain described below, and/or an HNH-like domain, e.g., an HNH-like domain described below.

RuvC-Like Domains

In an embodiment, a RuvC-like domain cleaves, a single strand, e.g., the non-complementary strand of the target nucleic acid molecule. The Cas9 molecule or Cas9 polypeptide can include more than one RuvC-like domain (e.g., one, two, three or more RuvC-like domains). In an embodiment, a RuvC-like domain is at least 5, 6, 7, 8 amino acids in length but not more than 20, 19, 18, 17, 16 or 15 amino acids in length. In an embodiment, the Cas9 molecule or Cas9 polypeptide comprises an N-terminal RuvC-like domain of about 10 to 20 amino acids, e.g., about 15 amino acids in length.

N-Terminal RuvC-Like Domains

Some naturally occurring Cas9 molecules comprise more than one RuvC-like domain with cleavage being dependent on the N-terminal RuvC-like domain. Accordingly, Cas9 molecules or Cas9 polypeptide can comprise an N-terminal RuvC-like domain. Exemplary N-terminal RuvC-like domains are described below.

In an embodiment, an eaCas9 molecule or eaCas9 polypeptide comprises an N-terminal RuvC-like domain comprising an amino acid sequence of formula I:

D-X1-G-X2-X3-X4-X5-G-X6-X7-X8-X9        (SEQ ID NO: 8), wherein,

X1 is selected from I, V, M, L and T (e.g., selected from I, V, and L);

X2 is selected from T, I, V, S, N, Y, E and L (e.g., selected from T, V, and I);

X3 is selected from N, S, G, A, D, T, R, M and F (e.g., A or N);

X4 is selected from S, Y, N and F (e.g., S);

X5 is selected from V, I, L, C, T and F (e.g., selected from V, I and L);

X6 is selected from W, F, V, Y, S and L (e.g., W);

X7 is selected from A, S, C, V and G (e.g., selected from A and S);

X8 is selected from V, I, L, A, M and H (e.g., selected from V, I, M and L); and X9 is selected from any amino acid or is absent (e.g., selected from T, V, I, L, Δ, F, S, A, Y, M and R, or, e.g., selected from T, V, I, L and Δ).

In an embodiment, the N-terminal RuvC-like domain differs from a sequence of SEQ ID NO:8, by as many as 1 but no more than 2, 3, 4, or 5 residues.

In embodiment, the N-terminal RuvC-like domain is cleavage competent.

In embodiment, the N-terminal RuvC-like domain is cleavage incompetent.

In an embodiment, a eaCas9 molecule or eaCas9 polypeptide comprises an N-terminal RuvC-like domain comprising an amino acid sequence of formula II:

D-X1-G-X2-X3-S-X5-G-X6-X7-X8-X9,        (SEQ ID NO: 9), wherein

X1 is selected from I, V, M, L and T (e.g., selected from I, V, and L);

X2 is selected from T, I, V, S, N, Y, E and L (e.g., selected from T, V, and I);

X3 is selected from N, S, G, A, D, T, R, M and F (e.g., A or N);

X5 is selected from V, I, L, C, T and F (e.g., selected from V, I and L);

X6 is selected from W, F, V, Y, S and L (e.g., W);

X7 is selected from A, S, C, V and G (e.g., selected from A and S);

X8 is selected from V, I, L, A, M and H (e.g., selected from V, I, M and L); and X9 is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO:9 by as many as 1 but no more than 2, 3, 4, or 5 residues.

In an embodiment, the N-terminal RuvC-like domain comprises an amino acid sequence of formula III:

D-I-G-X2-X3-S-V-G-W-A-X8-X9        (SEQ ID NO: 10), wherein

X2 is selected from T, I, V, S, N, Y, E and L (e.g., selected from T, V, and I);

X3 is selected from N, S, G, A, D, T, R, M and F (e.g., A or N);

X8 is selected from V, I, L, A, M and H (e.g., selected from V, I, M and L); and X9 is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO:10 by as many as 1 but no more than, 2, 3, 4, or 5 residues.

In an embodiment, the N-terminal RuvC-like domain comprises an amino acid sequence of formula III:

D-I-G-T-N-S-V-G-W-A-V-X, (SEQ ID NO: 11)

wherein

X is a non-polar alkyl amino acid or a hydroxyl amino acid, e.g., X is selected from V, I, L and T (e.g., the eaCas9 molecule can comprise an N-terminal RuvC-like domain shown in FIGS. 2A-2G (is depicted as Y)).

In an embodiment, the N-terminal RuvC-like domain differs from a sequence of SEQ ID NO:11 by as many as 1 but no more than, 2, 3, 4, or 5 residues.

In an embodiment, the N-terminal RuvC-like domain differs from a sequence of an N-terminal RuvC like domain disclosed herein, e.g., in FIGS. 3A-3B or FIGS. 7A-7B, as many as 1 but no more than 2, 3, 4, or 5 residues. In an embodiment, 1, 2, 3 or all of the highly conserved residues identified in FIGS. 3A-3B or FIGS. 7A-7B are present.

In an embodiment, the N-terminal RuvC-like domain differs from a sequence of an N-terminal RuvC-like domain disclosed herein, e.g., in FIGS. 4A-4B or FIGS. 7A-7B, as many as 1 but no more than 2, 3, 4, or 5 residues. In an embodiment, 1, 2, or all of the highly conserved residues identified in FIGS. 4A-4B or FIGS. 7A-7B are present.

Additional RuvC-Like Domains

In addition to the N-terminal RuvC-like domain, the Cas9 molecule or Cas9 polypeptide, e.g., an eaCas9 molecule or eaCas9 polypeptide, can comprise one or more additional RuvC-like domains. In an embodiment, the Cas9 molecule or Cas9 polypeptide can comprise two additional RuvC-like domains. Preferably, the additional RuvC-like domain is at least 5 amino acids in length and, e.g., less than 15 amino acids in length, e.g., 5 to 10 amino acids in length, e.g., 8 amino acids in length.

An additional RuvC-like domain can comprise an amino acid sequence:

I-X1-X2-E-X3-A-R-E (SEQ ID NO:12), wherein

X1 is V or H,
X2 is I, L or V (e.g., I or V); and
X3 is M or T.

In an embodiment, the additional RuvC-like domain comprises the amino acid sequence:

I-V-X2-E-M-A-R-E (SEQ ID NO:13), wherein

X2 is I, L or V (e.g., I or V) (e.g., the eaCas9 molecule or eaCas9 polypeptide can comprise an additional RuvC-like domain shown in FIG. 2A-2G or FIGS. 7A-7B (depicted as B)).

An additional RuvC-like domain can comprise an amino acid sequence:

H-H-A-X1-D-A-X2-X3 (SEQ ID NO: 14), wherein

X1 is H or L;
X2 is R or V; and
X3 is E or V.

In an embodiment, the additional RuvC-like domain comprises the amino acid sequence:

H-H-A-H-D-A-Y-L (SEQ ID NO:15).

In an embodiment, the additional RuvC-like domain differs from a sequence of SEQ ID NO: 12, 13, 14 or 15 by as many as 1 but no more than 2, 3, 4, or 5 residues.

In some embodiments, the sequence flanking the N-terminal RuvC-like domain is a sequences of formula V:

K-X1'-Y-X2'-X3'-X4'-Z-T-D-X9'-Y, (SEQ ID NO: 16).

wherein

X1' is selected from K and P,
X2' is selected from V, L, I, and F (e.g., V, I and L);
X3' is selected from G, A and S (e.g., G),
X4' is selected from L, I, V and F (e.g., L);
X9' is selected from D, E, N and Q; and
Z is an N-terminal RuvC-like domain, e.g., as described above.

HNH-Like Domains

In an embodiment, an HNH-like domain cleaves a single stranded complementary domain, e.g., a complementary strand of a double stranded nucleic acid molecule. In an embodiment, an HNH-like domain is at least 15, 20, 25 amino acids in length but not more than 40, 35 or 30 amino acids in length, e.g., 20 to 35 amino acids in length, e.g., 25 to 30 amino acids in length. Exemplary HNH-like domains are described below.

In an embodiment, an eaCas9 molecule or eaCas9 polypeptide comprises an HNH-like domain having an amino acid sequence of formula VI:

X1-X2-X3-H-X4-X5-P-X6-X7-X8-X9-X10-X11-X12-X13-X14-X15-N-X16-X17-X18-X19-X20-X21-X22-X23-N (SEQ ID NO: 17), wherein X1 is selected from D, E, Q and N (e.g., D and E);
X2 is selected from L, I, R, Q, V, M and K;
X3 is selected from D and E;
X4 is selected from I, V, T, A and L (e.g., A, I and V);
X5 is selected from V, Y, I, L, F and W (e.g., V, I and L);
X6 is selected from Q, H, R, K, Y, I, L, F and W;
X7 is selected from S, A, D, T and K (e.g., S and A);
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X11 is selected from D, S, N, R, L and T (e.g., D);
X12 is selected from D, N and S;
X13 is selected from S, A, T, G and R (e.g., S);
X14 is selected from I, L, F, S, R, Y, Q, W, D, K and H (e.g., I, L and F);
X15 is selected from D, S, I, N, E, A, H, F, L, Q, M, G, Y and V;
X16 is selected from K, L, R, M, T and F (e.g., L, R and K);
X17 is selected from V, L, I, A and T;
X18 is selected from L, I, V and A (e.g., L and I);
X19 is selected from T, V, C, E, S and A (e.g., T and V);
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, a HNH-like domain differs from a sequence of SEQ ID NO: 17 by at least one but no more than, 2, 3, 4, or 5 residues.

In an embodiment, the HNH-like domain is cleavage competent.

In an embodiment, the HNH-like domain is cleavage incompetent.

In an embodiment, an eaCas9 molecule or eaCas9 polypeptide comprises an HNH-like domain comprising an amino acid sequence of formula VII:

X1-X2-X3-H-X4-X5-P-X6-S-X8-X9-X10-D-D-S-X14-X15-N-K-V-L-X19-X20-X21-X22-X23-N (SEQ ID NO: 18), wherein
X1 is selected from D and E;
X2 is selected from L, I, R, Q, V, M and K;
X3 is selected from D and E;
X4 is selected from I, V, T, A and L (e.g., A, I and V);
X5 is selected from V, Y, I, L, F and W (e.g., V, I and L);
X6 is selected from Q, H, R, K, Y, I, L, F and W;
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X14 is selected from I, L, F, S, R, Y, Q, W, D, K and H (e.g., I, L and F);
X15 is selected from D, S, I, N, E, A, H, F, L, Q, M, G, Y and V;
X19 is selected from T, V, C, E, S and A (e.g., T and V);
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, the HNH-like domain differs from a sequence of SEQ ID NO: 18 by 1, 2, 3, 4, or 5 residues.

In an embodiment, an eaCas9 molecule or eaCas9 polypeptide comprises an HNH-like domain comprising an amino acid sequence of formula VII:

X1-V-X3-H-I-V-P-X6-S-X8-X9-X10-D-D-S-X14-X15-N-K-V-L-T-X20-X21-X22-X23-N (SEQ ID NO:19), wherein
X1 is selected from D and E;
X3 is selected from D and E;
X6 is selected from Q, H, R, K, Y, I, L and W;
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X14 is selected from I, L, F, S, R, Y, Q, W, D, K and H (e.g., I, L and F);
X15 is selected from D, S, I, N, E, A, H, F, L, Q, M, G, Y and V;
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, the HNH-like domain differs from a sequence of SEQ ID NO: 19 by 1, 2, 3, 4, or 5 residues.

In an embodiment, an eaCas9 molecule or eaCas9 polypeptide comprises an HNH-like domain having an amino acid sequence of formula VIII:

D-X2-D-H-I-X5-P-Q-X7-F-X9-X10-D-X12-S-I-D-N-X16-V-L-X19-X20-S-X22-X23-N (SEQ ID NO:20), wherein
X2 is selected from I and V;
X5 is selected from I and V;
X7 is selected from A and S;
X9 is selected from I and L;
X10 is selected from K and T;
X12 is selected from D and N;
X16 is selected from R, K and L; X19 is selected from T and V;
X20 is selected from S and R;
X22 is selected from K, D and A; and
X23 is selected from E, K, G and N (e.g., the eaCas9 molecule or eaCas9 polypeptide can comprise an HNH-like domain as described herein).

In an embodiment, the HNH-like domain differs from a sequence of SEQ ID NO: 20 by as many as 1 but no more than 2, 3, 4, or 5 residues.

In an embodiment, an eaCas9 molecule or eaCas9 polypeptide comprises the amino acid sequence of formula IX:

L-Y-Y-L-Q-N-G-X1'-D-M-Y-X2'-X3'-X4'-X5'-L-D-I-X6'-X7'-L-S-X8'-Y-Z-N-R-X9'-K-X10'-D-X11'-V-P (SEQ ID NO: 21), wherein
X1' is selected from K and R;
X2' is selected from V and T;
X3' is selected from G and D;
X4' is selected from E, Q and D;
X5' is selected from E and D;
X6' is selected from D, N and H;
X7' is selected from Y, R and N;
X8' is selected from Q, D and N; X9' is selected from G and E;
X10' is selected from S and G;
X11' is selected from D and N; and
Z is an HNH-like domain, e.g., as described above.

In an embodiment, the eaCas9 molecule or eaCas9 polypeptide comprises an amino acid sequence that differs from a sequence of SEQ ID NO:21 by as many as 1 but no more than 2, 3, 4, or 5 residues.

In an embodiment, the HNH-like domain differs from a sequence of an HNH-like domain disclosed herein, e.g., in FIGS. 5A-5C or FIGS. 7A-7B, as many as 1 but no more than 2, 3, 4, or 5 residues. In an embodiment, 1 or both of the highly conserved residues identified in FIGS. 5A-5C or FIGS. 7A-7B are present.

In an embodiment, the HNH-like domain differs from a sequence of an HNH-like domain disclosed herein, e.g., in FIGS. 6A-6B or FIGS. 7A-7B, as many as 1 but no more than 2, 3, 4, or 5 residues. In an embodiment, 1, 2, all 3 of the highly conserved residues identified in FIGS. 6A-6B or FIGS. 7A-7B are present.

Cas9 Activities

Nuclease and Helicase Activities

In an embodiment, the Cas9 molecule or Cas9 polypeptide is capable of cleaving a target nucleic acid molecule. Typically wild type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 polypeptide which is a nickase, or which lacks the ability to cleave target nucleic acid. A Cas9 molecule or Cas9 polypeptide that is capable of cleaving a target nucleic acid molecule is referred to herein as an eaCas9 (an enzymatically active Cas9) molecule or eaCas9 polypeptide.

In an embodiment, an eaCas9 molecule or eaCas9 polypeptide comprises one or more of the following enzymatic activities:

a nickase activity, i.e., the ability to cleave a single strand, e.g., the non-complementary strand or the complementary strand, of a nucleic acid molecule;

a double stranded nuclease activity, i.e., the ability to cleave both strands of a double stranded nucleic acid and create a double stranded break, which in an embodiment is the presence of two nickase activities;

an endonuclease activity;

an exonuclease activity; and a helicase activity, i.e., the ability to unwind the helical structure of a double stranded nucleic acid.

In an embodiment, an enzymatically active or an eaCas9 molecule or eaCas9 polypeptide cleaves both DNA strands and results in a double stranded break. In an embodiment, an eaCas9 molecule or eaCas9 polypeptide cleaves only one strand, e.g., the strand to which the gRNA hybridizes to, or the strand complementary to the strand the gRNA hybridizes with. In an embodiment, an eaCas9 molecule or eaCas9 polypeptide comprises cleavage activity associated with an HNH domain. In an embodiment, an eaCas9 molecule or eaCas9 polypeptide comprises cleavage activity associated with a RuvC domain. In an embodiment, an eaCas9 molecule or eaCas9 polypeptide comprises cleavage activity associated with an HNH domain and cleavage activity associated with a RuvC domain. In an embodiment, an eaCas9 molecule or eaCas9 polypeptide comprises an active, or cleavage competent, HNH domain and an inactive, or cleavage incompetent, RuvC domain. In an embodiment, an eaCas9 molecule or eaCas9 polypeptide comprises an inactive, or cleavage incompetent, HNH domain and an active, or cleavage competent, RuvC domain.

Some Cas9 molecules or Cas9 polypeptides have the ability to interact with a gRNA molecule, and in conjunction with the gRNA molecule localize to a core target domain, but are incapable of cleaving the target nucleic acid, or incapable of cleaving at efficient rates. Cas9 molecules having no, or no substantial, cleavage activity are referred to herein as an eiCas9 molecule or eiCas9 polypeptide. For example, an eiCas9 molecule or eiCas9 polypeptide can lack cleavage activity or have substantially less, e.g., less than 20, 10, 5, 1 or 0.1% of the cleavage activity of a reference Cas9 molecule or eiCas9 polypeptide, as measured by an assay described herein.

Targeting and PAMs

A Cas9 molecule or Cas9 polypeptide, is a polypeptide that can interact with a guide RNA (gRNA) molecule and, in concert with the gRNA molecule, localizes to a site which comprises a target domain, and in an embodiment, a PAM sequence.

In an embodiment, the ability of an eaCas9 molecule or eaCas9 polypeptide to interact with and cleave a target nucleic acid is PAM sequence dependent. A PAM sequence is a sequence in the target nucleic acid. In an embodiment, cleavage of the target nucleic acid occurs upstream from the PAM sequence. EaCas9 molecules from different bacterial species can recognize different sequence motifs (e.g., PAM sequences). In an embodiment, an eaCas9 molecule of *S. pyogenes* recognizes the sequence motif NGG and directs cleavage of a target nucleic acid sequence 1 to 10, e.g., 3 to 5, base pairs upstream from that sequence. See, e.g., Mali et al., SCIENCE 2013; 339(6121): 823-826. In an embodiment, an eaCas9 molecule of *S. thermophilus* recognizes the sequence motif NGGNG (SEQ ID NO.: 90) and/or NNAGAAW (W=A or T) (SEQ ID NO.: 91) and directs cleavage of a target nucleic acid sequence 1 to 10, e.g., 3 to 5, base pairs upstream from these sequences. See, e.g., Horvath et al., SCIENCE 2010; 327(5962):167-170, and Deveau et al., J BACTERIOL 2008; 190(4): 1390-1400. In an embodiment, an eaCas9 molecule of *S. mutans* recognizes the sequence motif NGG and/or NAAR (R=A or G) (SEQ ID NO.: 92) and directs cleavage of a target nucleic acid sequence 1 to 10, e.g., 3 to 5 base pairs, upstream from this sequence. See, e.g., Deveau et al., J BACTERIOL 2008; 190(4): 1390-1400. In an embodiment, an eaCas9 molecule of *S. aureus* recognizes the sequence motif NNGRR (R=A or G) (SEQ ID NO.: 93) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRN (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRT (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRV (R=A or G) (SEQ ID NO.:) and directs cleavage of a target nucleic acid sequence 1 to 10, e.g., 3 to 5, base pairs upstream from that sequence. In an embodiment, an eaCas9 molecule of *N. meningitidis* recognizes the sequence motif NNNNGATT (SEQ ID NO.: 94) or NNNGCTT (R=A or G) (SEQ ID NO: 95) and directs cleavage of a target nucleic acid sequence 1 to 10, e.g., 3 to 5, base pairs upstream from that sequence. See, e.g., Hou et al., PNAS 2013; 110(39):15644-15649. The ability of a Cas9 molecule to recognize a PAM sequence can be determined, e.g., using a transformation assay described in Jinek el al., SCIENCE 2012, 337:816. In the aforementioned embodiments, N can be any nucleotide residue, e.g., any of A, G, C or T.

As is discussed herein, Cas9 molecules can be engineered to alter the PAM specificity of the Cas9 molecule.

Exemplary naturally occurring Cas9 molecules are described in Chylinski et al., RNA BIOLOGY 2013 10:5, 727-737. Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of: *S. pyogenes* (e.g., strain SF370, MGAS10270, MGAS10750, MGAS2096, MGAS315, MGAS5005, MGAS6180, MGAS9429, NZ131 and SSI-1), *S. thermophilus* (e.g., strain LMD-9), *S. pseudoporcinus* (e.g., strain SPIN 20026), *S. mutans* (e.g., strain UA159, NN2025), *S. macacae* (e.g., strain NCTC11558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g., strain F0211), *S. agalactiae* (e.g., strain NEM316, A909), *Listeria monocytogenes* (e.g., strain F6854), *Listeria innocua* (*L. innocua*, e.g., strain Clip11262), *Enterococcus italicus* (e.g., strain DSM 15952), or *Enterococcus faecium* (e.g., strain 1,231,408). Additional exemplary Cas9 molecules are a Cas9 molecule of *Neisseria meningitidis* (Hou et al., PNAS Early Edition 2013, 1-6 and a *S. aureus* cas9 molecule.

In an embodiment, a Cas9 molecule or Cas9 polypeptide, e.g., an eaCas9 molecule or eaCas9 polypeptide, comprises an amino acid sequence:

having 60%, 65%, 70%, 75%, 80%, 85%, 90%, 95%, 96%, 97%, 98% or 99% homology with;

differs at no more than, 2, 5, 10, 15, 20, 30, or 40% of the amino acid residues when compared with;

differs by at least 1, 2, 5, 10 or 20 amino acids, but by no more than 100, 80, 70, 60, 50, 40 or 30 amino acids from; or is identical to any Cas9 molecule sequence described herein, or a naturally occurring Cas9 molecule sequence, e.g., a Cas9 molecule from a species listed herein or described in Chylinski et al., RNA BIOLOGY 2013 10:5, 727-737; Hou et al., PNAS Early Edition 2013, 1-6; SEQ ID NO:1-4. In an embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to localize to a target nucleic acid.

In an embodiment, a Cas9 molecule or Cas9 polypeptide comprises any of the amino acid sequence of the consensus sequence of FIGS. 2A-2G, wherein "*" indicates any amino acid found in the corresponding position in the amino acid sequence of a Cas9 molecule of *S. pyogenes, S. thermophilus, S. mutans* and *L. innocua*, and "-" indicates any amino acid. In an embodiment, a Cas9 molecule or Cas9 polypeptide differs from the sequence of the consensus sequence disclosed in FIGS. 2A-2G by at least 1, but no more than 2, 3, 4, 5, 6, 7, 8, 9, or 10 amino acid residues. In an embodiment, a Cas9 molecule or Cas9 polypeptide comprises the amino acid sequence of SEQ ID NO:7 of FIGS. 7A-7B, wherein "*" indicates any amino acid found in the corresponding position in the amino acid sequence of a Cas9 molecule of *S. pyogenes*, or *N. meningitidis*, "-" indicates any amino acid, and "-" indicates any amino acid or absent. In an embodiment, a Cas9 molecule or Cas9 polypeptide differs from the sequence of SEQ ID NO:6 or 7 disclosed in FIGS. 7A-7B by at least 1, but no more than 2, 3, 4, 5, 6, 7, 8, 9, or 10 amino acid residues.

A comparison of the sequence of a number of Cas9 molecules indicate that certain regions are conserved. These are identified below as:

region 1 (residues 1 to 180, or in the case of region 1'residues 120 to 180)

region 2 (residues 360 to 480);

region 3 (residues 660 to 720);

region 4 (residues 817 to 900); and region 5 (residues 900 to 960);

In an embodiment, a Cas9 molecule or Cas9 polypeptide comprises regions 1-5, together with sufficient additional Cas9 molecule sequence to provide a biologically active molecule, e.g., a Cas9 molecule having at least one activity described herein. In an embodiment, each of regions 1-5, independently, have 50%, 60%, 70%, 80%, 85%, 90%, 95%, 96%, 97%, 98% or 99% homology with the corresponding residues of a Cas9 molecule or Cas9 polypeptide described herein, e.g., a sequence from FIGS. 2A-2G or from FIGS. 7A-7B.

In an embodiment, a Cas9 molecule or Cas9 polypeptide, e.g., an eaCas9 molecule or eaCas9 polypeptide, comprises an amino acid sequence referred to as region 1:

having 50%, 60%, 70%, 80%, 85%, 90%, 95%, 96%, 97%, 98% or 99% homology with amino acids 1-180 (the numbering is according to the motif sequence in FIG. 2; 52% of residues in the four Cas9 sequences in FIGS. 2A-2G are conserved) of the amino acid sequence of Cas9 of *S. pyogenes;* differs by at least 1, 2, 5, 10 or 20 amino acids but by no more than 90, 80, 70, 60, 50, 40 or 30 amino acids from amino acids 1-180 of the amino acid sequence of Cas9 of *S. pyogenes, S. thermophilus, S. mutans* or *Listeria innocua*; or is identical to 1-180 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 1':

having 55%, 60%, 65%, 70%, 75%, 80%, 85%, 90%, 95%, 96%, 97%, 98% or 99% homology with amino acids 120-180 (55% of residues in the four Cas9 sequences in FIG. 2 are conserved) of the amino acid sequence of Cas9 of *S. pyogenes, S. thermophilus, S. mutans* or *L. innocua;* differs by at least 1, 2, or 5 amino acids but by no more than 35, 30, 25, 20 or 10 amino acids from amino acids 120-180 of the amino acid sequence of Cas9 of *S. pyogenes, S. thermophilus, S. mutans* or *L. innocua*; or is identical to 120-180 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 2:

having 50%, 55%, 60%, 65%, 70%, 75%, 80%, 85%, 90%, 95%, 96%, 97%, 98% or 99% homology with amino acids 360-480 (52% of residues in the four Cas9 sequences in FIG. 2 are conserved) of the amino acid sequence of Cas9 of *S. pyogenes, S. thermophilus, S. mutans* or *L. innocua;* differs by at least 1, 2, or 5 amino acids but by no more than 35, 30, 25, 20 or 10 amino acids from amino acids 360-480 of the amino acid sequence of Cas9 of *S. pyogenes, S. thermophilus, S. mutans* or *L. innocua*; or is identical to 360-480 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 3:

having 55%, 60%, 65%, 70%, 75%, 80%, 85%, 90%, 95%, 96%, 97%, 98%, or 99% homology with amino acids 660-720 (56% of residues in the four Cas9 sequences in FIG. 2 are conserved) of the amino acid sequence of Cas9 of *S. pyogenes, S. thermophilus, S. mutans* or *L. innocua;* differs by at least 1, 2, or 5 amino acids but by no more than 35, 30, 25, 20 or 10 amino acids from amino acids 660-720 of the amino acid sequence of Cas9 of *S. pyogenes, S. thermophilus, S. mutans* or *L. innocua;* or is identical to 660-720 of the amino acid sequence of Cas9 of *S. pyogenes, S. thermophilus, S. mutans* or *L. innocua.*

In an embodiment, a Cas9 molecule or Cas9 polypeptide, e.g., an eaCas9 molecule or eaCas9 polypeptide, comprises an amino acid sequence referred to as region 4:

having 50%, 55%, 60%, 65%, 70%, 75%, 80%, 85%, 90%, 95%, 96%, 97%, 98%, or 99% homology with amino acids 817-900 (55% of residues in the four Cas9 sequences in FIGS. 2A-2G are conserved) of the amino acid sequence of Cas9 of *S. pyogenes, S. thermophilus, S. mutans* or *L. innocua;* differs by at least 1, 2, or 5 amino acids but by no more than 35, 30, 25, 20 or 10 amino acids from amino acids 817-900 of the amino acid sequence of Cas9 of *S. pyogenes, S. thermophilus, S. mutans* or *L. innocua;* or is identical to 817-900 of the amino acid sequence of Cas9 of *S. pyogenes, S. thermophilus, S. mutans* or *L. innocua.*

In an embodiment, a Cas9 molecule or Cas9 polypeptide, e.g., an eaCas9 molecule or eaCas9 polypeptide, comprises an amino acid sequence referred to as region 5:

having 50%, 55%, 60%, 65%, 70%, 75%, 80%, 85%, 90%, 95%, 96%, 97%, 98%, or 99% homology with amino acids 900-960 (60% of residues in the four Cas9 sequences in FIGS. 2A-2G are conserved) of the amino acid sequence of Cas9 of *S. pyogenes, S. thermophilus, S. mutans* or *L. innocua;* differs by at least 1, 2, or 5 amino acids but by no more than 35, 30, 25, 20 or 10 amino acids from amino acids 900-960 of the amino acid sequence of Cas9 of *S. pyogenes, S. thermophilus, S. mutans* or *L. innocua;* or is identical to 900-960 of the amino acid sequence of Cas9 of *S. pyogenes, S. thermophilus, S. mutans* or *L. innocua.*

Engineered or Altered Cas9 Molecules and Cas9 Polypeptides

Cas9 molecules and Cas9 polypeptides described herein, e.g., naturally occurring Cas9 molecules, can possess any of a number of properties, including: nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In an embodiment, a Cas9 molecule or Cas9 polypeptide can include all or a subset of these properties. In a typical embodiment, a Cas9 molecule or Cas9 polypeptide has the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity, (as compared with a naturally occurring or other reference Cas9 molecule) or altered helicase activity. As discussed herein, an engineered Cas9 molecule or Cas9 polypeptide can have nickase activity (as opposed to double strand nuclease activity). In an embodiment an engineered Cas9 molecule or Cas9 polypeptide can have an alteration that alters its size, e.g., a deletion of amino acid sequence that reduces its size, e.g., without significant effect on one or more, or any Cas9 activity. In an embodiment, an engineered Cas9 molecule or Cas9 polypeptide can comprise an alteration that affects PAM recognition. E.g., an engineered Cas9 molecule can be altered to recognize a PAM sequence other than that recognized by the endogenous wild-type PI domain. In an embodiment a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring, Cas9 molecules or Cas9 polypeptides, to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids); insertions; or deletions. In an embodiment, a Cas9 molecule or Cas9 polypeptide can comprises one or more mutations or differences, e.g., at least 1, 2, 3, 4, 5, 10, 15, 20, 30, 40 or 50 mutations but less than 200, 100, or 80 mutations relative to a reference, e.g., a parental, Cas9 molecule.

In an embodiment, a mutation or mutations do not have a substantial effect on a Cas9 activity, e.g. a Cas9 activity described herein. In an embodiment, a mutation or mutations have a substantial effect on a Cas9 activity, e.g. a Cas9 activity described herein.

Non-Cleaving and Modified-Cleavage Cas9 Molecules and Cas9 Polypeptides

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. pyogenes*, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule, e.g., a double stranded or single stranded nucleic acid molecule, can be eliminated.

Modified Cleavage eaCas9 Molecules and eaCas9 Polypeptides

In an embodiment, an eaCas9 molecule or eaCas9 polypeptide comprises one or more of the following activities: cleavage activity associated with an N-terminal RuvC-like domain; cleavage activity associated with an HNH-like domain; cleavage activity associated with an HNH-like domain and cleavage activity associated with an N-terminal RuvC-like domain.

In an embodiment, an eaCas9 molecule or eaCas9 polypeptide comprises an active, or cleavage competent, HNH-like domain (e.g., an HNH-like domain described herein, e.g., SEQ ID NO: 17, SEQ ID NO: 18, SEQ ID NO: 19, SEQ ID NO: 20 or SEQ ID NO: 21) and an inactive, or cleavage incompetent, N-terminal RuvC-like domain. An exemplary inactive, or cleavage incompetent N-terminal RuvC-like domain can have a mutation of an aspartic acid in an N-terminal RuvC-like domain, e.g., an aspartic acid at position 9 of the consensus sequence disclosed in FIGS. 2A-2G or an aspartic acid at position 10 of SEQ ID NO: 7, e.g., can be substituted with an alanine. In an embodiment, the eaCas9 molecule or eaCas9 polypeptide differs from wild type in the N-terminal RuvC-like domain and does not cleave the target nucleic acid, or cleaves with significantly less efficiency, e.g., less than 20, 10, 5, 1 or 1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of S. pyogenes, or S. thermophilus. In an embodiment, the reference Cas9 molecule is the naturally occurring Cas9 molecule having the closest sequence identity or homology.

In an embodiment, an eaCas9 molecule or eaCas9 polypeptide comprises an inactive, or cleavage incompetent, HNH domain and an active, or cleavage competent, N-terminal RuvC-like domain (e.g., a RuvC-like domain described herein, e.g., SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, or SEQ ID NO: 16). Exemplary inactive, or cleavage incompetent HNH-like domains can have a mutation at one or more of: a histidine in an HNH-like domain, e.g., a histidine shown at position 856 of the consensus sequence disclosed in FIGS. 2A-2G, e.g., can be substituted with an alanine; and one or more asparagines in an HNH-like domain, e.g., an asparagine shown at position 870 of the consensus sequence disclosed in FIGS. 2A-2G and/or at position 879 of the consensus sequence disclosed in FIGS. 2A-2G, e.g., can be substituted with an alanine. In an embodiment, the eaCas9 differs from wild type in the HNH-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of S. pyogenes, or S. thermophilus. In an embodiment, the reference Cas9 molecule is the naturally occurring Cas9 molecule having the closest sequence identity or homology.

Alterations in the Ability to Cleave One or Both Strands of a Target Nucleic Acid In an embodiment, exemplary Cas9 activities comprise one or more of PAM specificity, cleavage activity, and helicase activity. A mutation(s) can be present, e.g., in: one or more RuvC domains, e.g., an N-terminal RuvC domain; an HNH domain; a region outside the RuvC domains and the HNH domain. In an embodiment, a mutation(s) is present in a RuvC domain. In an embodiment, a mutation(s) is present in an HNH domain. In an embodiment, mutations are present in both a RuvC domain and an HNH domain.

Exemplary mutations that may be made in the RuvC domain or HNH domain with reference to the S. pyogenes sequence include: D10A, E762A, H840A, N854A, N863A and/or D986A.

In an embodiment, a Cas9 molecule is an eiCas9 molecule comprising one or more differences in a RuvC domain and/or in an HNH domain as compared to a reference Cas9 molecule, and the eiCas9 molecule does not cleave a nucleic acid, or cleaves with significantly less efficiency than does wildtype, e.g., when compared with wild type in a cleavage assay, e.g., as described herein, cuts with less than 50, 25, 10, or 1% of a reference Cas9 molecule, as measured by an assay described herein.

Whether or not a particular sequence, e.g., a substitution, may affect one or more activity, such as targeting activity, cleavage activity, etc, can be evaluated or predicted, e.g., by evaluating whether the mutation is conservative. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In an embodiment, a Cas9 molecule comprises a cleavage property that differs from naturally occurring Cas9 molecules, e.g., that differs from the naturally occurring Cas9 molecule having the closest homology. For example, a Cas9 molecule can differ from naturally occurring Cas9 molecules, e.g., a Cas9 molecule of S. aureus, S. pyogenes, or C. jejuni as follows: its ability to modulate, e.g., decreased or increased, cleavage of a double stranded break (endonuclease and/or exonuclease activity), e.g., as compared to a naturally occurring Cas9 molecule (e.g., a Cas9 molecule of S. aureus, S. pyogenes, or C. jejuni); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of S. aureus, S. pyogenes, or C. jejuni); or the ability to cleave a nucleic acid molecule, e.g., a double stranded or single stranded nucleic acid molecule, can be eliminated.

In an embodiment, the altered Cas9 molecule is an eaCas9 molecule comprising one or more of the following activities: cleavage activity associated with a RuvC domain; cleavage activity associated with an HNH domain; cleavage activity associated with an HNH domain and cleavage activity associated with a RuvC domain.

In an embodiment, the altered Cas9 molecule is an eiCas9 molecule which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can be a naturally occurring unmodified Cas9 molecule, e.g., a naturally occurring Cas9 molecule such as a Cas9 molecule of S. pyogenes, S. thermophilus, S. aureus, C. jejuni or N. meningitidis. In an embodiment, the reference Cas9 molecule is the naturally occurring Cas9 molecule having the closest sequence identity or homology. In an embodiment, the eiCas9 molecule lacks substantial cleavage activity associated with a RuvC domain and cleavage activity associated with an HNH domain.

In an embodiment, the altered Cas9 molecule or Cas9 polypeptide is an eaCas9 molecule or eaCas9 polypeptide comprising the fixed amino acid residues of S. pyogenes shown in the consensus sequence disclosed in FIGS. 2A-2G, and has one or more amino acids that differ from the amino acid sequence of S. pyogenes (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G or SEQ ID NO: 7.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an S. pyogenes Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an S. pyogenes Cas9 molecule.

In an embodiment, the altered Cas9 molecule or Cas9 polypeptide is an eaCas9 molecule or eaCas9 polypeptide comprising the fixed amino acid residues of S. thermophilus shown in the consensus sequence disclosed in FIGS. 2A-2G, and has one or more amino acids that differ from the amino acid sequence of S. thermophilus (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G. In an embodiment In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an S. thermophilus Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an S. thermophilus Cas9 molecule.

In an embodiment, the altered Cas9 molecule or Cas9 polypeptide is an eaCas9 molecule or eaCas9 polypeptide comprising the fixed amino acid residues of S. mutans shown in the consensus sequence disclosed in FIGS. 2A-2G, and has one or more amino acids that differ from the amino acid sequence of S. mutans (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an S. mutans Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an S. mutans Cas9 molecule.

In an embodiment, the altered Cas9 molecule or Cas9 polypeptide is an eaCas9 molecule or eaCas9 polypeptide comprising the fixed amino acid residues of L. innocula shown in the consensus sequence disclosed in FIGS. 2A-2G, and has one or more amino acids that differ from the amino acid sequence of L. innocula (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an L. innocula Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an L. innocula Cas9 molecule.

In an embodiment, the altered Cas9 molecule or Cas9 polypeptide, e.g., an eaCas9 molecule or eaCas9 polypeptide, can be a fusion, e.g., of two of more different Cas9 molecules, e.g., of two or more naturally occurring Cas9 molecules of different species. For example, a fragment of a naturally occurring Cas9 molecule of one species can be fused to a fragment of a Cas9 molecule of a second species. As an example, a fragment of a Cas9 molecule of S. pyogenes comprising an N-terminal RuvC-like domain can be fused to a fragment of Cas9 molecule of a species other than S. pyogenes (e.g., S. thermophilus) comprising an HNH-like domain.

Cas9 Molecules and Cas9 Polypeptides with Altered PAM Recognition or No PAM Recognition Naturally occurring Cas9 molecules can recognize specific PAM sequences, for example the PAM recognition sequences described above for, e.g., S. pyogenes, S. thermophilus, S. mutans, S. aureus and N. meningitidis.

In an embodiment, a Cas9 molecule or Cas9 polypeptide has the same PAM specificities as a naturally occurring Cas9 molecule. In an embodiment, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule or Cas9 polypeptide recognizes to decrease off target sites and/or improve specificity; or eliminate a PAM recognition requirement. In an embodiment, a Cas9 molecule or Cas9 polypeptide can be altered, e.g., to increase length of PAM recognition sequence and/or improve Cas9 specificity to high level of identity (e.g., 98%, 99% or 100% match between gRNA and a PAM sequence), e.g., to decrease off target sites and increase specificity. In an embodiment, the length of the PAM recognition sequence is at least 4, 5, 6, 7, 8, 9, 10 or 15 amino acids in length. In an embodiment, the Cas9 specificity requires at least 90%, 95%, 96%, 97%, 98%, 99% or more homology between the gRNA and the PAM sequence. Cas9 molecules or Cas9 polypeptides that recognize different PAM sequences and/or have reduced off-target activity can be generated using directed evolution. Exemplary methods and systems that can be used for directed evolution of Cas9 molecules are described, e.g., in Esvelt et al. Nature 2011, 472(7344): 499-503. Candidate Cas9 molecules can be evaluated, e.g., by methods described in Section IV.

Alterations of the PI domain, which mediates PAM recognition are discussed below.

Synthetic Cas9 Molecules and Cas9 Polypeptides with Altered PI Domains

Current genome-editing methods are limited in the diversity of target sequences that can be targeted by the PAM sequence that is recognized by the Cas9 molecule utilized. A synthetic Cas9 molecule (or Syn-Cas9 molecule), or synthetic Cas9 polypeptide (or syn-Cas9 polypeptide), as that term is used herein, refers to a Cas9 molecule or Cas9 polypeptide that comprises a Cas9 core domain from one bacterial species and a functional altered PI domain, i.e., a PI domain other than that naturally associated with the Cas9 core domain, e.g., from a different bacterial species.

In an embodiment, the altered PI domain recognizes a PAM sequence that is different from the PAM sequence recognized by the naturally-occurring Cas9 from which the Cas9 core domain is derived. In an embodiment, the altered PI domain recognizes the same PAM sequence recognized by the naturally-occurring Cas9 from which the Cas9 core domain is derived, but with different affinity or specificity. A Syn-Cas9 molecule or Syn-Cas9 polypeptide can be, respectively, a Syn-eaCas9 molecule or Syn-eaCas9 polypeptide or a Syn-eiCas9 molecule Syn-eiCas9 polypeptide.

An exemplary Syn-Cas9 molecule Syn-Cas9 polypeptide comprises:

a) a Cas9 core domain, e.g., a Cas9 core domain from Table 28 or 29, e.g., a *S. aureus*, *S. pyogenes*, or *C. jejuni* Cas9 core domain; and b) an altered PI domain from a species X Cas9 sequence selected from Tables 31 and 32.

In an embodiment, the RKR motif (the PAM binding motif) of said altered PI domain comprises: differences at 1, 2, or 3 amino acid residues; a difference in amino acid sequence at the first, second, or third position; differences in amino acid sequence at the first and second positions, the first and third positions, or the second and third positions; as compared with the sequence of the RKR motif of the native or endogenous PI domain associated with the Cas9 core domain.

In an embodiment, the Cas9 core domain comprises the Cas9 core domain from a species X Cas9 from Table 28 and said altered PI domain comprises a PI domain from a species Y Cas9 from Table 28.

In an embodiment, the RKR motif of the species X Cas9 is other than the RKR motif of the species Y Cas9.

In an embodiment, the RKR motif of the altered PI domain is selected from XXY, XNG, and XNQ.

In an embodiment, the altered PI domain has at least 60, 70, 80, 90, 95, or 100% homology with the amino acid sequence of a naturally occurring PI domain of said species Y from Table 28.

In an embodiment, the altered PI domain differs by no more than 50, 40, 30, 25, 20, 15, 10, 5, 4, 3, 2, or 1 amino acid residue from the amino acid sequence of a naturally occurring PI domain of said second species from Table 28.

In an embodiment, the Cas9 core domain comprises a *S. aureus* core domain and altered PI domain comprises: an *A. denitrificans* PI domain; a *C. jejuni* PI domain; a *H. mustelae* PI domain; or an altered PI domain of species X PI domain, wherein species X is selected from Table 32.

In an embodiment, the Cas9 core domain comprises a *S. pyogenes* core domain and the altered PI domain comprises: an *A. denitrificans* PI domain; a *C. jejuni* PI domain; a *H. mustelae* PI domain; or an altered PI domain of species X PI domain, wherein species X is selected from Table 32.

In an embodiment, the Cas9 core domain comprises a *C. jejuni* core domain and the altered PI domain comprises: an *A. denitrificans* PI domain; a *H. mustelae* PI domain; or an altered PI domain of species X PI domain, wherein species X is selected from Table 32.

In an embodiment, the Cas9 molecule further comprises a linker disposed between said Cas9 core domain and said altered PI domain.

In an embodiment, the linker comprises: a linker described elsewhere herein disposed between the Cas9 core domain and the heterologous PI domain. Suitable linkers are further described in Section V.

Exemplary altered PI domains for use in Syn-Cas9 molecules are described in Tables 31 and 32. The sequences for the 83 Cas9 orthologs referenced in Tables 31 and 32 are provided in Table 28. Table 30 provides the Cas9 orthologs with known PAM sequences and the corresponding RKR motif.

In an embodiment, a Syn-Cas9 molecule may also be size-optimized, e.g., the Syn-Cas9 molecule comprises one or more deletions, and optionally one or more linkers disposed between the amino acid residues flanking the deletions. In an embodiment, a Syn-Cas9 molecule comprises a REC deletion.

Size-Optimized Cas9 Molecules

Engineered Cas9 molecules and engineered Cas9 polypeptides described herein include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., a *S. aureus*, *S. pyogenes*, or *C. jejuni*, Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome-editing. A Cas9 molecule can comprise one or more deletions that do not substantially affect or decrease the activity of the resultant Cas9 molecules described herein. Activities that are retained in the Cas9 molecules comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which in an embodiment is the presence of two nickase activities;

an endonuclease activity;

an exonuclease activity;

a helicase activity, i.e., the ability to unwind the helical structure of a double stranded nucleic acid;

and recognition activity of a nucleic acid molecule, e.g., a target nucleic acid or a gRNA.

Activity of the Cas9 molecules described herein can be assessed using the activity assays described herein or in the art.

Identifying Regions Suitable for Deletion

Suitable regions of Cas9 molecules for deletion can be identified by a variety of methods. Naturally-occurring orthologous Cas9 molecules from various bacterial species, e.g., any one of those listed in Table 28, can be modeled onto the crystal structure of S. pyogenes Cas9 (Nishimasu et al., Cell, 156:935-949, 2014) to examine the level of conservation across the selected Cas9 orthologs with respect to the three-dimensional conformation of the protein. Less conserved or unconserved regions that are spatially located distant from regions involved in Cas9 activity, e.g., interface with the target nucleic acid molecule and/or gRNA, represent regions or domains are candidates for deletion without substantially affecting or decreasing Cas9 activity.

REC-Optimized Cas9 Molecules

A REC-optimized Cas9 molecule, as that term is used herein, refers to a Cas9 molecule that comprises a deletion in one or both of the REC2 domain and the RE1$_{CT}$ domain (collectively a REC deletion), wherein the deletion comprises at least 10% of the amino acid residues in the cognate domain. A REC-optimized Cas9 molecule can be an eaCas9 molecule or an eiCas9 molecule. An exemplary REC-optimized Cas9 molecule comprises:

a) a deletion selected from:

i) a REC2 deletion;

ii) a REC1$_{CT}$ deletion; or iii) a REC1$_{SUB}$ deletion.

Optionally, a linker is disposed between the amino acid residues that flank the deletion. In an embodiment a Cas9 molecule includes only one deletion, or only two deletions. A Cas9 molecule can comprise a REC2 deletion and a REC1$_{CT}$ deletion. A Cas9 molecule can comprise a REC2 deletion and a REC1$_{SUB}$ deletion.

Generally, the deletion will contain at least 10% of the amino acids in the cognate domain, e.g., a REC2 deletion will include at least 10% of the amino acids in the REC2 domain.

A deletion can comprise: at least 10, 20, 30, 40, 50, 60, 70, 80, or 90% of the amino acid residues of its cognate domain; all of the amino acid residues of its cognate domain; an amino acid residue outside its cognate domain; a plurality of amino acid residues outside its cognate domain; the amino acid residue immediately N terminal to its cognate domain; the amino acid residue immediately C terminal to its cognate domain; the amino acid residue immediately N terminal to its cognate and the amino acid residue immediately C terminal to its cognate domain; a plurality of, e.g., up to 5, 10, 15, or 20, amino acid residues N terminal to its cognate domain; a plurality of, e.g., up to 5, 10, 15, or 20, amino acid residues C terminal to its cognate domain; a plurality of, e.g., up to 5, 10, 15, or 20, amino acid residues N terminal to to its cognate domain and a plurality of e.g., up to 5, 10, 15, or 20, amino acid residues C terminal to its cognate domain.

In an embodiment, a deletion does not extend beyond: its cognate domain; the N terminal amino acid residue of its cognate domain; the C terminal amino acid residue of its cognate domain.

A REC-optimized Cas9 molecule can include a linker disposed between the amino acid residues that flank the deletion. Suitable linkers for use between the amino acid resides that flank a REC deletion in a REC-optimized Cas9 molecule is disclosed in Section V.

In an embodiment a REC-optimized Cas9 molecule comprises an amino acid sequence that, other than any REC deletion and associated linker, has at least 50, 55, 60, 65, 70, 75, 80, 85, 90, 95, 99, or 100% homology with the amino acid sequence of a naturally occurring Cas 9, e.g., a Cas9 molecule described in Table 28, e.g., a S. aureus Cas9 molecule, a S. pyogenes Cas9 molecule, or a C. jejuni Cas9 molecule.

In an embodiment, a a REC-optimized Cas9 molecule comprises an amino acid sequence that, other than any REC deletion and associated linker, differs by no more than 1, 2, 3, 4, 5, 6, 7, 8, 9, 10, 15, 20, or 25, amino acid residues from the amino acid sequence of a naturally occurring Cas 9, e.g., a Cas9 molecule described in Table 28, e.g., a S. aureus Cas9 molecule, a S. pyogenes Cas9 molecule, or a C. jejuni Cas9 molecule.

In an embodiment, a REC-optimized Cas9 molecule comprises an amino acid sequence that, other than any REC deletion and associate linker, differs by no more than 1, 2, 3, 4, 5, 6, 7, 8, 9, 10, 15, 20, or 25% of the, amino acid residues from the amino acid sequence of a naturally occurring Cas 9, e.g., a Cas9 molecule described in Table 28, e.g., a S. aureus Cas9 molecule, a S. pyogenes Cas9 molecule, or a C. jejuni Cas9 molecule.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Biol. 48:444-453) algorithm which has been incorporated into the GAP program in the GCG software package (available at www.gcg.com), using either a Blossom 62 matrix or a PAM250 matrix, and a gap weight of 16, 14, 12, 10, 8, 6, or 4 and a length weight of 1, 2, 3, 4, 5, or 6.

Sequence information for exemplary REC deletions are provided for 83 naturally-occurring Cas9 orthologs in Table 28.

The amino acid sequences of exemplary Cas9 molecules from different bacterial species are shown below.

TABLE 28

Amino Acid Sequence of Cas9 Orthologs

| | | REC2 | | | REC1$_{CT}$ | | | Rec$_{sub}$ | | |
|---|---|---|---|---|---|---|---|---|---|---|
| Species/Composite ID | Amino acid sequence | start (AA pos) | stop (AA pos) | # AA deleted (n) | start (AA pos) | stop (AA pos) | # AA deleted (n) | start (AA pos) | stop (AA pos) | # AA deleted (n) |
| Staphylococcus Aureus tr\|J7RUA5\|J7RUA5_STAAU | SEQ ID NO: 304 | 126 | 166 | 41 | 296 | 352 | 57 | 296 | 352 | 57 |
| Streptococcus Pyogenes sp\|Q99ZW2\|CAS9_STRP1 | SEQ ID NO: 305 | 176 | 314 | 139 | 511 | 592 | 82 | 511 | 592 | 82 |
| Campylobacter jejuni NCTC 11168 gi\|218563121\|ref\|YP_002344900.1 | SEQ ID NO: 306 | 137 | 181 | 45 | 316 | 360 | 45 | 316 | 360 | 45 |
| Bacteroides fragilis NCTC 9343 gi\|60683389\|ref\|YP_213533.1\| | SEQ ID NO: 307 | 148 | 339 | 192 | 524 | 617 | 84 | 524 | 617 | 84 |
| Bifidobacterium bifidum S17 gi\|310286728\|ref\|YP_003937986. | SEQ ID NO: 308 | 173 | 335 | 163 | 516 | 607 | 87 | 516 | 607 | 87 |
| Veillonella atypica ACS-134-V-Col7a gi\|303229466\|ref\|ZP_07316256.1 | SEQ ID NO: 309 | 185 | 339 | 155 | 574 | 663 | 79 | 574 | 663 | 79 |
| Lactobacillus rhamnosus GG gi\|258509199\|ref\|YP_003171950.1 | SEQ ID NO: 310 | 169 | 320 | 152 | 559 | 645 | 78 | 559 | 645 | 78 |
| Filifactor alocis ATCC 35896 gi\|374307738\|ref\|YP_005054169.1 | SEQ ID NO: 311 | 166 | 314 | 149 | 508 | 592 | 76 | 508 | 592 | 76 |
| Oenococcus kitaharae DSM 17330 gi\|366983953\|gb\|EHN59352.1\| | SEQ ID NO: 312 | 169 | 317 | 149 | 555 | 639 | 80 | 555 | 639 | 80 |
| Fructobacillus fructosus KCTC 3544 gi\|339625081\|ref\|ZP_08660870.1 | SEQ ID NO: 313 | 168 | 314 | 147 | 488 | 571 | 76 | 488 | 571 | 76 |
| Catenibacterium mitsuokai DSM 15897 gi\|224543312\|ref\|ZP_03683851.1 | SEQ ID NO: 314 | 173 | 318 | 146 | 511 | 594 | 78 | 511 | 594 | 78 |
| Finegoldia magna ATCC 29328 gi\|169823755\|ref\|YP_001691366.1 | SEQ ID NO: 315 | 168 | 313 | 146 | 452 | 534 | 77 | 452 | 534 | 77 |
| CoriobacteriumglomeransPW2 gi\|328956315\|ref\|YP_004373648.1 | SEQ ID NO: 316 | 175 | 318 | 144 | 511 | 592 | 82 | 511 | 592 | 82 |
| Eubacterium yurii ATCC 43715 gi\|306821691\|ref\|ZP_07455288.1 | SEQ ID NO: 317 | 169 | 310 | 142 | 552 | 633 | 76 | 552 | 633 | 76 |
| Peptoniphilus duerdenii ATCC BAA-1640 gi\|304438954\|ref\|ZP_07398877.1 | SEQ ID NO: 318 | 171 | 311 | 141 | 535 | 615 | 76 | 535 | 615 | 76 |
| Acidaminococcus sp. D21 gi\|227824983\|ref\|ZP_03989815.1 | SEQ ID NO: 319 | 167 | 306 | 140 | 511 | 591 | 75 | 511 | 591 | 75 |
| Lactobacillus farciminis KCTC 3681 gi\|336394882\|ref\|ZP_08576281.1 | SEQ ID NO: 320 | 171 | 310 | 140 | 542 | 621 | 85 | 542 | 621 | 85 |
| Streptococcus sanguinis SK49 gi\|422884106\|ref\|ZP_16930555.1 | SEQ ID NO: 321 | 185 | 324 | 140 | 411 | 490 | 85 | 411 | 490 | 85 |
| Coprococcus catus GD-7 gi\|291520705\|emb\|CBK78998.1\| | SEQ ID NO: 322 | 172 | 310 | 139 | 556 | 634 | 76 | 556 | 634 | 76 |
| Streptococcus mutans UA159 gi\|24379809\|ref\|NP_721764.1\| | SEQ ID NO: 323 | 176 | 314 | 139 | 392 | 470 | 84 | 392 | 470 | 84 |
| Streptococcus pyogenes M1 GAS gi\|13622193\|gb\|AAK33936.1\| | SEQ ID NO: 324 | 176 | 314 | 139 | 523 | 600 | 82 | 523 | 600 | 82 |
| Streptococcus thermophilus LMD-9 gi\|116628213\|ref\|YP_820832.1\| | SEQ ID NO: 325 | 176 | 314 | 139 | 481 | 558 | 81 | 481 | 558 | 81 |
| Fusobacterium nucleatum ATCC49256 gi\|34762592\|ref\|ZP_00143587.1\| | SEQ ID NO: 326 | 171 | 308 | 138 | 537 | 614 | 76 | 537 | 614 | 76 |
| Planococcus antarcticus DSM 14505 gi\|389815359\|ref\|ZP_10206685.1 | SEQ ID NO: 327 | 162 | 299 | 138 | 538 | 614 | 94 | 538 | 614 | 94 |
| Treponema denticola ATCC 35405 gi\|42525843\|ref\|NP_970941.1\| | SEQ ID NO: 328 | 169 | 305 | 137 | 524 | 600 | 81 | 524 | 600 | 81 |
| Solobacterium moorei F0204 gi\|320528778\|ref\|ZP_08029929.1 | SEQ ID NO: 329 | 179 | 314 | 136 | 544 | 619 | 77 | 544 | 619 | 77 |
| Staphylococcus pseudintermedius ED99 gi\|323463801\|gb\|ADX75954.1\| | SEQ ID NO: 330 | 164 | 299 | 136 | 531 | 606 | 92 | 531 | 606 | 92 |
| Flavobacterium branchiophilum FL-15 gi\|347536497\|ref\|YP_004843922.1 | SEQ ID NO: 331 | 162 | 286 | 125 | 538 | 613 | 63 | 538 | 613 | 63 |
| Ignavibacterium album JCM 16511 gi\|385811609\|ref\|YP_005848005.1 | SEQ ID NO: 332 | 223 | 329 | 107 | 357 | 432 | 90 | 357 | 432 | 90 |

TABLE 28-continued

Amino Acid Sequence of Cas9 Orthologs

| Species/Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| *Bergeyella zoohelcum* ATCC 43767 gi\|423317190\|ref\|ZP_17295095.1\| | SEQ ID NO: 333 | 165 | 261 | 97 | 529 | 604 | 56 | 529 | 604 | 56 |
| *Nitrobacter hamburgensis* X14 gi\|92109262\|ref\|YP_571550.1\| | SEQ ID NO: 334 | 169 | 253 | 85 | 536 | 611 | 48 | 536 | 611 | 48 |
| *Odoribacter laneus* YIT 12061 gi\|374384763\|ref\|ZP_09642280.1\| | SEQ ID NO: 335 | 164 | 242 | 79 | 535 | 610 | 63 | 535 | 610 | 63 |
| *Legionella pneumophila* str. Paris gi\|54296138\|ref\|YP_122507.1\| | SEQ ID NO: 336 | 164 | 239 | 76 | 402 | 476 | 67 | 402 | 476 | 67 |
| *Bacteroides* sp. 20 3 gi\|301311869\|ref\|ZP_07721791.1\| | SEQ ID NO: 337 | 198 | 269 | 72 | 530 | 604 | 83 | 530 | 604 | 83 |
| *Akkermansia muciniphila* ATCC BAA-835 gi\|187736489\|ref\|YP_001878601. | SEQ ID NO: 338 | 136 | 202 | 67 | 348 | 418 | 62 | 348 | 418 | 62 |
| *Prevotella* sp. C561 gi\|345885718\|ref\|ZP_08837074.1\| | SEQ ID NO: 339 | 184 | 250 | 67 | 357 | 425 | 78 | 357 | 425 | 78 |
| *Wolinella succinogenes* DSM 1740 gi\|34557932\|ref\|NP_907747.1\| | SEQ ID NO: 340 | 157 | 218 | 36 | 401 | 468 | 60 | 401 | 468 | 60 |
| *Alicyclobacillus hesperidum* URH17-3-68 gi\|403744858\|ref\|ZP_10953934.1\| | SEQ ID NO: 341 | 142 | 196 | 55 | 416 | 482 | 61 | 416 | 482 | 61 |
| *Caenispirillum salinarum* AK4 gi\|427429481\|ref\|ZP_18919511.1\| | SEQ ID NO: 342 | 161 | 214 | 54 | 330 | 393 | 68 | 330 | 393 | 68 |
| *Eubacterium rectale* ATCC 33656 gi\|238924075\|ref\| YP_002937591.1\| | SEQ ID NO: 343 | 133 | 185 | 53 | 322 | 384 | 60 | 322 | 384 | 60 |
| *Mycoplasma synoviae* 53 gi\|71894592\|ref\|YP_278700.1\| | SEQ ID NO: 344 | 187 | 239 | 53 | 319 | 381 | 80 | 319 | 381 | 80 |
| *Porphyromonas* sp. oral taxon 279 str. F0450 gi\|402847315\|ref\|ZP_10895610.1 | SEQ ID NO: 345 | 150 | 202 | 53 | 309 | 371 | 60 | 309 | 371 | 60 |
| *Streptococcus thermophilus* LMD-9 gi\|116627542\|ref\|YP_820161.1\| | SEQ ID NO: 346 | 127 | 178 | 139 | 424 | 486 | 81 | 424 | 486 | 81 |
| *Roseburia inulinivorans* DSM 16841 gi\|225377804\|ref\|ZP_03755025.1\| | SEQ ID NO: 347 | 154 | 204 | 51 | 318 | 380 | 69 | 318 | 380 | 69 |
| *Methylosinus trichosporium* OB3b gi\|296446027\|ref\|ZP_06887976.1\| | SEQ ID NO: 348 | 144 | 193 | 50 | 426 | 488 | 64 | 426 | 488 | 64 |
| *Ruminococcus albus* 8 gi\|325677756\|ref\|ZP_08157403.1\| | SEQ ID NO: 349 | 139 | 187 | 49 | 351 | 412 | 55 | 351 | 412 | 55 |
| *Bifidobacterium longum* DJO10A gi\|189440764\|ref\|YP_001955845. | SEQ ID NO: 350 | 183 | 230 | 48 | 370 | 431 | 44 | 370 | 431 | 44 |
| *Enterococcus faecalis* TX0012 gi\|315149830\|gb\|EFT93846.1\| | SEQ ID NO: 351 | 123 | 170 | 48 | 327 | 387 | 60 | 327 | 387 | 60 |
| *Mycoplasma mobile* 163K gi\|47458868\|ref\|YP_015730.1\| | SEQ ID NO: 352 | 179 | 226 | 48 | 314 | 374 | 79 | 314 | 374 | 79 |
| *Actinomyces coleocanis* DSM 15436 gi\|227494853\|ref\|ZP_03925169.1\| | SEQ ID NO: 353 | 147 | 193 | 47 | 358 | 418 | 40 | 358 | 418 | 40 |
| *Dinoroseobacter shibae* DFL 12 gi\|159042956\|ref\|YP_001531750.1\| | SEQ ID NO: 354 | 138 | 184 | 47 | 338 | 398 | 48 | 338 | 398 | 48 |
| *Actinomyces* sp. oral taxon 180 str. F0310 gi\|315605738\|ref\|ZP_07880770.1\| | SEQ ID NO: 355 | 183 | 228 | 46 | 349 | 409 | 40 | 349 | 409 | 40 |
| *Alcanivorax* sp. W11-5 gi\|407803669\|ref\|ZP_11150502.1\| | SEQ ID NO: 356 | 139 | 183 | 45 | 344 | 404 | 61 | 344 | 404 | 61 |
| *Aminomonas paucivorans* DSM 12260 gi\|312879015\|ref\|ZP_07738815.1\| | SEQ ID NO: 357 | 134 | 178 | 45 | 341 | 401 | 63 | 341 | 401 | 63 |
| *Mycoplasma canis* PG 14 gi\|384393286\|gb\|EIE39736.1\| | SEQ ID NO: 358 | 139 | 183 | 45 | 319 | 379 | 76 | 319 | 379 | 76 |
| *Lactobacillus coryniformis* KCTC 3535 gi\|336393381\|ref\|ZP_08574780.1\| | SEQ ID NO: 359 | 141 | 184 | 44 | 328 | 387 | 61 | 328 | 387 | 61 |
| *Elusimicrobium minutum* Pei191 gi\|187250660\|ref\|YP_001875142.1\| | SEQ ID NO: 360 | 177 | 219 | 43 | 322 | 381 | 47 | 322 | 381 | 47 |
| *Neisseria meningitidis* Z2491 gi\|218767588\|ref\|YP_002342100.1\| | SEQ ID NO: 361 | 147 | 189 | 43 | 360 | 419 | 61 | 360 | 419 | 61 |
| *Pasteurella multocida* str. Pm70 gi\|15602992\|ref\|NP_246064.1\| | SEQ ID NO: 362 | 139 | 181 | 43 | 319 | 378 | 61 | 319 | 378 | 61 |
| *Rhodovulum* sp. PH10 gi\|402849997\|ref\|ZP_10898214.1\| | SEQ ID NO: 363 | 141 | 183 | 43 | 319 | 378 | 48 | 319 | 378 | 48 |
| *Eubacterium dolichum* DSM 3991 gi\|160915782\|ref\|ZP_02077990.1\| | SEQ ID NO: 364 | 131 | 172 | 42 | 303 | 361 | 59 | 303 | 361 | 59 |
| *Nitratifractor salsuginis* DSM 16511 gi\|319957206\|ref\|YP_004168469.1\| | SEQ ID NO: 365 | 143 | 184 | 42 | 347 | 404 | 61 | 347 | 404 | 61 |
| *Rhodospirillum rubrum* ATCC 11170 gi\|83591793\|ref\|YP_425545.1\| | SEQ ID NO: 366 | 139 | 180 | 42 | 314 | 371 | 55 | 314 | 371 | 55 |
| *Clostridium cellulolyticum* H10 gi\|220930482\|ref\|YP_002507391.1\| | SEQ ID NO: 367 | 137 | 176 | 40 | 320 | 376 | 61 | 320 | 376 | 61 |

TABLE 28-continued

Amino Acid Sequence of Cas9 Orthologs

| Species/Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| *Helicobacter mustelae* 12198 gi\|291276265\|ref\|YP_003516037.1 | SEQ ID NO: 368 | 148 | 187 | 40 | 298 | 354 | 48 | 298 | 354 | 48 |
| *Ilyobacter polytropus* DSM 2926 gi\|310780384\|ref\|YP_003968716.1 | SEQ ID NO: 369 | 134 | 173 | 40 | 462 | 517 | 63 | 462 | 517 | 63 |
| *Sphaerochaeta globus* str. Buddy gi\|325972003\|ref\|YP_004248194.1 | SEQ ID NO: 370 | 163 | 202 | 40 | 335 | 389 | 45 | 335 | 389 | 45 |
| *Staphylococcus lugdunensis* M23590 gi\|315659848\|ref\|ZP_07912707.1 | SEQ ID NO: 371 | 128 | 167 | 40 | 337 | 391 | 57 | 337 | 391 | 57 |
| *Treponema* sp. JC4 gi\|384109266\|ref\|ZP_10010146.1 | SEQ ID NO: 372 | 144 | 183 | 40 | 328 | 382 | 63 | 328 | 382 | 63 |
| uncultured delta proteobacterium HF0070 07E19 gi\|297182908\|gb\|ADI19058.1\| | SEQ ID NO: 373 | 154 | 193 | 40 | 313 | 365 | 55 | 313 | 365 | 55 |
| *Alicycliphilus denitrificans* K601 gi\|330822845\|ref\|YP_004386148.1 | SEQ ID NO: 374 | 140 | 178 | 39 | 317 | 366 | 48 | 317 | 366 | 48 |
| *Azospirillum* sp. B510 gi\|288957741\|ref\|YP_003448082.1 | SEQ ID NO: 375 | 205 | 243 | 39 | 342 | 389 | 46 | 342 | 389 | 46 |
| *Bradyrhizobium* sp. BTAi1 gi\|148255343\|ref\|YP_001239928.1 | SEQ ID NO: 376 | 143 | 181 | 39 | 323 | 370 | 48 | 323 | 370 | 48 |
| *Parvibaculum lavamentivorans* DS-1 gi\|154250555\|ref\|YP_001411379.1 | SEQ ID NO: 377 | 138 | 176 | 39 | 327 | 374 | 58 | 327 | 374 | 58 |
| *Prevotella timonensis* CRIS 5C-B1 gi\|282880052\|ref\|ZP_06288774.1 | SEQ ID NO: 378 | 170 | 208 | 39 | 328 | 375 | 61 | 328 | 375 | 61 |
| *Bacillus smithii* 7 3 47FAA gi\|365156657\|ref\|ZP_09352959.1 | SEQ ID NO: 379 | 134 | 171 | 38 | 401 | 448 | 63 | 401 | 448 | 63 |
| *Cand. Puniceispirillum marinum* IMCC1322 gi\|294086111\|ref\|YP_003552871.1 | SEQ ID NO: 380 | 135 | 172 | 38 | 344 | 391 | 53 | 344 | 391 | 53 |
| *Barnesiella intestinihominis* YIT 11860 gi\|404487228\|ref\|ZP_11022414.1 | SEQ ID NO: 381 | 140 | 176 | 37 | 371 | 417 | 60 | 371 | 417 | 60 |
| *Ralstonia syzygii* R24 gi\|344171927\|emb\|CCA84553.1\| | SEQ ID NO: 382 | 140 | 176 | 37 | 395 | 440 | 50 | 395 | 440 | 50 |
| *Wolinella succinogenes* DSM 1740 gi\|34557790\|ref\|NP_907605.1\| | SEQ ID NO: 383 | 145 | 180 | 36 | 348 | 392 | 60 | 348 | 392 | 60 |
| *Mycoplasma gallisepticum* str. F gi\|284931710\|gb\|ADC31648.1\| | SEQ ID NO: 384 | 144 | 177 | 34 | 373 | 416 | 71 | 373 | 416 | 71 |
| *Acidothermus cellulolyticus* 11B gi\|117929158\|ref\|YP_873709.1\| | SEQ ID NO: 385 | 150 | 182 | 33 | 341 | 380 | 58 | 341 | 380 | 58 |
| *Mycoplasma ovipneumoniae* SC01 gi\|363542550\|ref\|ZP_09312133.1 | SEQ ID NO: 386 | 156 | 184 | 29 | 381 | 420 | 62 | 381 | 420 | 62 |

TABLE 29

Amino Acid Sequence of Cas9 Core Domains

| Strain Name | Cas9 Start (AA pos) | Cas9 Stop (AA pos) |
|---|---|---|
| | Start and Stop numbers refer to the sequence in Table 28 | |
| *Staphylococcus Aureus* | 1 | 772 |
| *Streptococcus Pyogenes* | 1 | 1099 |
| *Campulobacter Jejuni* | 1 | 741 |

TABLE 30

Identified PAM sequences and corresponding RKR motifs.

| Strain Name | PAM sequence (NA) | RKR motif (AA) |
|---|---|---|
| *Streptococcus pyogenes* | NGG | RKR |
| *Streptococcus mutans* | NGG | RKR |
| *Streptococcus thermophilus* A | NGGNG | RYR |
| *Treponema denticola* | NAAAAN | VAK |
| *Streptococcus thermophilus* B | NNAAAAW | IYK |
| *Campylobacter jejuni* | NNNNACA | NLK |
| *Pasteurella multocida* | GNNNCNNA | KDG |
| *Neisseria meningitidis* | NNNNGATT or | IGK |
| *Staphylococcus aureus* | NNGRRV (R = A or G; V = A, G or C) NNGRRT (R = A or G) | NDK |

PI domains are provided in Tables 31 and 32.

TABLE 31

Altered PI Domains

| Strain Name | PI Start (AA pos) Start and Stop numbers refer to the sequences in Table 28 | PI Stop (AA pos) | Length of PI (AA) | RKR motif (AA) |
|---|---|---|---|---|
| Alicycliphilus denitrificans K601 | 837 | 1029 | 193 | --Y |

TABLE 31-continued

Altered PI Domains

| Strain Name | PI Start (AA pos) Start and Stop numbers refer to the sequences in Table 28 | PI Stop (AA pos) | Length of PI (AA) | RKR motif (AA) |
|---|---|---|---|---|
| Campylobacter jejuni NCTC 11168 | 741 | 984 | 244 | -NG |
| Helicobacter mustelae 12198 | 771 | 1024 | 254 | -NQ |

TABLE 32

Other Altered PI Domains

| Strain Name | PI Start (AA pos) Start and Stop numbers refer to the sequences in Table 28 | PI Stop (AA pos) | Length of PI (AA) | RKR motif (AA) |
|---|---|---|---|---|
| Akkermansia muciniphila ATCC BAA-835 | 871 | 1101 | 231 | ALK |
| Ralstonia syzygii R24 | 821 | 1062 | 242 | APY |
| Cand. Puniceispirillum marinum IMCC1322 | 815 | 1035 | 221 | AYK |
| Fructobacillus fructosus KCTC 3544 | 1074 | 1323 | 250 | DGN |
| Eubacterium yurii ATCC 43715 | 1107 | 1391 | 285 | DGY |
| Eubacterium dolichum DSM 3991 | 779 | 1096 | 318 | DKK |
| Dinoroseobacter shibae DFL 12 | 851 | 1079 | 229 | DPI |
| Clostridium cellulolyticum H10 | 767 | 1021 | 255 | EGK |
| Pasteurella multocida str. Pm70 | 815 | 1056 | 242 | ENN |
| Mycoplasma canis PG 14 | 907 | 1233 | 327 | EPK |
| Porphyromonas sp. oral taxon 279 str. F0450 | 935 | 1197 | 263 | EPT |
| Filifactor alocis ATCC 35896 | 1094 | 1365 | 272 | EVD |
| Aminomonas paucivorans DSM 12260 | 801 | 1052 | 252 | EVY |
| Wolinella succinogenes DSM 1740 | 1034 | 1409 | 376 | EYK |
| Oenococcus kitaharae DSM 17330 | 1119 | 1389 | 271 | GAL |
| Coriobacteriumglomerans PW2 | 1126 | 1384 | 259 | GDR |
| Peptoniphilus duerdenii ATCC BAA-1640 | 1091 | 1364 | 274 | GDS |
| Bifidobacterium bifidum S17 | 1138 | 1420 | 283 | GGL |
| Alicyclobacillus hesperidum URH17-3-68 | 876 | 1146 | 271 | GGR |
| Roseburia inulinivorans DSM 16841 | 895 | 1152 | 258 | GGT |
| Actinomyces coleocanis DSM 15436 | 843 | 1105 | 263 | GKK |
| Odoribacter laneus YIT 12061 | 1103 | 1498 | 396 | GKV |
| Coprococcus catus GD-7 | 1063 | 1338 | 276 | GNQ |
| Enterococcus faecalis TX0012 | 829 | 1150 | 322 | GRK |
| Bacillus smithii 7 3 47FAA | 809 | 1088 | 280 | GSK |
| Legionella pneumophila str. Paris | 1021 | 1372 | 352 | GTM |

TABLE 32-continued

Other Altered PI Domains

| Strain Name | PI Start (AA pos) Start and Stop numbers refer to the sequences in Table 28 | PI Stop (AA pos) | Length of PI (AA) | RKR motif (AA) |
|---|---|---|---|---|
| Bacteroides fragilis NCTC 9343 | 1140 | 1436 | 297 | IPV |
| Mycoplasma ovipneumoniae SC01 | 923 | 1265 | 343 | IRI |
| Actinomyces sp. oral taxon 180 str. F0310 | 895 | 1181 | 287 | KEK |
| Treponema sp. JC4 | 832 | 1062 | 231 | KIS |
| Fusobacteriumnucleatum ATCC49256 | 1073 | 1374 | 302 | KKV |
| Lactobacillus farciminis KCTC 3681 | 1101 | 1356 | 256 | KKV |
| Nitratifractor salsuginis DSM 16511 | 840 | 1132 | 293 | KMR |
| Lactobacillus coryniformis KCTC 3535 | 850 | 1119 | 270 | KNK |
| Mycoplasma mobile 163K | 916 | 1236 | 321 | KNY |
| Flavobacterium branchiophilum FL-15 | 1182 | 1473 | 292 | KQK |
| Prevotella timonensis CRIS 5C-B1 | 957 | 1218 | 262 | KQQ |
| Methylosinus trichosporium OB3b | 830 | 1082 | 253 | KRP |
| Prevotella sp. C561 | 1099 | 1424 | 326 | KRY |
| Mycoplasma gallisepticum str. F | 911 | 1269 | 359 | KTA |
| Lactobacillus rhamnosus GG | 1077 | 1363 | 287 | KYG |
| Wolinella succinogenes DSM 1740 | 811 | 1059 | 249 | LPN |
| Streptococcus thermophilus LMD-9 | 1099 | 1388 | 290 | MLA |
| Treponema denticola ATCC 35405 | 1092 | 1395 | 304 | NDS |
| Bergeyella zoohelcum ATCC 43767 | 1098 | 1415 | 318 | NEK |
| Veillonella atypica ACS-134-V-Col7a | 1107 | 1398 | 292 | NGF |
| Neisseria meningitidis Z2491 | 835 | 1082 | 248 | NHN |
| Ignavibacterium album JCM 16511 | 1296 | 1688 | 393 | NKK |
| Ruminococcus albus 8 | 853 | 1156 | 304 | NNF |
| Streptococcus thermophilus LMD-9 | 811 | 1121 | 311 | NNK |
| Barnesiella intestinihominis YIT 11860 | 871 | 1153 | 283 | NPV |
| Azospirillum sp. B510 | 911 | 1168 | 258 | PFH |
| Rhodospirillum rubrum ATCC 11170 | 863 | 1173 | 311 | PRG |
| Planococcus antarcticus DSM 14505 | 1087 | 1333 | 247 | PYY |
| Staphylococcus pseudintermedius ED99 | 1073 | 1334 | 262 | QIV |
| Alcanivorax sp. W11-5 | 843 | 1113 | 271 | RIE |
| Bradyrhizobium sp. BTAi1 | 811 | 1064 | 254 | RIY |
| Streptococcus pyogenes MI GAS | 1099 | 1368 | 270 | RKR |
| Streptococcus mutans UA159 | 1078 | 1345 | 268 | RKR |
| Streptococcus Pyogenes | 1099 | 1368 | 270 | RKR |
| Bacteroides sp. 20_3 | 1147 | 1517 | 371 | RNI |
| S. aureus | 772 | 1053 | 282 | RNK |

TABLE 32-continued

Other Altered PI Domains

| Strain Name | PI Start (AA pos) Start and Stop numbers refer to the sequences in Table 28 | PI Stop (AA pos) | Length of PI (AA) | RKR motif (AA) |
|---|---|---|---|---|
| Solobacterium moorei F0204 | 1062 | 1327 | 266 | RSG |
| Finegoldia magna ATCC 29328 | 1081 | 1348 | 268 | RTE |
| uncultured delta proteobacterium HF0070 07E19 | 770 | 1011 | 242 | SGG |
| Acidaminococcus sp. D21 | 1064 | 1358 | 295 | SIG |
| Eubacterium rectale ATCC 33656 | 824 | 1114 | 291 | SKK |
| Caenispirillum salinarum AK4 | 1048 | 1442 | 395 | SLV |
| Acidothermus cellulolyticus 11B | 830 | 1138 | 309 | SPS |
| Catenibacterium mitsuokai DSM 15897 | 1068 | 1329 | 262 | SPT |
| Parvibaculum lavamentivorans DS-1 | 827 | 1037 | 211 | TGN |
| Staphylococcus lugdunensis M23590 | 772 | 1054 | 283 | TKK |
| Streptococcus sanguinis SK49 | 1123 | 1421 | 299 | TRM |
| Elusimicrobium minutum Pei191 | 910 | 1195 | 286 | TTG |
| Nitrobacter hamburgensis X14 | 914 | 1166 | 253 | VAY |
| Mycoplasma synoviae 53 | 991 | 1314 | 324 | VGF |
| Sphaerochaeta globus str. Buddy | 877 | 1179 | 303 | VKG |
| Ilyobacter polytropus DSM 2926 | 837 | 1092 | 256 | VNG |
| Rhodovulum sp. PH10 | 821 | 1059 | 239 | VPY |
| Bifidobacterium longum DJO10A | 904 | 1187 | 284 | VRK |

Amino Acid Sequences Described in Table 28:

SEQ ID NO: 304

MKRNYILGLDIGITSVGYGIIDYETRDVIDAGVRLFKEANVENNEGRRSKRGARRLKRRRRHRI
QRVKKLLFDYNLLTDHSELSGINPYEARVKGLSQKLSEEEFSAALLHLAKRRGVHNVNEVEEDT
GNELSTKEQISRNSKALEEKYVAELQLERLKKDGEVRGSINRFKTSDYVKEAKQLLKVQKAYHQ
LDQSFIDTYIDLLETRRTYYEGPGEGSPFGWKDIKEWYEMLMGHCTYFPEELRSVKYAYNADLY
NALNDLNNLVITRDENEKLEYYEKFQIIENVFKQKKKPTLKQIAKEILVNEEDIKGYRVTSTGK
PEFTNLKVYHDIKDITARKEIIENAELLDQIAKILTIYQSSEDIQEELTNLNSELTQEEIEQIS
NLKGYTGTHNLSLKAINLILDELWHTNDNQIAIFNRLKLVPKKVDLSQQKEIPTTLVDDFILSP
VVKRSFIQSIKVINAIIKKYGLPNDIIIELAREKNSKDAQKMINEMQKRNRQTNERIEEIIRTT
GKENAKYLIEKIKLHDMQEGKCLYSLEAIPLEDLLNNPFNYEVDHIIPRSVSFDNSFNNKVLVK
QEENSKKGNRTPFQYLSSSDSKISYETFKKHILNLAKGKGRISKTKKEYLLEERDINRFSVQKD
FINRNLVDTRYATRGLMNLLRSYFRVNNLDVKVKSINGGFTSFLRRKWKFKKERNKGYKHHAED
ALIIANADFIFKEWKKLDKAKKVMENQMFEEKQAESMPEIETEQEYKEIFITPHQIKHIKDFKD
YKYSHRVDKKPNRELINDTLYSTRKDDKGNTLIVNNLNGLYDKDNDKLKKLINKSPEKKLMYHH
DPQTYQKLKLIMEQYGDEKNPLYKYYEETGNYLTKYSKKDNGPVIKKIKYYGNKLNAHLDITDD

-continued

YPNSRNKVVKLSLKPYRFDVYLDNGVYKFVTVKNLDVIKKENYYEVNSKCYEEAKKLKKISNQA

EFIASFYNNDLIKINGELYRVIGVNNDLLNRIEVNMIDITYREYLENMNDKRPPRIIKTIASKT

QSIKKYSTDILGNLYEVKSKKHPQIIKKG

SEQ ID NO: 305

MDKKYSIGLDIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD

SEQ ID NO: 306

MARILAFDIGISSIGWAFSENDELKDCGVRIFTKVENPKTGESLALPRRLARSARKRLARRKAR

LNHLKHLIANEFKLNYEDYQSFDESLAKAYKGSLISPYELRFRALNELLSKQDFARVILHIAKR

RGYDDIKNSDDKEKGAILKAIQNEEKLANYQSVGEYLYKEYFQKFKENSKEFTNVRNKKESYE

RCIAQSFLKDELKLIFKKQREFGFSFSKKFEEEVLSVAFYKRALKDFSHLVGNCSFFTDEKRAP

KNSPLAFMFVALTRIINLLNNLKNTEGILYTKDDLNALLNEVLKNGTLTYKQTKKLLGLSDDYE

FKGEKGTYFIEFKKYKEFIKALGEHNLSQDDLNEIAKDITLIKDEIKLKKALAKYDLNQNQIDS

LSKLEFKDHLNISFKALKLVTPLMLEGKKYDEACNELNLKVAINEDKKDFLPAFNETYYKDEVT

NPVVLRAIKEYRKVLNALLKKYGKVHKINIELAREVGKNHSQRAKIEKEQNENYKAKKDAELEC

EKLGLKINSKNILKLRLFKEQKEFCAYSGEKIKISDLQDEKMLEIDHIYPYSRSFDDSYMNKVL

VFTKQNQEKLNQTPFEAFGNDSAKWQKIEVLAKNLPTKKQKRILDKNYKDKEQKNFKDRNLNDT

RYIARLVLNYTKDYLDFLPLSDDENTKLNDTQKGSKVHVEAKSGMLTSALRHTWGFSAKDRNNH

LHHAIDAVIIAYANNSIVKAFSDFKKEQESNSAELYAKKISELDYKNKRKFFEPFSGFRQKVLD

KIDEIFVSKPERKKPSGALHEETFRKEEEFYQSYGGKEGVLKALELGKIRKVNGKIVKNGDMFR

VDIFKHKKTNKFYAVPIYTMDFALKVLPNKAVARSKKGEIKDWILMDENYEFCFSLYKDSLILI

-continued

QTKDMQEPEFVYYNAFTSSTVSLIVSKHDNKFETLSKNQKILFKNANEKEVIAKSIGIQNLKVF

EKYIVSALGEVTKAEFRQREDFKK

SEQ ID NO: 307

MKRILGLDLGTNSIGWALVNEAENKDERSSIVKLGVRVNPLTVDELTNFEKGKSITTNADRTLK

RGMRRNLQRYKLRRETLTEVLKEHKLITEDTILSENGNRTTFETYRLRAKAVTEEISLEEFARV

LLMINKKRGYKSSRKAKGVEEGTLIDGMDIARELYNNNLTPGELCLQLLDAGKKFLPDFYRSDL

QNELDRIWEKQKEYYPEILTDVLKEELRGKKRDAVWAICAKYFVWKENYTEWNKEKGKTEQQER

EHKLEGIYSKRKRDEAKRENLQWRVNGLKEKLSLEQLVIVFQEMNTQINNSSGYLGAISDRSKE

LYFNKQTVGQYQMEMLDKNPNASLRNMVFYRQDYLDEFNMLWEKQAVYHKELTEELKKEIRDII

IPFYQRRLKSQKGLIGFCEFESRQIEVDIDGKKKIKTVGNRVISRSSPLFQEFKIWQILNNIEVT

VVGKKRKRRKLKENYSALFEELNDAEQLELNGSRRLCQEEKELLAQELFIRDKMTKSEVLKLLF

DNPQELDLNFKTIDGNKTGYALFQAYSKMIEMSGHEPVDFKKPVEKVVEYIKAVFDLLNWNTDI

LGFNSNEELDNQPYYKLWHLLYSFEGDNTPTGNGRLIQKMTELYGFEKEYATILANVSFQDDYG

SLSAKAIHKILPHLKEGNRYDVACVYAGYRHSESSLTREEIANKVLKDRLMLLPKNSLHNPVVE

KILNQMVNVINVIIDIYGKPDEIRVELARELKKNAKEREELTKSIAQTTKAHEEYKTLLQTEFG

LTNVSRTDILRYKLYKELESCGYKTLYSNTYISREKLFSKEFDIEHIIPQARLFDDSFSNKTLE

ARSVNIEKGNKTAYDFVKEKFGESGADNSLEHYLNNIEDLFKSGKISKTKYNKLKMAEQDIPDG

FIERDLRNTQYIAKKALSMLNEISHRVVATSGSVTDKLREDWQLIDVMKELNWEKYKALGLVEY

FEDRDGRQIGRIKDWTKRNDHRHHAMDALTVAFTKDVFIQYFNNKNASLDPNANEHAIKNKYFQ

NGRAIAPMPLREFRAEAKKHLENTLISIKAKNKVITGNINKTRKKGGVNKNMQQTPRGQLHLET

IYGSGKQYLTKEEKVNASFDMRKIGTVSKSAYRDALLKRLYENDNDPKKAFAGKNSLDKQPIWL

DKEQMRKVPEKVKIVTLEAIYTIRKEISPDLKVDKVIDVGVRKILIDRLNEYGNDAKKAFSNLD

KNPIWLNKEKGISIKRVTISGISNAQSLHVKKDKDGKPILDENGRNIPVDFVNTGNNHHVAVYY

RPVIDKRGQLVVDEAGNPKYELEEVVVSFFEAVTRANLGLPIIDKDYKTTEGWQFLFSMKQNEY

FVFPNEKTGFNPKEIDLLDVENYGLISPNLFRVQKFSLKNYVFRHHLETTIKDTSSILRGITWI

DFRSSKGLDTIVKVRVNHIGQIVSVGEY

SEQ ID NO: 308
MSRKNYVDDYAISLDIGNASVGWSAFTPNYRLVRAKGHELIGVRLFDPADTAESRRMARTTRRR

YSRRRWRLRLLDALFDQALSEIDPSFLARRKYSWVHPDDENNADCWYGSVLFDSNEQDKRFYEK

YPTIYHLRKALMEDDSQHDIREIYLAIHHMVKYRGNFLVEGTLESSNAFKEDELLKLLGRITRY

EMSEGEQNSDIEQDDENKLVAPANGQLADALCATRGSRSMRVDNALEALSAVNDLSREQRAIVK

AIFAGLEGNKLDLAKIFVSKEFSSENKKILGIYFNKSDYEEKCVQIVDSGLLDDEEREFLDRMQ

GQYNAIALKQLLGRSTSVSDSKCASYDAHRANWNLIKLQLRTKENEKDINENYGILVGWKIDSG

QRKSVRGESAYENMRKKANVFFKKMIETSDLSETDKNRLIHDIEEDKLFPIQRDSDNGVIPHQL

HQNELKQIIKKQGKYYPFLLDAFEKDGKQINKIEGLLTFRVPYFVGPLVVPEDLQKSDNSENHW

MVRKKKGEITPWNFDEMVDKDASGRKFIERLVGTDSYLLGEPTLPKNSLLYQEYEVLNELNNVR

LSVRTGNHWNDKRRMRLGREEKTLLCQRLFMKGQTVTKRTAENLLRKEYGRTYELSGLSDESKF

TSSLSTYGKMCRIFGEKYVNEHRDLMEKIVELQTVFEDKETLLHQLRQLEGISEADCALLVNTH

YTGWGRLSRKLLTTKAGECKISDDFAPRKHSIIEIMRAEDRNLMEIITDKQLGFSDWIEQENLG

AENGSSLMEVVDDLRVSPKVKRGIIQSIRLIDDISKAVGKRPSRIFLELADDIQPSGRTISRKS

RLQDLYRNANLGKEFKGIADELNACSDKDLQDDRLFLYYTQLGKDMYTGEELDLDRLSSAYDID

-continued

HIIPQAVTQNDSIDNRVLVARAENARKTDSFTYMPQIADRMRNFWQILLDNGLISRVKFERLTR

QNEFSEREKERFVQRSLVETRQIMKNVATLMRQRYGNSAAVIGLNAELTKEMHRYLGFSHKNRD

INDYHHAQDALCVGIAGQFAANRGFFADGEVSDGAQNSYNQYLRDYLRGYREKLSAEDRKQGRA

FGFIVGSMRSQDEQKRVNPRTGEVVWSEEDKDYLRKVMNYRKMLVTQKVGDDFGALYDETRYAA

TDPKGIKGIPFDGAKQDTSLYGGFSSAKPAYAVLIESKGKTRLVNVTMQEYSLLGDRPSDDELR

KVLAKKKSEYAKANILLRHVPKMQLIRYGGGLMVIKSAGELNNAQQLWLPYEEYCYFDDLSQGK

GSLEKDDLKKLLDSILGSVQCLYPWHRFTEEELADLHVAFDKLPEDEKKNVITGIVSALHADAK

TANLSIVGMTGSWRRMNNKSGYTFSDEDEFIFQSPSGLFEKRVTVGELKRKAKKEVNSKYRTNE

KRLPTLSGASQP

SEQ ID NO: 309
METQTSNQLITSHLKDYPKQDYFVGLDIGTNSVGWAVTNTSYELLKFHSHKMWGSRLFEEGESA

VTRRGFRSMRRRLERRKLRLKLLEELFADAMAQVDSTFFIRLHESKYHYEDKTTGHSSKHILFI

DEDYTDQDYFTEYPTIYHLRKDLMENGTDDIRKLFLAVHHILKYRGNFLYEGATFNSNAFTFED

VLKQALVNITFNCFDTNSAISSISNILMESGKTKSDKAKAIERLVDTYTVFDEVNTPDKPQKEQ

VKEDKKTLKAFANLVLGLSANLIDLFGSVEDIDDDLKKLQIVGDTYDEKRDELAKVWGDEIHII

DDCKSVYDAIILMSIKEPGLTISQSKVKAFDKHKEDLVILKSLLKLDRNVYNEMFKSDKKGLHN

YVHYIKQGRTEETSCSREDFYKYTKKIVEGLADSKDKEYILNEIELQTLLPLQRIKDNGVIPYQ

LHLEELKVILDKCGPKFPFLHTVSDGFSVTEKLIKMLEFRIPYYVGPLNTHHNIDNGGFSWAVR

KQAGRVTPWNFEEKIDREKSAAAFIKNLTNKCTYLFGEDVLPKSSLLYSEFMLLNELNNVRIDG

KALAQGVKQHLIDSIFKQDHKKMTKNRIELFLKDNNYITKKHKPEITGLDGEIKNDLTSYRDMV

RILGNNFDVSMAEDIITDITIFGESKKMLRQTLRNKFGSQLNDETIKKLSKLRYRDWGRLSKKL

LKGIDGCDKAGNGAPKTIIELMRNDSYNLMEILGDKFSFMECIEEENAKLAQGQVVNPHDIIDE

LALSPAVKRAVWQALRIVDEVAHIKKALPSRIFVEVARTNKSEKKKKDSRQKRLSDLYSAIKKD

DVLQSGLQDKEFGALKSGLANYDDAALRSKKLYLYYTQMGRCAYTGNIIDLNQLNTDNYDIDHI

YPRSLTKDDSFDNLVLCERTANAKKSDIYPIDNRIQTKQKPFWAFLKHQGLISERKYERLTRIA

PLTADDLSGFIARQLVETNQSVKATTTLLRRLYPDIDVVFVKAENVSDFRHNNNFIKVRSLNHH

HHAKDAYLNIVVGNVYHEKFTRNFRLFFKKNGANRTYNLAKMFNYDVICTNAQDGKAWDVKTSM

NTVKKMMASNDVRVTRRLLEQSGALADATIYKASVAAKAKDGAYIGMKTKYSVFADVTKYGGMT

KIKNAYSIIVQYTGKKGEEIKEIVPLPIYLINRNATDIELIDYVKSVIPKAKDISIKYRLCIN

QLVKVNGFYYYLGGKTNDKIYIDNAIELVVPHDIATYIKLLDKYDLLRKENKTLKASSITTSIY

NINTSTVVSLNKVGIDVFDYFMSKLRTPLYMKMKGNKVDELSSTGRSKFIKMTLEEQSIYLLEV

LNLLTNSKTTFDVKPLGITGSRSTIGVKIHNLDEFKIINESITGLYSNEVTIV

SEQ ID NO: 310
MTKLNQPYGIGLDIGSNSIGFAVVDANSHLLRLKGETAIGARLFREGQSAADRRGSRTTRRRLS

RTRWRLSFLRDFFAPHITKIDPDFFLRQKYSEISPKDKDRFKYEKRLFNDRTDAEFYEDYPSMY

HLRLHLMTHTHKADPREIFLAIHHILKSRGHFLTPGAAKDFNTDKVDLEDIFPALTEAYAQVYP

DLELTFDLAKADDFKAKLLDEQATPSDTQKALVNLLLSSDGEKEIVKKRKQVLTEFAKAITGLK

TKFNLALGTEVDEADASNWQFSMGQLDDKWSNIETSMTDQGTEIFEQIQELYRARLLNGIVPAG

MSLSQAKVADYGQHKEDLELFKTYLKKLNDHELAKTIRGLYDRYINGDDAKPFLREDFVKALTK

EVTAHPNEVSEQLLNRMGQANFMLKQRTKANGAIPIQLQQRELDQIIANQSKYYDWLAAPNPVE

AHRWKMPYQLDELLNFHIPYYVGPLITPKQQAESGENVFAWMVRKDPSGNITPYNFDEKVDREA

SANTFIQRMKTTDTYLIGEDVLPKQSLLYQKYEVLNELNNVRINNECLGTDQKQRLIREVFERH

-continued

SSVTIKQVADNLVAHGDFARRPEIRGLADEKRFLSSLSTYHQLKEILHEAIDDPTKLLDIENII
TWSTVFEDHTIFETKLAEIEWLDPKKINELSGIRYRGWGQFSRKLLDGLKLGNGHTVIQELMLS
NHNLMQILADETLKETMTELNQDKLKTDDIEDVINDAYTSPSNKKALRQVLRVVEDIKHAANGQ
DPSWLFIETADGTGTAGKRTQSRQKQIQTVYANAAQELIDSAVRGELEDKIADKASFTDRLVLY
FMQGGRDIYTGAPLNIDQLSHYDIDHILPQSLIKDDSLDNRVLVNATINREKNNVFASTLFAGK
MKATWRKWHEAGLISGRKLRNLMLRPDEIDKFAKGFVARQLVETRQIIKLTEQIAAAQYPNTKI
IAVKAGLSHQLREELDFPKNRDVNHYHHAFDAFLAARIGTYLLKRYPKLAPFFTYGEFAKVDVK
KFREFNFIGALTHAKKNIIAKDTGEIVWDKERDIRELDRIYNFKRMLITHEVYFETADLFKQTI
YAAKDSKERGGSKQLIPKKQGYPTQVYGGYTQESGSYNALVRVAEADTTAYQVIKISAQNASKI
ASANLKSREKGKQLLNEIVVKQLAKRRKNWKPSANSFKIVIPRFGMGTLFQNAKYGLFMVNSDT
YYRNYQELWLSRENQKLLKKLFSIKYEKTQMNHDALQVYKAIIDQVEKFFKLYDINQFRAKLSD
AIERFEKLPINTDGNKIGKTETLRQILIGLQANGTRSNVKNLGIKTDLGLLQVGSGIKLDKDTQ
IVYQSPSGLFKRRIPLADL

SEQ ID NO: 311

MTKEYYLGLDVGTNSVGWAVTDSQYNLCKFKKKDMWGIRLFESANTAKDRRLQRGNRRRLERKK
QRIDLLQEIFSPEICKIDPTFFIRLNESRLHLEDKSNDFKYPLFIEKDYSDIEYYKEFPTIFHL
RKHLIESEEKQDIRLIYALHNIIKTRGHFLIDGDLQSAKQLRPILDTFLLSLQEEQNLSVSLS
ENQKDEYEEILKNRSIAKSEKVKKLKNLFEISDELEKEEKKAQSAVIENFCKFIVGNKGDVCKF
LRVSKEELEIDSFSFSEGKYEDDIVKNLEEKVPEKVYLFEQMKAMYDWNILVDILETEEYISFA
KVKQYEKHKTNLRLLRDIILKYCTKDEYNRMFNDEKEAGSYTAYVGKLKKNNKKYWIEKKRNPE
EFYKSLGKLLDKIEPLKEDLEVLTMMIEECKNHTLLPIQKNKDNGVIPHQVHEVELKKILENAK
KYYSFLTETDKDGYSVVQKIESIFRFRIPYYVGPLSTRHQEKGSNVWMVRKPGREDRIYPWNME
EIIDFEKSNENFITRMTNKCTYLIGEDVLPKHSLLYSKYMVLNELNNVKVRGKKLPTSLKQKVF
EDLFENKSKVTGKNLLEYLQIQDKDIQIDDLSGFDKDFKTSLKSYLDFKKQIFGEEIEKESIQN
MIEDIIKWITIYGNDKEMLKRVIRANYSNQLTEEQMKKITGFQYSGWGNFSKMFLKGISGSDVS
TGETFDIITAMWETDNNLMQILSKKFTFMDNVEDFNSGKVGKIDKITYDSTVKEMFLSPENKRA
VWQTIQVAEEIKKVMGCEPKKIFIEMARGGEKVKKRTKSRKAQLLELYAACEEDCRELIKEIED
RDERDFNSMKLFLYYTQFGKCMYSGDDIDINELIRGNSKWDRDHIYPQSKIKDDSIDNLVLVNK
TYNAKKSNELLSEDIQKKMHSFWLSLLNKKLITKSKYDRLTRKGDFTDEELSGFIARQLVETRQ
STKAIADIFKQIYSSEVVYVKSSLVSDFRKKPLNYLKSRRVNDYHHAKDAYLNIVVGNVYNKKF
TSNPIQWMKKNRDTNYSLNKVFEHDVVINGEVIWEKCTYHEDTNTYDGGTLDRIRKIVERDNIL
YTEYAYCEKGELFNATIQNKNGNSTVSLKKGLDVKKYGGYFSANTSYFSLIEFEDKKGDRARHI
IGVPIYIANMLEHSPSAFLEYCEQKGYQNVRILVEKIKKNSLLIINGYPLRIRGENEVDTSFKR
AIQLKLDQKNYELVRNIEKFLEKYVEKKGNYPIDENRDHITHEKMNQLYEVLLSKMKKFNKKGM
ADPSDRIEKSKPKFIKLEDLIDKINVINKMLNLLRCDNDTKADLSLIELPKNAGSFVVKKNTIG
KSKIILVNQSVTGLYENRREL

SEQ ID NO: 312

MARDYSVGLDIGTSSVGWAAIDNKYHLIRAKSKNLIGVRLFDSAVTAEKRRGYRTTRRRLSRRH
WRLRLLNDIFAGPLTDFGDENFLARLKYSWVHPQDQSNQAHFAAGLLFDSKEQDKDFYRKYPTI
YHLRLALMNDDQKHDLREVYLAIHHLVKYRGHFLIEGDVKADSAFDVHTFADAIQRYAESNNSD
ENLLGKIDEKKLSAALTDKHGSKSQRAETAETAFDILDLQSKKQIQAILKSVVGNQANLMAIFG

-continued

LDSSAISKDEQKNYKFSFDDADIDEKIADSEALLSDTEFEFLCDLKAAFDGLTLKMLLGDDKTV

SAAMVRRFNEHQKDWEYIKSHIRNAKNAGNGLYEKSKKFDGINAAYLALQSDNEDDRKKAKKIF

QDEISSADIPDDVKADFLKKIDDDQFLPIQRTKNNGTIPHQLHRNELEQIIEKQGIYYPFLKDT

YQENSHELNKITALINFRVPYYVGPLVEEEQKIADDGKNIPDPTNHWMVRKSNDTITPWNLSQV

VDLDKSGRRFIERLTGTDTYLIGEPTLPKNSLLYQKFDVLQELNNIRVSGRRLDIRAKQDAFEH

LFKVQKTVSATNLKDFLVQAGYISEDTQIEGLADVNGKNFNNALTTYNYLVSVLGREFVENPSN

EELLEEITELQTVFEDKKVLRRQLDQLDGLSDHNREKLSRKHYTGWGRISKKLLTTKIVQNADK

IDNQTFDVPRMNQSIIDTLYNTKMNLMEIINNAEDDFGVRAWIDKQNTTDGDEQDVYSLIDELA

GPKEIKRGIVQSFRILDDITKAVGYAPKRVYLEFARKTQESHLTNSRKNQLSTLLKNAGLSELV

TQVSQYDAAALQNDRLYLFLQQGKDMYSGEKLNLDNLSNYDIDHIIPQAYTKDNSLDNRVLVS

NITNRRKSDSSNYLPALIDKMRPFWSVLSKQGLLSKHKFANLTRTRDFDDMEKERFIARSLVET

RQIIKNVASLIDSHFGGETKAVAIRSSLTADMRRYVDIPKNRDINDYHHAFDALLFSTVGQYTE

NSGLMKKGQLSDSAGNQYNRYIKEWIHAARLNAQSQRVNPFGFVVGSMRNAAPGKLNPETGEIT

PEEENADWSIADLDYLHKVMNFRKITVTRRLKDQKGQLYDESRYPSVLHDAKSKASINFDKHKPV

DLYGGFSSAKPAYAALIKFKNKFRLVNVLRQWTYSDKNSEDYILEQIRGKYPKAEMVLSHIPYG

QLVKKDGALVTISSATELHNFEQLWLPLADYKLINTLLKTKEDNLVDILHNRLDLPEMTIESAF

YKAFDSILSFAFNRYALHQNALVKLQAHRDDFNALNYEDKQQTLERILDALHASPASSDLKKIN

LSSGFGRLFSPSHFTLADTDEFIFQSVTGLFSTQKTVAQLYQETK

SEQ ID NO: 313
MVYDVGLDIGTGSVGWVALDENGKLARAKGKNLVGVRLFDTAQTAADRRGFRTTRRRLSRRKWR

LRLLDELFSAEINEIDSSFFQRLKYSYVHPKDEENKAHYYGGYLFPTEEETKKFHRSYPTIYHL

RQELMAQPNKRFDIREIYLAIHHLVKYRGHFLSSQEKITIGSTYNPEDLANAIEVYADEKGLSW

ELNNPEQLTEIISGEAGYGLNKSMKADEALKLFEFDNNQDKVAIKTLLAGLTGNQIDFAKLFGK

DISDKDEAKLWKLKLDDEALEEKSQTILSQLTDEEIELFHAVVQAYDGFVLIGLLNGADSVSAA

MVQLYDQHREDRKLLKSLAQKAGLKHKRFSEIYEQLALATDEATIKNGISTARELVEESNLSKE

VKEDTLRRLDENEFLPKQRTKANSVIPHQLHLAELQKILQNQGQYYPFLLDTFEKEDGQDNKIE

ELLRFRIPYYVGPLVTKKDVEHAGGDADNHWVERNEGFEKSRVTPWNFDKVFNRDKAARDFIER

LTGNDTYLIGEKTLPQNSLRYQLFTVLNELNNVRVNGKKFDSKTKADLINDLFKARKTVSLSAL

KDYLKAQGKGDVTITGLADESKFNSSLSSYNDLKKTFDAEYLENEDNQETLEKIIEIQTVFEDS

KIASRELSKLPLDDDQVKKLSQTHYTGWGRLSEKLLDSKIIDERGQKVSILDKLKSTSQNFMSI

INNDKYGVQAWITEQNTGSSKLTFDEKVNELTTSPANKRGIKQSFAVLNDIKKAMKEEPRRVYL

EFAREDQTSVRSVPRYNQLKEKYQSKSLSEEAKVLKKTLDGNKNKMSDDRYFLYFQQQGKDMYT

GRPINFERLSQDYDIDHIIPQAFTKDDSLDNRVLVSRPENARKSDSFAYTDEVQKQDGSLWTSL

LKSGFINRKKYERLTKAGKYLDGQKTGFIARQLVETRQIIKNVASLIEGEYENSKAVAIRSEIT

ADMRLLVGIKKHREINSFHHAFDALLITAAGQYMQNRYPDRDSTNVYNEFDRYTNDYLKNLRQL

SSRDEVRRLKSFGFVVGTMRKGNEDWSEENTSYLRKVMMFKNILTTKKTEKDRGPLNKETIFSP

KSGKKLIPLNSKRSDTALYGGYSNVYSAYMTLVRANGKNLLIKIPISIANQIEVGNLKINDYIV

NNPAIKKFEKILISKLPLGQLVNEDGNLIYLASNEYRHNAKQLWLSTTDADKIASISENSSDEE

LLEAYDILTSENVKNRFPFFKKDIDKLSQVRDEFLDSDKRIAVIQTILRGLQIDAAYQAPVKII

SKKVSDWHKLQQSGGIKLSDNSEMIYQSATGIFETRVKISDLL

SEQ ID NO: 314
IVDYCIGLDLGTGSVGWAVVDMNHRLMKRNGKHLWGSRLFSNAETAANRRASRSIRRRYNKRRE

-continued

RIRLLRAILQDMVLEKDPTFFIRLEHTSFLDEEDKAKYLGTDYKDNYNLFIDEDFNDYTYYHKY

PTIYHLRKALCESTEKADPRLIYLALHHIVKYRGNFLYEGQKFNMDASNIEDKLSDIFTQFTSF

NNIPYEDDEKKNLEILEILKKPLSKKAKVDEVMTLIAPEKDYKSAFKELVTGIAGNKMNVTKMI

LCEPIKQGDSEIKLKFSDSNYDDQFSEVEKDLGEYVEFVDALHNVYSWVELQTIMGATHTDNAS

ISEAMVSRYNKHHDDLKLLKDCIKNNVPNKYFDMFRNDSEKSKGYYNYINRPSKAPVDEFYKYV

KKCIEKVDTPEAKQILNDIELENFLLKQNSRTNGSVPYQMQLDEMIKIIDNQAEYYPILKEKRE

QLLSILTFRIPYYFGPLNETSEHAWIKRLEGKENQRILPWNYQDIVDVDATAEGFIKRMSYCT

YFPDEEVLPKNSLIVSKYEVYNELNKIRVDDKLLEVDVKNDIYNELFMKNKTVTEKKLKNWLVN

NQCCSKDAEIKGFQKENQFSTSLTPWIDFTNIFGKIDQSNFDLIENIIYDLTVFEDKKIMKRRL

KKKYALPDDKVKQILKLKYKDWSRLSKKLLDGIVADNRFGSSVTVLDVLEMSRLNLMEIINDKD

LGYAQMIEEATSCPEDGKFTYEEVERLAGSPALKRGIWQSLQIVEEITKVMKCRPKYIYIEFER

SEEAKERTESKIKKLENVYKDLDEQTKKEYKSVLEELKGFDNTKKISSDSLFLYFTQLGKCMYS

GKKLDIDSLDKYQIDHIVPQSLVKDDSFDNRVLVVPSENQRKLDDLVVPFDIRDKMYRFWKLLF

DHELISPKKFYSLIKTEYTERDEERFINRQLVETRQITKNVTQIIEDHYSTTKVAAIRANLSHE

FRVKNHIYKNRDINDYHHAHDAYIVALIGGFMRDRYPNMHDSKAVYSEYMKMFRKNKNDQKRWK

DGFVINSMNYPYEVDGKLIWNPDLINEIKKCFYYKDCYCTTKLDQKSGQLFNLTVLSNDAHADK

GVTKAVVPVNKNRSDVHKYGGFSGLQYTIVAIEGQKKKGKKTELVKKISGVPLHLKAASINEKI

NYIEEKEGLSDVRIIKDNIPVNQMIEMDGGEYLLTSPTEYVNARQLVLNEKQCALIADIYNAIY

KQDYDNLDDILMIQLYIELTNKMKVLYPAYRGIAEKFESMNENYVVISKEEKANIIKQMLIVMH

RGPQNGNIVYDDFKISDRIGRLKTKNHNLNNIVFISQSPTGIYTKKYKL

SEQ ID NO: 315
MKSEKKYYIGLDVGTNSVGWAVTDEFYNILRAKGKDLWGVRLFEKADTAANTRIFRSGRRRNDR

KGMRLQILREIFEDEIKKVDKDFYDRLDESKFWAEDKKVSGKYSLFNDKNFSDKQYFEKFPTIF

HLRKYLMEEHGKVDIRYYFLAINQMMKRRGHFLIDGQISHVTDDKPLKEQLILLINDLLKIELE

EELMDSIFEILADVNEKRTDKKNNLKELIKGQDFNKQEGNILNSIFESIVTGKAKIKNIISDED

ILEKIKEDNKEDFVLTGDSYEENLQYFEEVLQENITLFNTLKSTYDFLILQSILKGKSTLSDAQ

VERYDEHKKDLEILKKVIKKYDEDGKLFKQVFKEDNGNGYVSYIGYYLNKNKKITAKKKISNIE

FTKYVKGILEKQCDCEDEDVKYLLGKIEQENFLLKQISSINSVIPHQIHLFELDKILENLAKNY

PSFNNKKEEFTKIEKIRKTFTFRIPYYVGPLNDYHKNNGGNAWIFRNKGEKIRPWNFEKIVDLH

KSEEEFIKRMLNQCTYLPEETVLPKSSILYSEYMVLNELNNLRINGKPLDTDVKLKLIEELFKK

KTKVTLKSIRDYMVRNNFADKEDFDNSEKNLEIASNMKSYIDFNNILEDKFDVEMVEDLIEKIT

IHTGNKKLLKKYIEETYPDLSSSQIQKIINLKYKDWGRLSRKLLDGIKGTKKETEKTDTVINFL

RNSSDNLMQIIGSQNYSFNEYIDKLRKKYIPQEISYEVVENLYVSPSVKKMIWQVIRVTEEITK

VMGYDPDKIFIEMAKSEEEKKTTISRKNKLLDLYKAIKKDERDSQYEKLLTGLNKLDDSDLRSR

KLYLYYTQMGRDMYTGEKIDLDKLFDSTHYDKDHIIPQSMKKDDSIINNLVLVNKNANQTTKGN

IYPVPSSIRNNPKIYNYWKYLMEKEFISKEKYNRLIRNTPLTNEELGGFINRQLVETRQSTKAI

KELFEKFYQKSKIIPVKASLASDLRKDMNTLKSREVNDLHHAHDAFLNIVAGDVWNREFTSNPI

NYVKENREGDKVKYSLSKDFTRPRKSKGKVIWTPEKGRKLIVDTLNKPSVLISNESHVKKGELF

NATIAGKKDYKKGKIYLPLKKDDRLQDVSKYGGYKAINGAFFFLVEHTKSKKRIRSIELFPLHL

LSKFYEDKNTVLDYAINVLQLQDPKIIIDKINYRTEIIIDNFSYLISTKSNDGSITVKPNEQMY

WRVDEISNLKKIENKYKKDAILTEEDRKIMESYIDKIYQQFKAGKYKNRRTTDTIIEKYEIIDL

```
DTLDNKQLYQLLVAFISLSYKTSNNAVDFTVIGLGTECGKPRITNLPDNTYLVYKSITGIYEKR

IRIK
                                                    SEQ ID NO: 316
MKLRGIEDDYSIGLDMGTSSVGWAVTDERGTLAHFKRKPTWGSRLFREAQTAAVARMPRGQRRR

YVRRRWRLDLLQKLFEQQMEQADPDFFIRLRQSRLLRDDRAEEHADYRWPLFNDCKFTERDYYQ

RFPTIYHVRSWLMETDEQADIRLIYLALHNIVKHRGNFLREGQSLSAKSARPDEALNHLRETLR

VWSSERGFECSIADNGSILAMLTHPDLSPSDRRKKIAPLFDVKSDDAAADKKLGIALAGAVIGL

KTEFKNIFGDFPCEDSSIYLSNDEAVDAVRSACPDDCAELFDRLCEVYSAYVLQGLLSYAPGQT

ISANMVEKYRRYGEDLALLKKLVKIYAPDQYRMFFSGATYPGTGIYDAAQARGYTKYNLGPKKS

EYKPSESMQYDDFRKAVEKLFAKTDARADERYRMMMDRFDKQQFLRRLKTSDNGSIYHQLHLEE

LKAIVENQGRFYPFLKRDADKLVSLVSFRIPYYVGPLSTRNARTDQHGENRFAWSERKPGMQDE

PIFPWNWESIIDRSKSAEKFILRMTGMCTYLQQEPVLPKSSLLYEEFCVLNELNGAHWSIDGDD

EHRFDAADREGIIEELFRRKRTVSYGDVAGWMERERNQIGAHVCGGQGEKGFESKLGSYIFFCK

DVFKVERLEQSDYPMIERIILWNTLFEDRKILSQRLKEEYGSRLSAEQIKTICKKRFTGWGRLS

EKFLTGITVQVDEDSVSIMDVLREGCPVSGKRGRAMVMMEILRDEELGFQKKVDDFNRAFFAEN

AQALGVNELPGSPAVRRSLNQSIRIVDEIASIAGKAPANIFIEVTRDEDPKKKGRRTKRRYNDL

KDALEAFKKEDPELWRELCETAPNDMDERLSLYFMQRGKCLYSGRAIDIHQLSNAGIYEVDHII

PRTYVKDDSLENKALVYREENQRKTDMLLIDPEIRRRMSGYWRMLHEAKLIGDKKFRNLLRSRI

DDKALKGFIARQLVETGQMVKLVRSLLEARYPETNIISVKASISHDLRTAAELVKCREANDFHH

AHDAFLACRVGLFIQKRHPCVYENPIGLSQVVRNYVRQQADIFKRCRTIPGSSGFIVNSFMTSG

FDKETGEIFKDDWDAEAEVEGIRRSLNFRQCFISRMPFEDHGVFWDATIYSPRAKKTAALPLKQ

GLNPSRYGSFSREQFAYFFIYKARNPRKEQTLFEFAQVPVRLSAQIRQDENALERYARELAKDQ

GLEFIRIERSKILKNQLIEIDGDRLCITGKEEVRNACELAFAQDEMRVIRMLVSEKPVSRECVI

SLFNRILLHGDQASRRLSKQLKLALLSEAFSEASDNVQRNVVLGLIAIFNGSTNMVNLSDIGGS

KFAGNVRIKYKKELASPKVNVHLIDQSVTGMFERRTKIGL
                                                    SEQ ID NO: 317
MENKQYYIGLDVGTNSVGWAVTDTSYNLLRAKGKDMWGARLFEKANTAAERRTKRTSRRRSERE

KARKAMLKELFADEINRVDPSFFIRLEESKFFLDDRSENNRQRYTLFNDATFTDKDYYEKYKTI

FHLRSALINSDEKFDVRLVFLAILNLFSHRGHFLNASLKGDGDIQGMDVFYNDLVESCEYFEIE

LPRITNIDNFEKILSQKGKSRTKILEELSEELSISKKDKSKYNLIKLISGLEASVVELYNIEDI

QDENKKIKIGFRESDYEESSLKVKEIIGDEYFDLVERAKSVHDMGLLSNIIGNSKYLCEARVEA

YENHHKDLLKIKELLKKYDKKAYNDMFRKMTDKNYSAYVGSVNSNIAKERRSVDKRKIEDLYKY

IEDTALKNIPDDNKDKIEILEKIKLGEFLKKQLTASNGVIPNQLQSRELRAILKKAENYLPFLK

EKGEKNLTVSEMIIQLFEFQIPYYVGPLDKNPKKDNKANSWAKIKQGGRILPWNFEDKVDVKGS

RKEFIEKMVRKCTYISDEHTLPKQSLLYEKFMVLNEINNIKIDGEKISVEAKQKIYNDLFVKGK

KVSQKDIKKELISLNIMDKDSVLSGTDTVCNAYLSSIGKFTGVFKEEINKQSIVDMIEDIIFLK

TVYGDEKRFVKEEIVEKYGDEIDKDKIKRILGFKFSNWGNLSKSFLELEGADVGTGEVRSIIQS

LWETNFNLMELLSSRFTYMDELEKRVKKLEKPLSEWTIEDLDDMYLSSPVKRMIWQSMKIVDEI

QTVIGYAPKRIFVEMTRSEGEKVRTKSRKDRLKELYNGIKEDSKQWVKELDSKDESYFRSKKMY

LYYLQKGRCMYSGEVIELDKLMDDNLYDIDHIYPRSFVKDDSLDNLVLVKKEINNRKQNDPITP

QIQASCQGFWKILHDQGFMSNEKYSRLTRKTQEFSDEEKLSFINRQIVETGQATKCMAQILQKS
```

```
                                                        -continued
MGEDVDVVFSKARLVSEFRHKFELFKSRLINDFHHANDAYLNIVVGNSYFVKFTRNPANFIKDA

RKNPDNPVYKYHMDRFFERDVKSKSEVAWIGQSEGNSGTIVIVKKTMAKNSPLITKKVEEGHGS

ITKETIVGVKEIKFGRNKVEKADTPKKPNLQAYRPIKTSDERLCNILRYGGRTSISISGYCLV

EYVKKRKTIRSLEAIPVYLGRKDSLSEEKLLNYFRYNLNDGGKDSVSDIRLCLPFISTNSLVKI

DGYLYYLGGKNDDRIQLYNAYQLKMKKEEVEYIRKIEKAVSMSKFDEIDREKNPVLTEEKNIEL

YNKIQDKFENTVFSKRMSLVKYNKKDLSFGDFLKNKKSKFEEIDLEKQCKVLYNIIFNLSNLKE

VDLSDIGGSKSTGKCRCKKNITNYKEFKLIQQSITGLYSCEKDLMTI

SEQ ID NO: 318
MKNLKEYYIGLDIGTASVGWAVTDESYNIPKFNGKKMWGVRLFDDAKTAEERRTQRGSRRRLNR

RKERINLLQDLFATEISKVDPNFFLRLDNSDLYREDKDEKLKSKYTLFNDKDFKDRDYHKKYPT

IHHLIMDLIEDEGKKDIRLLYLACHYLLKNRGHFIFEGQKFDTKNSFDKSINDLKIHLRDEYNI

DLEFNNEDLIEIITDTTLNKTNKKKELKNIVGDTKFLKAISAIMIGSSQKLVDLFEDGEFEETT

VKSVDFSTTAFDDKYSEYEEALGDTISLLNILKSIYDSSILENLLKDADKSKDGNKYISKAFVK

KFNKHGKDLKTLKRIIKKYLPSEYANIFRNKSINDNYVAYTKSNITSNKRTKASKFTKQEDFYK

FIKKHLDTIKETKLNSSENEDLKLIDEMLTDIEFKTFIPKLKSSDNGVIPYQLKLMELKKILDN

QSKYYDFLNESDEYGTVKDKVESIMEFRIPYYVGPLNPDSKYAWIKRENTKITPWNFKDIVDLD

SSREEFIDRLIGRCTYLKEEKVLPKASLIYNEFMVLNELNNLKLNEFLITEEMKKAIFEELFKT

KKKVTLKAVSNLLKKEFNLTGDILLSGTDGDFKQGLNSYIDFKNIIGDKVDRDDYRIKIEEIIK

LIVLYEDDKTYLKKKIKSAYKNDFTDDEIKKIAALNYKDWGRLSKRFLTGIEGVDKTTGEKGSI

IYFMREYNLNLMELMSGHYTFTEEVEKLNPVENRELCYEMVDELYLSPSVKRMLWQSLRVVDEI

KRIIGKDPKKIFIEMARAKEAKNSRKESRKNKLLEFYKFGKKAFINEIGEERYNYLLNEINSEE

ESKFRWDNLYLYYTQLGRCMYSLEPIDLADLKSNNIYDQDHIYPKSKIYDDSLENRVLVKKNLN

HEKGNQYPIPEKVLNKNAYGFWKILFDKGLIGQKKYTRLTRRTPFEERELAEFIERQIVETRQA

TKETANLLKNICQDSEIVYSKAENASRFRQEFDIIKCRTVNDLHHMHDAYLNIVVGNVYNTKFT

KNPLNFIKDKDNVRSYNLENMFKYDVVRGSYTAWIADDSEGNVKAATIKKVKRELEGKNYRFTR

MSYIGTGGLYDQNLMRKGKGQIPQKENTNKSNIEKYGGYNKASSAYFALIESDGKAGRERTLET

IPIMVYNQEKYGNTEAVDKYLKDNLELQDPKILKDKIKINSLIKLDGFLYNIKGKTGDSLSIAG

SVQLIVNKEEQKLIKKMDKFLVKKKDNKDIKVTSFDNIKEEELIKLYKTLSDKLNNGIYSNKRN

NQAKNISEALDKFKEISIEEKIDVLNQIILLFQSYNNGCNLKSIGLSAKTGVVFIPKKLNYKEC

KLINQSITGLFENEVDLLNL

SEQ ID NO: 319
MGKMYYLGLDIGTNSVGYAVTDPSYHLLKFKGEPMWGAHVFAAGNQSAERRSFRTSRRRLDRRQ

QRVKLVQEIFAPVISPIDPRFFIRLHESALWRDDVAETDKHIFFNDPTYTDKEYYSDYPTIHHL

IVDLMESSEKHDPRLVYLAVAWLVAHRGHFLNEVDKDNIGDVLSFDAFYPEFLAFLSDNGVSPW

VCESKALQATLLSRNSVNDKYALKSLIFGSQKPEDNFDANISEDGLIQLLAGKKVKVNKLFPQ

ESNDASFTLNDKEDAIEEILGTLTPDECEWIAHIRRLFDWAIMKHALKDGRTISESKVKLYEQH

HHDLTQLKYFVKTYLAKEYDDIFRNVDSETTKNYVAYSYHVKEVKGTLPKNKATQEEFCKYVLG

KVKNIECSEADKVDFDEMIQRLTDNSFMPKQVSGENRVIPYQLYYYELKTILNKAASYLPFLTQ

CGKDAISNQDKLLSIMTFRIPYFVGPLRKDNSEHAWLERKAGKIYPWNFNDKVDLDKSEEAFIR

RMTNTCTYYPGEDVLPLDSLIYEKFMILNEINNIRIDGYPISVDVKQQVFGLFEKKRRVTVKDI

QNLLLSLGALDKHGKLTGIDTTIHSNYNTYHHFKSLMERGVLTRDDVERIVERMTYSDDTKRVR

LWLNNNYGTLTADDVKHISRLRKHDFGRLSKMFLTGLKGVHKETGERASILDFMWNTNDNLMQL
```

-continued

LSECYTFSDEITKLQEAYYAKAQLSLNDFLDSMYISNAVKRPIYRTLAVVNDIRKACGTAPKRI

FIEMARDGESKKKRSVTRREQIKNLYRSIRKDFQQEVDFLEKILENKSDGQLQSDALYLYFAQL

GRDMYTGDPIKLEHIKDQSFYNIDHIYPQSMVKDDSLDNKVLVQSEINGEKSSRYPLDAAIRNK

MKPLWDAYYNHGLISLKKYQRLTRSTPFTDDEKWDFINRQLVETRQSTKALAILLKRKFPDTEI

VYSKAGLSSDFRHEFGLVKSRNINDLHHAKDAFLAIVTGNVYHERFNRRWFMVNQPYSVKTKTL

FTHSIKNGNFVAWNGEEDLGRIVKMLKQNKNTIHFTRFSFDRKEGLFDIQPLKASTGLVPRKAG

LDVVKYGGYDKSTAAYYLLVRFTLEDKKTQHKLMMIPVEGLYKARIDHDKEFLTDYAQTTISEI

LQKDKQKVINIMFPMGTRHIKLNSMISIDGFYLSIGGKSSKGKSVLCHAMVPLIVPHKIECYIK

AMESFARKFKENNKLRIVEKFDKITVEDNLNLYELFLQKLQHNPYNKFFSTQFDVLTNGRSTFT

KLSPEEQVQTLLNILSIFKTCRSSGCDLKSINGSAQAARIMISADLTGLSKKYSDIRLVEQSAS

GLFVSKSQNLLEYL

SEQ ID NO: 320
MTKKEQPYNIGLDIGTSSVGWAVTNDNYDLLNIKKKNLWGVRLFEEAQTAKETRLNRSTRRRYR

RRKNRINWLNEIFSEELAKTDPSFLIRLQNSWVSKKDPDRKRDKYNLFIDGPYTDKEYYREFPT

IFHLRKELILNKDKADIRLIYLALHNILKYRGNFTYEHQKFNISNLNNNLSKELIELNQQLIKY

DISFPDDCDWNHISDILIGRGNATQKSSNILKDFTLDKETKKLLKEVINLILGNVAHLNTIFKT

SLTKDEEKLNFSGKDIESKLDDLDSILDDDQFTVLDAANRIYSTITLNEILNGESYFSMAKVNQ

YENHAIDLCKLRDMWHTTKNEEAVEQSRQAYDDYINKPKYGTKELYTSLKKFLKVALPTNLAKE

AEEKISKGTYLVKPRNSENGVVPYQLNKIEMEKIIDNQSQYYPFLKENKEKLLSILSFRIPYYV

GPLQSAEKNPFAWMERKSNGHARPWNFDEIVDREKSSNKFIRRMTVTDSYLVGEPVLPKNSLIY

QRYEVLNELNNIRITENLKTNPIGSRLTVETKQRIYNELFKKYKKVTVKKLTKWLIAQGYYKNP

ILIGLSQKDEFNSTLTTYLDMKKIFGSSFMEDNKNYDQIEELIEWLTIFEDKQILNEKLHSSKY

SYTPDQIKKISNMRYKGWGRLSKKILMDITTETNTPQLLQLSNYSILDLMWATNNNFISIMSND

KYDFKNYIENHNLNKNEDQNISDLVNDIHVSPALKRGITQSIKIVQEIVKFMGHAPKHIFIEVT

RETKKSEITTSREKRIKRLQSKLLNKANDFKPQLREYLVPNKKIQEELKKHKNDLSSERIMLYF

LQNGKSLYSEESLNINKLSDYQVDHILPRTYIPDDSLENKALVLAKENQRKADDLLLNSNVIDR

NLERWTYMLNNNMIGLKKFKNLTRRVITDKDKLGFIHRQLVQTSQMVKGVANILDNMYKNQGTT

CIQARANLSTAFRKALSGQDDTYHFKHPELVKNRNVNDFHHAQDAYLASFLGTYRLRRFPTNEM

LLMNGEYNKFYGQVKELYSKKKKLPDSRKNGFIISPLVNGTTQYDRNTGEIIWNVGFRDKILKI

FNYHQCNVTRKTEIKTGQFYDQTIYSPKNPKYKKLIAQKKDMDPNIYGGFSGDNKSSITIVKID

NNKIKPVAIPIRLINDLKDKKTLQNWLEENVKHKKSIQIIKNNVPIGQIIYSKKVGLLSLNSDR

EVANRQQLILPPEHSALLRLLQIPDEDLDQILAFYDKNILVEILQELITKMKKFYPFYKGEREF

LIANIENFNQATTSEKVNSLEELITLLHANSTSAHLIFNNIEKKAFGRKTHGLTLNNTDFIYQS

VTGLYETRIHIE

SEQ ID NO: 321
MTKFNKNYSIGLDIGVSSVGYAVVTEDYRVPAFKFKVLGNTEKEKIKKNLIGSTTFVSAQPAKG

TRVFRVNRRRIDRRNHRITYLRDIFQKEIEKVDKNFYRRLDESFRVLGDKSEDLQIKQPFFGDK

ELETAYHKKYPTIYHLRKHLADADKNSPVADIREVYMAISHILKYRGHFLTLDKINPNNINMQN

SWIDFIESCQEVFDLEISDESKNIADIFKSSENRQEKVKKILPYFQQELLKKDKSIFKQLLQLL

FGLKTKFKDCFELEEEPDLNFSKENYDENLENFLGSLEEDFSDVFAKLKVLRDTILLSGMLTYT

GATHARFSATMVERYEEHRKDLQRFKFFIKQNLSEQDYLDIFGRKTQNGFDVDKETKGYVGYIT

-continued

NKMVLTNPQKQKTIQQNFYDYISGKITGIEGAEYFLNKISDGTFLRKLRTSDNGAIPNQIHAYE

LEKIIERQGKDYPFLLENKDKLLSILTFKIPYYVGPLAKGSNSRFAWIKRATSSDILDDNDEDT

RNGKIRPWNYQKLINMDETRDAFITNLIGNDIILLNEKVLPKRSLIYEEVMLQNELTRVKYKDK

YGKAHFFDSELRQNIINGLFKNNSKRVNAKSLIKYLSDNHKDLNAIEIVSGVEKGKSFNSTLKT

YNDLKTIFSEELLDSEIYQKELEEIIKVITVFDDKKSIKNYLTKFFGHLEILDEEKINQLSKLR

YSGWGRYSAKLLLDIRDEDTGFNLLQFLRNDEENRNLTKLISDNTLSFEPKIKDIQSKSTIEDD

IFDEIKKLAGSPAIKRGILNSIKIVDELVQIIGYPPHNIVIEMARENMTTEEGQKKAKTRKTKL

ESALKNIENSLLENGKVPHSDEQLQSEKLYLYYLQNGKDMYTLDKTGSPAPLYLDQLDQYEVDH

IIPYSFLPIDSIDNKVLTHRENNQQKLNNIPDKETVANMKPFWEKLYNAKLISQTKYQRLTTSE

RTPDGVLTESMKAGFIERQLVETRQIIKHVARILDNRFSDTKIITLKSQLITNFRNTFHIAKIR

ELNDYHHAHDAYLAVVVGQTLLKVYPKLAPELIYGHHAHFNRHEENKATLRKHLYSNIMRFFNN

PDSKVSKDIWDCNRDLPIIKDVIYNSQINFVKRTMIKKGAFYNQNPVGKFNKQLAANNRYPLKT

KALCLDTSIYGGYGPMNSALSIIIAERFNEKKGKIETVKEFHDIFIIDYEKFNNNPFQFLNDT

SENGFLKKNNINRVLGFYRIPKYSLMQKIDGTRMLFESKSNLHKATQFKLTKTQNELFFHMKRL

LTKSNLMDLKSKSAIKESQNFILKHKEEFDNISNQLSAFSQKMLGNTTSLKNLIKGYNERKIKE

IDIRDETIKYFYDNFIKMFSFVKSGAPKDINDFFDNKCTVARMRPKPDKKLLNATLIHQSITGL

YETRIDLSKLGED

SEQ ID NO: 322
MKQEYFLGLDMGTGSLGWAVTDSTYQVMRKHGKALWGTRLFESASTAEERRMFRTARRRLDRRN

WRIQVLQEIFSEEISKVDPGFFLRMKESKYYPEDKRDAEGNCPELPYALFVDDNYTDKNYHKDY

PTIYHLRKMLMETTEIPDIRLVYLVLHHMMKHRGHFLLSGDISQIKEFKSTFEQLIQNIQDEEL

EWHISLDDAAIQFVEHVLKDRNLTRSTKKSRLIKQLNAKSACEKAILNLLSGGTVKLSDIFNNK

ELDESERPKVSFADSGYDDYIGIVEAELAEQYYIIASAKAVYDWSVLVEILGNSVSISEAKIKV

YQKHQADLKTLKKIVRQYMTKEDYKRVFVDTEEKLNNYSAYIGMTKKNGKKVDLKSKQCTQADF

YDFLKKNVIKVIDHKEITQEIESEIEKENFLPKQVTKDNGVIPYQVHDYELKKILDNLGTRMPF

IKENAEKIQQLFEFRIPYYVGPLNRVDDGKDGKFTWSVRKSDARIYPWNFTEVIDVEASAEKFI

RRMTNKCTYLVGEDVLPKDSLVYSKFMVLNELNNLRLNGEKISVELKQRIYEELFCKYRKVTRK

KLERYLVIEGIAKKGVEITGIDGDFKASLTAYHDFKERLTDVQLSQRAKEAIVLNVVLFGDDKK

LLKQRLSKMYPNLTTGQLKGICSLSYQGWGRLSKTFLEEITVPAPGTGEVWNIMTALWQTNDNL

MQLLSRNYGFTNEVEEFNTLKKETDLSYKTVDELYVSPAVKRQIWQTLKVVKEIQKVMGNAPKR

VFVEMAREKQEGKRSDSRKKQLVELYRACKNEERDWITELNAQSDQQLRSDKLFLYYIQKGRCM

YSGETIQLDELWDNTKYDIDHIYPQSKTMDDSLNNRVLVKKNYNAIKSDTYPLSLDIQKKMMSF

WKMLQQQGFITKEKYVRLVRSDELSADELAGFIERQIVETRQSTKAVATILKEALPDTEIVYVK

AGNVSNFRQTYELLKVREMNDLHHAKDAYLNIVVGNAYFVKFTKNAAWFIRNNPGRSYNLKRMF

EFDIERSGEIAWKAGNKGSIVTVKKVMQKNNILVTRKAYEVKGGLFDQQIMKKGKGQVPIKGND

ERLADIEKYGGYNKAAGTYFMLVKSLDKKGKEIRTIEFVPLYLKNQIEINHESAIQYLAQERGL

NSPEILLSKIKIDTLFKVDGFKMWLSGRTGNQLIFKGANQLILSHQEAAILKGVVKYVNRKNEN

KDAKLSERDGMTEEKLLQLYDTFLDKLSNTVYSIRLSAQIKTLTEKRAKFIGLSNEDQCIVLNE

ILHMFQCQSGSANLKLIGGPGSAGILVMNNNITACKQISVINQSPTGIYEKEIDLIKL

SEQ ID NO: 323
MKKPYSIGLDIGTNSVGWAVVTDDYKVPAKKMKVLGNTDKSHIEKNLLGALLFDSGNTAEDRRL

KRTARRRYTRRRNRILYLQEIFSEEMGKVDDSFFHRLEDSFLVTEDKRGERHPIFGNLEEEVKY

-continued

HENFPTIYHLRQYLADNPEKVDLRLVYLALAHIIKFRGHFLIEGKFDTRNNDVQRLFQEFLAVY

DNTFENSSLQEQNVQVEEILTDKISKSAKKDRVLKLFPNEKSNGRFAEFLKLIVGNQADFKKHF

ELEEKAPLQFSKDTYEEELEVLLAQIGDNYAELFLSAKKLYDSILLSGILTVTDVGTKAPLSAS

MIQRYNEHQMDLAQLKQFIRQKLSDKYNEVFSDVSKDGYAGYIDGKTNQEAFYKYLKGLLNKIE

GSGYFLDKIEREDFLRKQRTFDNGSIPHQIHLQEMRAIIRRQAEFYPFLADNQDRIEKLLTFRI

PYYVGPLARGKSDFAWLSRKSADKITPWNFDEIVDKESSAEAFINRMTNYDLYLPNQKVLPKHS

LLYEKFTVYNELTKVKYKTEQGKTAFFDANMKQEIFDGVFKVYRKVTKDKLMDFLEKEFDEFRI

VDLTGLDKENKVFNASYGTYHDLCKILDKDFLDNSKNEKILEDIVLTLTLFEDREMIRKRLENY

SDLLTKEQVKKLERRHYTGWGRLSAELIHGIRNKESRKTILDYLIDDGNSNRNFMQLINDDALS

FKEEIAKAQVIGETDNLNQVVSDIAGSPAIKKGILQSLKIVDELVKIMGHQPENIVVEMARENQ

FTNQGRRNSQQRLKGLTDSIKEFGSQILKEHPVENSQLQNDRLFLYYLQNGRDMYTGEELDIDY

LSQYDIDHIIPQAFIKDNSIDNRVLTSSKENRGKSDDVPSKDVVRKMKSYWSKLLSAKLITQRK

FDNLTKAERGGLTDDDKAGFIKRQLVETRQITKHVARILDERFNTETDENNKKIRQVKIVTLKS

NLVSNFRKEFELYKVREINDYHHAHDAYLNAVIGKALLGVYPQLEPEFVYGDYPHFHGHKENKA

TAKKFFYSNIMNFFKKDDVRTDKNGEIIWKKDEHISNIKKVLSYPQVNIVKKVEEQTGGFSKES

ILPKGNSDKLIPRKTKKFYWDTKKYGGFDSPIVAYSILVIADIEKGKSKKLKTVKALVGVTIME

KMTFERDPVAFLERKGYRNVQEENIIKLPKYSLFKLENGRKRLLASARELQKGNEIVLPNHLGT

LLYHAKNIHKVDEPKHLDYVDKHKDEFKELLDVVSNFSKKYTLAEGNLEKIKELYAQNNGEDLK

ELASSFINLLTFTAIGAPATFKFFDKNIDRKRYTSTTEILNATLIHQSITGLYETRIDLNKLGG

D

SEQ ID NO: 324

MDKKYSIGLDIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD

SEQ ID NO: 325

MTKPYSIGLDIGTNSVGWAVTTDNYKVPSKKMKVLGNTSKKYIKKNLLGVLLFDSGITAEGRRL

KRTARRRYTRRRNRILYLQEIFSTEMATLDDAFFQRLDDSFLVPDDKRDSKYPIFGNLVEEKAY

HDEFPTIYHLRKYLADSTKKADLRLVYLALAHMIKYRGHFLIEGEFNSKNNDIQKNFQDFLDTY

NAIFESDLSLENSKQLEEIVKDKISKLEKKDRILKLFPGEKNSGIFSEFLKLIVGNQADFRKCF

NLDEKASLHFSKESYDEDLETLLGYIGDDYSDVFLKAKKLYDAILLSGFLTVTDNETEAPLSSA

MIKRYNEHKEDLALLKEYIRNISLKTYNEVFKDDTKNGYAGYIDGKTNQEDFYVYLKKLLAEFE

GADYFLEKIDREDFLRKQRTFDNGSIPYQIHLQEMRAILDKQAKFYPFLAKNKERIEKILTFRI

PYYVGPLARGNSDFAWSIRKRNEKITPWNFEDVIDKESSAEAFINRMTSFDLYLPEEKVLPKHS

LLYETFNVYNELTKVRFIAESMRDYQFLDSKQKKDIVRLYFKDKRKVTDKDIIEYLHAIYGYDG

IELKGIEKQFNSSLSTYHDLLNIINDKEFLDDSSNEAIIEEIIHTLTIFEDREMIKQRLSKFEN

IFDKSVLKKLSRRHYTGWGKLSAKLINGIRDEKSGNTILDYLIDDGISNRNFMQLIHDDALSFK

KKIQKAQIIGDEDKGNIKEVVKSLPGSPAIKKGILQSIKIVDELVKVMGGRKPESIVVEMAREN

QYTNQGKSNSQQRLKRLEKSLKELGSKILKENIPAKLSKIDNNALQNDRLYLYYLQNGKDMYTG

DDLDIDRLSNYDIDHIIPQAFLKDNSIDNKVLVSSASNRGKSDDVPSLEVVKKRKTFWYQLLKS

KLISQRKFDNLTKAERGGLSPEDKAGFIQRQLVETRQITKHVARLLDEKFNNKKDENNRAVRTV

KIITLKSTLVSQFRKDFELYKVREINDFHHAHDAYLNAVVASALLKKYPKLEPEFVYGDYPKYN

SFRERKSATEKVYFYSNIMNIFKKSISLADGRVIERPLIEVNEETGESVWNKESDLATVRRVLS

YPQVNVVKKVEEQNHGLDRGKPKGLFNANLSSKPKPNSNENLVGAKEYLDPKKYGGYAGISNSF

TVLVKGTIEKGAKKKITNVLEFQGISILDRINYRKDKLNFLLEKGYKDIELIIELPKYSLFELS

DGSRRMLASILSTNNKRGEIHKGNQIFLSQKFVKLLYHAKRISNTINENHRKYVENHKKEFEEL

FYYILEFNENYVGAKKNGKLLNSAFQSWQNHSIDELCSSFIGPTGSERKGLFELTSRGSAADFE

FLGVKIPRYRDYTPSSLLKDATLIHQSVTGLYETRIDLAKLGEG

SEQ ID NO: 326

MKKQKFSDYYLGFDIGTNSVGWCVTDLDYNVLRFNKKDMWGSRLFDEAKTAAERRVQRNSRRRL

KRRKWRLNLLEEIFSDEIMKIDSNFFRRLKESSLWLEDKNSKEKFTLFNDDNYKDYDFYKQYPT

IFHLRDELIKNPEKKDIRLIYLALHSIFKSRGHFLFEGQNLKEIKNFETLYNNLISFLEDNGIN

KSIDKDNIEKLEKIICDSGKGLKDKEKEFKGIFNSDKQLVAIFKLSVGSSVSLNDLFDTDEYKK

EEVEKEKISFREQIYEDDKPIYYSILGEKIELLDIAKSFYDFMVLNNILSDSNYISEAKVKLYE

EHKKDLKNLKYIIRKYNKENYDKLFKDKNENNYPAYIGLNKEKDKKEVVEKSRLKIDDLIKVIK

GYLPKPERIEEKDKTIFNEILNKIELKTILPKQRISDNGTLPYQIHEVELEKILENQSKYYDFL

NYEENGVSTKDKLLKTFKFRIPYYVGPLNSYHKDKGGNSWIVRKEEGKILPWNFEQKVDIEKSA

EEFIKRMTNKCTYLNGEDVIPKDSFLYSEYIILNELNKVQVNDEFLNEENKRKIIDELFKENKK

VSEKKFKEYLLVNQIANRTVELKGIKDSFNSNYVSYIKFKDIFGEKLNLDIYKEISEKSILWKC

LYGDDKKIFEKKIKNEYGDILNKDEIKKINSFKFNTWGRLSEKLLTGIEFINLETGECYSSVME

ALRRTNYNLMELLSSKFTLQESIDNENKEMNEVSYRDLIEESYVSPSLKRAILQTLKIYEEIKK

ITGRVPKKVFIEMARGGDESMKNKKIPARQEQLKKLYDSCGNDIANFSIDIKEMKNSLSSYDNN

SLRQKKLYLYYLQFGKCMYTGREIDLDRLLQNNDTYDIDHIYPRSKVIKDDSFDNLVLVLKNEN

AEKSNEYPVKKEIQEKMKSFWRFLKEKNFISDEKYKRLTGKDDFELRGFMARQLVNVRQTTKEV

-continued

GKILQQIEPEIKIVYSKAEIASSFREMFDFIKVRELNDTHHAKDAYLNIVAGNVYNTKFTEKPY

RYLQEIKENYDVKKIYNYDIKNAWDKENSLEIVKKNMEKNTVNITRFIKEEKGELFNLNPIKKG

ETSNEIISIKPKLYDGKDNKLNEKYGYYTSLKAAYFIYVEHEKKNKKVKTFERITRIDSTLIKN

EKNLIKYLVSQKKLLNPKIIKKIYKEQTLIIDSYPYTFTGVDSNKKVELKNKKQLYLEKKYEQI

LKNALKFVEDNQGETEENYKFIYLKKRNNNEKNETIDAVKERYNIEFNEMYDKFLEKLSSKDYK

NYINNKLYTNFLNSKEKFKKLKLWEKSLILREFLKIFNKNTYGKYEIKDSQTKEKLFSFPEDTG

RIRLGQSSLGNNKELLEESVTGLFVKKIKL

SEQ ID NO: 327
MKNYTIGLDIGVASVGWVCIDENYKILNYNNRHAFGVHEFESAESAAGRRLKRGMRRRYNRRKK

RLQLLQSLFDSYITDSGFFSKTDSQHFWKNNNEFENRSLTEVLSSLRISSRKYPTIYHLRSDLI

ESNKKMDLRLVYLALHNLVKYRGHFLQEGNWSEAASAEGMDDQLLELVTRYAELENLSPLDLSE

SQWKAAETLLLNRNLTKTDQSKELTAMFGKEYEPFCKLVAGLGVSLHQLFPSSEQALAYKETKT

KVQLSNENVEEVMELLLEEESALLEAVQPFYQQVVLYELLKGETYVAKAKVSAFKQYQKDMASL

KNLLDKTFGEKVYRSYFISDKNSQREYQKSHKVEVLCKLDQFNKEAKFAETFYKDLKKLLEDKS

KTSIGTTEKDEMLRIIKAIDSNQFLQKQKGIQNAAIPHQNSLYEAEKILRNQQAHYPFITTEWI

EKVKQILAFRIPYYIGPLVKDTTQSPFSWVERKGDAPITPWNFDEQIDKAASAEAFISRMRKTC

TYLKGQEVLPKSSLTYERFEVLNELNGIQLRTTGAESDFRHRLSYEMKCWIIDNVFKQYKTVST

KRLLQELKKSPYADELYDEHTGEIKEVFGTQKENAFATSLSGYISMKSILGAVVDDNPAMTEEL

IYWIAVFEDREILHLKIQEKYPSITDVQRQKLALVKLPGWGRFSRLLIDGLPLDEQGQSVLDHM

EQYSSVFMEVLKNKGFGLEKKIQKMNQHQVDGTKKIRYEDIEELAGSPALKRGIWRSVKIVEEL

VSIFGEPANIVLEVAREDGEKKRTKSRKDQWEELTKTTLKNDPDLKSFIGEIKSQGDQRFNEQR

FWLYVTQQGKCLYTGKALDIQNLSMYEVDHILPQNFVKDDSLDNLALVMPEANQRKNQVGQNKM

PLEIIEANQQYAMRTLWERLHELKLISSGKLGRLKKPSFDEVDKDKFIARQLVETRQIIKHVRD

LLDERFSKSDIHLVKAGIVSKFRRFSEIPKIRDYNNKHHAMDALFAAALIQSILGKYGKNFLAF

DLSKKDRQKQWRSVKGSNKEFFLFKNFGNLRLQSPVTGEEVSGVEYMKHVYFELPWQTTKMTQT

GDGMFYKESIFSPKVKQAKYVSPKTEKFVHDEVKNHSICLVEFTFMKKEKEVQETKFIDLKVIE

HHQFLKEPESQLAKFLAEKETNSPIIHARIIRTIPKYQKIWIEHFPYYFISTRELHNARQFEIS

YELMEKVKQLSERSSVEELKIVFGLLIDQMNDNYPIYTKSSIQDRVQKFVDTQLYDFKSFEIGF

EELKKAVAANAQRSDTFGSRISKKPKPEEVAIGYESITGLKYRKPRSVVGTKR

SEQ ID NO: 328
MKKEIKDYFLGLDVGTGSVGWAVTDTDYKLLKANRKDLWGMRCFETAETAEVRRLHRGARRIE

RRKKRIKLLQELFSQEIAKTDEGFFQRMKESPFYAEDKTILQENTLFNDKDFADKTYHKAYPTI

NHLIKAWIENKVKPDPRLLYLACHNIIKKRGHFLFEGDFDSENQFDTSIQALFEYLREDMEVDI

DADSQKVKEILKDSSLKNSEKQSRLNKILGLKPSDKQKKAITNLISGNKINFADLYDNPDLKDA

EKNSISFSKDDFDALSDDLASILGDSFELLLKAKAVYNCSVLSKVIGDEQYLSFAKVKIYEKHK

TDLTKLKNVIKKHFPKDYKKVFGYNKNEKNNNNYSGYVGVCKTKSKKLIINNSVNQEDFYKFLK

TILSAKSEIKEVNDILTEIETGTFLPKQISKSNAEIPYQLRKMELEKILSNAEKHFSFLKQKDE

KGLSHSEKIIMLLTFKIPYYIGPINDNHKKFFPDRCWVVKKEKSPSGKTTPWNFFDHIDKEKTA

EAFITSRTNFCTYLVGESVLPKSSLLYSEYTVLNEINNLQIIIDGKNICDIKLKQKIYEDLFKK

YKKITQKQISTFIKHEGICNKTDEVIILGIDKECTSSLKSYIELKNIFGKQVDEISTKNMLEEI

IRWATIYDEGEGKTILKTKIKAEYGKYCSDEQIKKILNLKFSGWGRLSRKFLETVTSEMPGFSE

PVNIITAMRETQNNLMELLSSEFTFTENIKKINSGFEDAEKQFSYDGLVKPLFLSPSVKKMLWQ

-continued

```
TLKLVKEISHITQAPPKKIFIEMAKGAELEPARTKTRLKILQDLYNNCKNDADAFSSEIKDLSG

KIENEDNLRLRSDKLYLYYTQLGKCMYCGKPIEIGHVFDTSNYDIDHIYPQSKIKDDSISNRVL

VCSSCNKNKEDKYPLKSEIQSKQRGFWNFLQRNNFISLEKLNRLTRATPISDDETAKFIARQLV

ETRQATKVAAKVLEKMFPETKIVYSKAETVSMFRNKFDIVKCREINDFHHAHDAYLNIVVGNVY

NTKFTNNPWNFIKEKRDNPKIADTYNYYKVFDYDVKRNNITAWEKGKTIITVKDMLKRNTPIYT

RQAACKKGELFNQTIMKKGLGQHPLKKEGPFSNISKYGGYNKVSAAYYTLIEYEEKGNKIRSLE

TIPLYLVKDIQKDQDVLKSYLTDLLGKKEFKILVPKIKINSLLKINGFPCHITGKTNDSFLLRP

AVQFCCSNNEVLYFKKIIRFSEIRSQREKIGKTISPYEDLSFRSYIKENLWKKTKNDEIGEKEF

YDLLQKKNLEIYDMLLTKHKDTIYKKRPNSATIDILVKGKEKFKSLIIENQFEVILEILKLFSA

TRNVSDLQHIGGSKYSGVAKIGNKISSLDNCILIYQSITGIFEKRIDLLKV

SEQ ID NO: 329
MEGQMKNNGNNLQQGNYYLGLDVGTSSVGWAVTDTDYNVLKFRGKSMWGARLFDEASTAEERRT

HRGNRRRLARRKYRLLLLEQLFEKEIRKIDDNFFVRLHESNLWADDKSKPSKFLLFNDTNFTDK

DYLKKYPTIYHLRSDLIHNSTEHDIRLVFLALHHLIKYRGHFIYDNSANGDVKTLDEAVSDFEE

YLNENDIEFNIENKKEFINVLSDKHLTKKEKKISLKKLYGDITDSENINISVLIEMLSGSSISL

SNLFKDIEFDGKQNLSLDSDIEETLNDVVDILGDNIDLLIHAKEVYDIAVLTSSLGKHKYLCDA

KVELFEKNKKDLMILKKYIKKNHPEDYKKIFSSPTEKKNYAAYSQTNSKNVCSQEEFCLFIKPY

IRDMVKSENEDEVRIAKEVEDKSFLTKLKGTNNSVVPYQIHERELNQILKNIVAYLPFMNDEQE

DISVVDKIKLIFKFKIPYYVGPLNTKSTRSWVYRSDEKIYPWNFSNVIDLDKTAHEFMNRLIGR

CTYTNDPVLPMDSLLYSKYNVLNEINPIKVNGKAIPVEVKQAIYTDLFENSKKKVTRKSIYIYL

LKNGYIEKEDIVSGIDIEIKSKLKSHHDFTQIVQENKCTPEEIERIIKGILVYSDDKSMLRRWL

KNNIKGLSENDVKYLAKLNYKEWGRLSKTLLTDIYTINPEDGEACSILDIMWNTNATLMEILSN

EKYQFKQNIENYKAENYDEKQNLHEELDDMYISPAARRSIWQALRIVDEIVDIKKSAPKKIFIE

MAREKKSAMKKKRTESRKDTLLELYKSCKSQADGFYDEELFEKLSNESNSRLRRDQLYLYYTQM

GRSMYTGKRIDFDKLINDKNTYDIDHIYPRSKIKDDSITNRVLVEKDINGEKTDIYPISEDIRQ

KMQPFWKILKEKGLINEEKYKRLTRNYELTDEELSSFVARQLVETQQSTKALATLLKKEYPSAK

IVYSKAGNVSEFRNRKDKELPKFREINDLHHAKDAYLNIVVGNVYDTKFTEKFFNNIRNENYSL

KRVFDFSVPGAWDAKGSTFNTIKKYMAKNNPIIAFAPYEVKGELFDQQIVPKGKGQFPIKQGKD

IEKYGGYNKLSSAFLFAVEYKGKKARERSLETVYIKDVELYLQDPIKYCESVLGLKEPQIIKPK

ILMGSLFSINNKKLVVTGRSGKQYVCHHIYQLSINDEDSQYLKNIAKYLQEEPDGNIERQNILN

ITSVNNIKLFDVLCTKFNSNTYEIILNSLKNDVNEGREKFSELDILEQCNILLQLLKAFKCNRE

SSNLEKLNNKKQAGVIVIPHLFTKCSVFKVIHQSITGLFEKEMDLLK

SEQ ID NO: 330
MGRKPYILSLDIGTGSVGYACMDKGFNVLKYHDKDALGVYLFDGALTAQERRQFRTSRRRKNRR

IKRLGLLQELLAPLVQNPNFYQFRQFAWKNDNMDFKNKSLSEVLSFLGYESKKYPTIYHLQEA

LLLKDEKFDPELIYMALYHLVKYRGHFLFDHLKIENLTNNDNMHDFVELIETYENLNNIKLNLD

YEKTKVIYEILKDNEMTKNDRAKRVKNMEKKLEQFSIMLLGLKFNEGKLFNHADNAEELKGANQ

SHTFADNYEENLTPFLTVEQSEFIERANKIYLSLTLQDILKGKKSMAMSKVAAYDKFRNELKQV

KDIVYKADSTRTQFKKIFVSSKKSLKQYDATPNDQTFSSLCLFDQYLIRPKKQYSLLIKELKKI

IPQDSELYFEAENDTLLKVLNTTDNASIPMQINLYEAETILRNQQKYHAEITDEMIEKVLSLIQ

FRIPYYVGPLVNDHTASKFGWMERKSNESIKPWNFDEVVDRSKSATQFIRRMTNKCSYLINEDV
```

```
LPKNSLLYQEMEVLNELNATQIRLQTDPKNRKYRMMPQIKLFAVEHIFKKYKTVSHSKFLEIML

NSNHRENFMNHGEKLSIFGTQDDKKFASKLSSYQDMTKIFGDIEGKRAQIEEIIQWITIFEDKK

ILVQKLKECYPELTSKQINQLKKLNYSGWGRLSEKLLTHAYQGHSIIELLRHSDENFMEILTND

VYGFQNFIKEENQVQSNKIQHQDIANLTTSPALKKGIWSTIKLVRELTSIFGEPEKIIMEFATE

DQQKGKKQKSRKQLWDDNIKKNKLKSVDEYKYIIDVANKLNNEQLQQEKLWLYLSQNGKCMYSG

QSIDLDALLSPNATKHYEVDHIFPRSFIKDDSIDNKVLVIKKMNQTKGDQVPLQFIQQPYERIA

YWKSLNKAGLISDSKLHKLMKPEFTAMDKEGFIQRQLVETRQISVHVRDFLKEEYPNTKVIPMK

AKMVSEFRKKFDIPKIRQMNDAHHAIDAYLNGVVYHGAQLAYPNVDLFDFNFKWEKVREKWKAL

GEFNTKQKSRELFFFKKLEKMEVSQGERLISKIKLDMNHFKINYSRKLANIPQQFYNQTAVSPK

TAELKYESNKSNEVVYKGLTPYQTYVVAIKSVNKKGKEKMEYQMIDHYVFDFYKFQNGNEKELA

LYLAQRENKDEVLDAQIVYSLNKGDLLYINNHPCYFVSRKEVINAKQFELTVEQQLSLYNVMNN

KETNVEKLLIEYDFIAEKVINEYHHYLNSKLKEKRVRTFFSESNQTHEDFIKALDELFKVVTAS

ATRSDKIGSRKNSMTHRAFLGKGKDVKIAYTSISGLKTTKPKSLFKLAESRNEL

SEQ ID NO: 331
MAKILGLDLGTNSIGWAVVERENIDFSLIDKGVRIFSEGVKSEKGIESSRAAERTGYRSARKIK

YRRKLRKYETLKVLSLNRMCPLSIEEVEEWKKSGFKDYPLNPEFLKWLSTDEESNVNPYFFRDR

ASKHKVSLFELGRAFYHIAQRRGFLSNRLDQSAEGILEEHCPKIEAIVEDLISIDEISTNITDY

FFETGILDSNEKNGYAKDLDEGDKKLVSLYKSLLAILKKNESDFENCKSEIIERLNKKDVLGKV

KGKIKDISQAMLDGNYKTLGQYFYSLYSKEKIRNQYTSREEHYLSEFITICKVQGIDQINEEEK

INEKKFDGLAKDLYKAIFFQRPLKSQKGLIGKCSFEKSKSRCAISHPDFEEYRMWTYLNTIKIG

TQSDKKLRFLTQDEKLKLVPKFYRKNDFNFDVLAKELIEKGSSFGFYKSSKKNDFFYWFNYKPT

DTVAACQVAASLKNAIGEDWKTKSFKYQTINSNKEQVSRTVDYKDLWHLLTVATSDVYLYEFAI

DKLGLDEKNAKAFSKTKLKKDFASLSLSAINKILPYLKEGLLYSHAVFVANIENIVDENIWKDE

KQRDYIKTQISEIIENYTLEKSRFEIINGLLKEYKSENEDGKRVYYSKEAEQSFENDLKKKLVL

FYKSNEIENKEQQETIFNELLPIFIQQLKDYEFIKIQRLDQKVLIFLKGKNETGQIFCTEEKGT

AEEKEKKIKNRLKKLYHPSDIEKFKKKIIKDEFGNEKIVLGSPLTPSIKNPMAMRALHQLRKVL

NALILEGQIDEKTIIHIEMARELNDANKRKGIQDYQNDNKKFREDAIKEIKKLYFEDCKKEVEP

TEDDILRYQLWMEQNRSEIYEEGKNISICDIIGSNPAYDIEHTIPRSRSQDNSQMNKTLCSQRF

NREVKKQSMPIELNNHLEILPRIAHWKEEADNLTREIEIISRSIKAAATKEIKDKKIRRRHYLT

LKRDYLQGKYDRFIWEEPKVGFKNSQIPDTGIITKYAQAYLKSYFKKVESVKGGMVAEFRKIWG

IQESFIDENGMKHYKVKDRSKHTHHTIDAITIACMTKEKYDVLAHAWTLEDQQNKKEARSIIEA

SKPWKTFKEDLLKIEEEILVSHYTPDNVKKQAKKIVRVRGKKQFVAEVERDVNGKAVPKKAASG

KTIYKLDGEGKKLPRLQQGDTIRGSLHQDSIYGAIKNPLNTDEIKYVIRKDLESIKGSDVESIV

DEVVKEKIKEAIANKVLLLSSNAQQKNKLVGTVWMNEEKRIAINKVRIYANSVKNPLHIKEHSL

LSKSKHVHKQKVYGQNDENYAMAIYELDGKRDFELINIFNLAKLIKQGQGFYPLHKKKEIKGKI

VFVPIEKRNKRDVVLKRGQQVVFYDKEVENPKDISEIVDFKGRIYIIEGLSIQRIVRPSGKVDE

YGVIMLRYFKEARKADDIKQDNFKPDGVFKLGENKPTRKMNHQFTAFVEGIDFKVLPSGKFEKI

SEQ ID NO: 332
MEFKKVLGLDIGTNSIGCALLSLPKSIQDYGKGGRLEWLTSRVIPLDADYMKAFIDGKNGLPQV

ITPAGKRRQKRGSRRLKHRYKLRRSRLIRVFKTLNWLPEDFPLDNPKRIKETISTEGKFSFRIS

DYVPISDESYREFYREFGYPENEIEQVIEEINFRRKTKGKNKNPMIKLLPEDWVVYLRKKALI

KPTTKEELIRIIYLFNQRRGFKSSRKDLTETAILDYDEFAKRLAEKEKYSAENYETKFVSITKV
```

KEVVELKTDGRKGKKRFKVILEDSRIEPYEIERKEKPDWEGKEYTFLVTQKLEKGKFKQNKPDL

PKEEDWALCTTALDNRMGSKHPGEFFFDELLKAFKEKRGYKIRQYPVNRWRYKKELEFIWTKQC

QLNPELNNLNINKEILRKLATVLYPSQSKFFGPKIKEFENSDVLHIISEDIIYYQRDLKSQKSL

ISECRYEKRKGIDGEIYGLKCIPKSSPLYQEFRIWQDIHNIKVIRKESEVNGKKKINIDETQLY

INENIKEKLFELFNSKDSLSEKDILELISLNIINSGIKISKKEEETTHRINLFANRKELKGNET

KSRYRKVFKKLGFDGEYILNHPSKLNRLWHSDYSNDYADKEKTEKSILSSLGWKNRNGKWEKSK

NYDVFNLPLEVAKAIANLPPLKKEYGSYSALAIRKMLVVMRDGKYWQHPDQIAKDQENTSLMLF

DKNLIQLTNNQRKVLNKYLLTLAEVQKRSTLIKQKLNEIEHNPYKLELVSDQDLEKQVLKSFLE

KKNESDYLKGLKTYQAGYLIYGKHSEKDVPIVNSPDELGEYIRKKLPNNSLRNPIVEQVIRETI

FIVRDVWKSFGIIDEIHIELGRELKNNSEERKKTSESQEKNFQEKERARKLLKELLNSSNFEHY

DENGNKIFSSFTVNPNPDSPLDIEKFRIWKNQSGLTDEELNKKLKDEKIPTEIEVKKYILWLTQ

KCRSPYTGKIIPLSKLFDSNVYEIEHIIPRSKMKNDSTNNLVICELGVNKAKGDRLAANFISES

NGKCKFGEVEYTLLKYGDYLQYCKDTFKYQKAKYKNLLATEPPEDFIERQINDTRYIGRKLAEL

LTPVVKDSKNIIFTIGSITSELKITWGLNGVWKDILRPRFKRLESIINKKLIFQDEDDPNKYHF

DLSINPQLDKEGLKRLDHRHHALDATIIAATTREHVRYLNSLNAADNDEEKREYFLSLCNHKIR

DFKLPWENFTSEVKSKLLSCVVSYKESKPILSDPFNKYLKWEYKNGKWQKVFAIQIKNDRWKAV

RRSMFKEPIGTVWIKKIKEVSLKEAIKIQAIWEEVKNDPVRKKKEKYIYDDYAQKVIAKIVQEL

GLSSSMRKQDDEKLNKFINEAKVSAGVNKNLNTTNKTIYNLEGRFYEKIKVAEYVLYKAKRMPL

NKKEYIEKLSLQKMFNDLPNFILEKSILDNYPEILKELESDNKYIIEPHKKNNPVNRLLLEHIL

EYHNNPKEAFSTEGLEKLNKKAINKIGKPIKYITRLDGDINEEEIFRGAVFETDKGSNVYFVMY

ENNQTKDREFLKPNPSISVLKAIEHKNKIDFFAPNRLGFSRIILSPGDLVYVPTNDQYVLIKDN

SSNETIINWDDNEFISNRIYQVKKFTGNSCYFLKNDIASLILSYSASNGVGEFGSQNISEYSVD

DPPIRIKDVCIKIRVDRLGNVRPL

SEQ ID NO: 333
MKHILGLDLGTNSIGWALIERNIEEKYGKIIGMGSRIVPMGAELSKFEQGQAQTKNADRRTNRG

ARRLNKRYKQRRNKLIYILQKLDMLPSQIKLKEDFSDPNKIDKITILPISKKQEQLTAFDLVSL

RVKALTEKVGLEDLGKIIYKYNQLRGYAGGSLEPEKEDIFDEEQSKDKKNKSFIAFSKIVFLGE

PQEEIFKNKKLNRRAIIVETEEGNFEGSTFLENIKVGDSLELLINISASKSGDTITIKLPNKTN

WRKKMENIENQLKEKSKEMGREFYISEFLLELLKENRWAKIRNNTILRARYESEFEAIWNEQVK

HYPFLENLDKKTLIEIVSFIFPGEKESQKKYRELGLEKGLKYIIKNQVVFYQRELKDQSHLISD

CRYEPNEKAIAKSHPVFQEYKVWEQINKLIVNTKIEAGTNRKGEKKYKYIDRPIPTALKEWIFE

ELQNKKEITFSAIFKKLKAEFDLREGIDFLNGMSPKDKLKGNETKLQLQKSLGELWDVLGLDSI

NRQIELWNILYNEKGNEYDLTSDRTSKVLEFINKYGNNIVDDNAEETAIRISKIKFARAYSSLS

LKAVERILPLVRAGKYFNNDFSQQLQSKILKLLNENVEDPFAKAAQTYLDNNQSVLSEGGVGNS

IATILVYDKHTAKEYSHDELYKSYKEINLLKQGDLRNPLVEQIINEALVLIRDIWKNYGIKPNE

IRVELARDLKNSAKERATIHKRNKDNQTINNKIKETLVKNKKELSLANIEKVKLWEAQRHLSPY

TGQPIPLSDLFDKEKYDVDHIIPISRYFDDSFTNKVISEKSVNQEKANRTAMEYFEVGSLKYSI

FTKEQFIAHVNEYFSGVKRKNLLATSIPEDPVQRQIKDTQYIAIRVKEELNKIVGNENVKTTTG

SITDYLRNHWGLTDKFKLLLKERYEALLESEKFLEAEYDNYKKDFDSRKKEYEEKEVLFEEQEL

TREEFIKEYKENYIRYKKNKLIIKGWSKRIDHRHHAIDALIVACTEPAHIKRLNDLNKVLQDWL

VEHKSEFMPNFEGSNSELLEEILSLPENERTEIFTQIEKFRAIEMPWKGFPEQVEQKLKEIIIS

-continued

HKPKDKLLLQYNKAGDRQIKLRGQLHEGTLYGISQGKEAYRIPLTKFGGSKFATEKNIQKIVSP

FLSGFIANHLKEYNNKKEEAFSAEGIMDLNNKLAQYRNEKGELKPHTPISTVKIYYKDPSKNKK

KKDEEDLSLQKLDREKAFNEKLYVKTGDNYLFAVLEGEIKTKKTSQIKRLYDIISFFDATNFLK

EEFRNAPDKKTFDKDLLFRQYFEERNKAKLLFTLKQGDFVYLPNENEEVILDKESPLYNQYWGD

LKERGKNIYVVQKFSKKQIYFIKHTIADIIKKDVEFGSQNCYETVEGRSIKENCFKLEIDRLGN

IVKVIKR

SEQ ID NO: 334
MHVEIDFPHFSRGDSHLAMNKNEILRGSSVLYRLGLDLGSNSLGWFVTHLEKRGDRHEPVALGP

GGVRIFPDGRDPQSGTSNAVDRRMARGARKRRDRFVERRKELIAALIKYNLLPDDARERRALEV

LDPYALRKTALTDTLPAHHVGRALFHLNQRRGFQSNRKTDSKQSEDGAIKQAASRLATDKGNET

LGVFFADMHLRKSYEDRQTAIRAELVRLGKDHLTGNARKKIWAKVRKRLFGDEVLPRADAPHGV

RARATITGTKASYDYYPTRDMLRDEFNAIWAGQSAHHATITDEARTEIEHIIFYQRPLKPAIVG

KCTLDPATRPFKEDPEGYRAPWSHPLAQRFRILSEARNLEIRDTGKGSRRLTKEQSDLVVAALL

ANREVKFDKLRTLLKLPAEARFNLESDRRAALDGDQTAARLSDKKGFNKAWRGFPPERQIAIVA

RLEETEDENELIAWLEKECALDGAAAARVANTTLPDGHCRLGLRAIKKIVPIMQDGLDEDGVAG

AGYHIAAKRAGYDHAKLPTGEQLGRLPYYGQWLQDAVVGSGDARDQKEKQYGQFPNPTVHIGLG

QLRRVVNDLIDKYGPPTEISIEFTRALKLSEQQKAERQREQRRNQDKNKARAEELAKFGRPANP

RNLLKMRLWEELAHDPLDRKCVYTGEQISIERLLSDEVDIDHILPVAMTLDDSPANKIICMRYA

NRHKRKQTPSEAFGSSPTLQGHRYNWDDIAARATGLPRNKRWRFDANAREEFDKRGGFLARQLN

ETGWLARLAKQYLGAVTDPNQIWVVPGRLTSMLRGKWGLNGLLPSDNYAGVQDKAEEFLASTDD

MEFSGVKNRADHRHHAIDGLVTALTDRSLLWKMANAYDEEHEKFVIEPPWPTMRDDLKAALEKM

VVSHKPDHGIEGKLHEDSAYGFVKPLDATGLKEEEAGNLVYRKAIESLNENEVDRIRDIQLRTI

VRDHVNVEKTKGVALADALRQLQAPSDDYPQFKHGLRHVRILKKEKGDYLVPIANRASGVAYKA

YSAGENFCVEVFETAGGKWDGEAVRRFDANKKNAGPKIAHAPQWRDANEGAKLVMRIHKGDLIR

LDHEGRARIMVVHRLDAAAGRFKLADHNETGNLDKRHATNNDIDPFRWLMASYNTLKKLAAVPV

RVDELGRVWRVMPN

SEQ ID NO: 335
METTLGIDLGTNSIGLALVDQEEHQILYSGVRIFPEGINKDTIGLGEKEESRNATRRAKRQMRR

QYFRKKLRKAKLLELLIAYDMCPLKPEDVRRWKNWDKQQKSTVRQFPDTPAFREWLKQNPYELR

KQAVTEDVTRPELGRILYQMIQRRGFLSSRKGKEEGKIFTGKDRMVGIDETRKNLQKQTLGAYL

YDIAPKNGEKYRFRTERVRARYTLRDMYIREFEIIWQRQAGHLGLAHEQATRKKNIFLEGSATN

VRNSKLITHLQAKYGRGHVLIEDTRITVTFQLPLKEVLGGKIEIEEEQLKFKSNESVLFWQRPL

RSQKSLLSKCVFEGRNFYDPVHQKWIIAGPTPAPLSHPEFEEFRAYQFINNIIYGKNEHLTAIQ

REAVFELMCTESKDFNFEKIPKHLKLFEKFNFDDTTKVPACTTISQLRKLFPHPVWEEKREEIW

HCFYFYDDNTLLFEKLQKDYALQTNDLEKIKKIRLSESYGNVSLKAIRRINPYLKKGYAYSTAV

LLGGIRNSFGKRFEYFKEYEPEIEKAVCRILKEKNAEGEVIRKIKDYLVHNRFGFAKNDRAFQK

LYHHSQAITTQAQKERLPETGNLRNPIVQQGLNELRRTVNKLLATCREKYGPSFKFDHIHVEMG

RELRSSKTEREKQSRQIRENEKKNEAAKVKLAEYGLKAYRDNIQKYLLYKEIEEKGGTVCCPYT

GKTLNISHTLGSDNSVQIEHIIPYSISLDDSLANKTLCDATFNREKGELTPYDFYQKDPSPEKW

GASSWEEIEDRAFRLLPYAKAQRFIRRKPQESNEFISRQLNDTRYISKKAVEYLSAICSDVKAF

PGQLTAELRHLWGLNNILQSAPDITFPLPVSATENHREYYVITNEQNEVIRLFPKQGETPRTEK

-continued

GELLLTGEVERKVFRCKGMQEFQTDVSDGKYWRRIKLSSSVTWSPLFAPKPISADGQIVLKGRI

EKGVFVCNQLKQKLKTGLPDGSYWISLPVISQTFKEGESVNNSKLTSQQVQLFGRVREGIFRCH

NYQCPASGADGNFWCTLDTDTAQPAFTPIKNAPPGVGGGQIILTGDVDDKGIFHADDDLHYELP

ASLPKGKYYGIFTVESCDPTLIPIELSAPKTSKGENLIEGNIWVDEHTGEVRFDPKKNREDQRH

HAIDAIVIALSSQSLFQRLSTYNARRENKKRGLDSTEHFPSPWPGFAQDVRQSVVPLLVSYKQN

PKTLCKISKTLYKDGKKIHSCGNAVRGQLHKETVYGQRTAPGATEKSYHIRKDIRELKTSKHIG

KVVDITIRQMLLKHLQENYHIDITQEFNIPSNAFFKEGVYRIFLPNKHGEPVPIKKIRMKEELG

NAERLKDNINQYVNPRNNHHVMIYQDADGNLKEEIVSFWSVIERQNQGQPIYQLPREGRNIVSI

LQINDTFLIGLKEEEPEVYRNDLSTLSKHLYRVQKLSGMYYTFRHHLASTLNNEREEFRIQSLE

AWKRANPVKVQIDEIGRITFLNGPLC

SEQ ID NO: 336

MESSQILSPIGIDLGGKFTGVCLSHLEAFAELPNHANTKYSVILIDHNNFQLSQAQRRATRHRV

RNKKRNQFVKRVALQLFQHILSRDLNAKEETALCHYLNNRGYTYVDTDLDEYIKDETTINLLKE

LLPSESEHNFIDWFLQKMQSSEFRKILVSKVEEKKDDKELKNAVKNIKNFITGFEKNSVEGHRH

RKVYFENIKSDITKDNQLDSIKKKIPSVCLSNLLGHLSNLQWKNLHRYLAKNPKQFDEQTFGNE

FLRMLKNFRHLKGSQESLAVRNLIQQLEQSQDYISILEKTPPEITIPPYEARTNTGMEKDQSLL

LNPEKLNNLYPNWRNLIPGIIDAHPFLEKDLEHTKLRDRKRIISPSKQDEKRDSYILQRYLDLN

KKIDKFKIKKQLSFLGQGKQLPANLIETQKEMETHFNSSLVSVLIQIASAYNKEREDAAQGIWF

DNAFSLCELSNINPPRKQKILPLLVGAILSEDFINNKDKWAKFKIFWNTHKIGRTSLKSKCKEI

EEARKNSGNAFKIDYEEALNHPEHSNNKALIKIIQTIPDIIQAIQSHLGHNDSQALIYHNPFSL

SQLYTILETKRDGFHKNCVAVTCENYWRSQKTEIDPEISYASRLPADSVRPFDGVLARMMQRLA

YEIAMAKWEQIKHIPDNSSLLIPIYLEQNRFEFEESFKKIKGSSSDKTLEQAIEKQNIQWEEKF

QRIINASMNICPYKGASIGGQGEIDHIYPRSLSKKHFGVIFNSEVNLIYCSSQGNREKKEEHYL

LEHLSPLYLKHQFGTDNVSDIKNFISQNVANIKKYISFHLLTPEQQKAARHALFLDYDDEAFKT

ITKFLMSQQKARVNGTQKFLGKQIMEFLSTLADSKQLQLEFSIKQITAEEVHDHRELLSKQEPK

LVKSRQQSFPSHAIDATLTMSIGLKEFPQFSQELDNSWFINHLMPDEVHLNPVRSKEKYNKPNI

SSTPLFKDSLYAERFIPVWVKGETFAIGFSEKDLFEIKPSNKEKLFTLLKTYSTKNPGESLQEL

QAKSKAKWLYFPINKTLALEFLHHYFHKEIVTPDDTTVCHFINSLRYYTKKESITVKILKEPMP

VLSVKFESSKKNVLGSFKHTIALPATKDWERLFNHPNFLALKANPAPNPKEFNEFIRKYFLSDN

NPNSDIPNNGHNIKPQKHKAVRKVFSLPVIPGNAGTMMRIRRKDNKGQPLYQLQTIDDTPSMGI

QINEDRLVKQEVLMDAYKTRNLSTIDGINNSEGQAYATFDNWLTLPVSTFKPEIIKLEMKPHSK

TRRYIRITQSLADFIKTIDEALMIKPSDSIDDPLNMPNEIVCKNKLFGNELKPRDGKMKIVSTG

KIVTYEFESDSTPQWIQTLYVTQLKKQP

SEQ ID NO: 337

MKKIVGLDLGTNSIGWALINAYINKEHLYGIEACGSRIIPMDAAILGNFDKGNSISQTADRTSY

RGIRRLRERHLLRRERLHRILDLLGFLPKHYSDSLNRYGKFLNDIECKLPWVKDETGSYKFIFQ

ESFKEMLANFTEHHPILIANNKKVPYDWTIYYLRKKALTQKISKEELAWILLNFNQKRGYYQLR

GEEEETPNKLVEYYSLKVEKVEDSGERKGKDTWYNVHLENGMIYRRTSNIPLDWEGKTKEFIVT

TDLEADGSPKKDKEGNIKRSFRAPKDDDWTLIKKKTEADIDKIKMTVGAYIYDTLLQKPDQKIR

GKLVRTIERKYYKNELYQILKTQSEFHEELRDKQLYIACLNELYPNNEPRRNSISTRDFCHLFI

EDIIFYQRPLKSKKSLIDNCPYEENRYIDKESGEIKHASIKCIAKSHPLYQEFRLWQFIVNLRI

YRKETDVDVTQELLPTEADYVTLFEWLNEKKEIDQKAFFKYPPFGFKKTTSNYRWNYVEDKPYP

-continued

CNETHAQIIARLGKAHIPKAFLSKEKEETLWHILYSIEDKQEIEKALHSFANKNNLSEEFIEQF

KNFPPFKKEYGSYSAKAIKKLLPLMRMGKYWSIENIDNGTRIRINKIIDGEYDENIRERVRQKA

INLTDITHFRALPLWLACYLVYDRHSEVKDIVKWKTPKDIDLYLKSFKQHSLRNPIVEQVITET

LRTVRDIWQQVGHIDEIHIELGREMKNPADKRARMSQQMIKNENTNLRIKALLTEFLNPEFGIE

NVRPYSPSQQDLLRIYEEGVLNSILELPEDIGIILGKFNQTDTLKRPTRSEILRYKLWLEQKYR

SPYTGEMIPLSKLFTPAYEIEHIIPQSRYFDDSLSNKVICESEINKLKDRSLGYEFIKNHHGEK

VELAFDKPVEVLSVEAYEKLVHESYSHNRSKMKKLLMEDIPDQFIERQLNDSRYISKVVKSLLS

NIVREENEQEAISKNVIPCTGGITDRLKKDWGINDVWNKIVLPRFIRLNELTESTRFTSINTNN

TMIPSMPLELQKGFNKKRIDHRHHAMDAIIIACANRNIVNYLNNVSASKNTKITRRDLQTLLCH

KDKTDNNGNYKWVIDKPWETFTQDTLTALQKITVSFKQNLRVINKTTNHYQHYENGKKIVSNQS

KGDSWAIRKSMHKETVHGEVNLRMIKTVSFNEALKKPQAIVEMDLKKKILAMLELGYDTKRIKN

YFEENKDTWQDINPSKIKVYYFTKETKDRYFAVRKPIDTSFDKKKIKESITDTGIQQIMLRHLE

TKDNDPTLAFSPDGIDEMNRNILILNKGKKHQPIYKVRVYEKAEKFTVGQKGNKRTKFVEAAKG

TNLFFAIYETEEIDKDTKKVIRKRSYSTIPLNVVIERQKQGLSSAPEDENGNLPKYILSPNDLV

YVPTQEEINKGEVVMPIDRDRIYKMVDSSGITANFIPASTANLIFALPKATAEIYCNGENCIQN

EYGIGSPQSKNQKAITGEMVKEICFPIKVDRLGNIIQVGSCILTN

SEQ ID NO: 338
MSRSLTFSFDIGYASIGWAVIASASHDDADPSVCGCGTVLFPKDDCQAFKRREYRRLRRNIRSR

RVRIERIGRLLVQAQIITPEMKETSGHPAPFYLASEALKGHRTLAPIELWHVLRWYAHNRGYDN

NASWSNSLSEDGGNGEDTERVKHAQDLMDKHGTATMAETICRELKLEEGKADAPMEVSTPAYKN

LNTAFPRLIVEKEVRRILELSAPLIPGLTAEIIELIAQHHPLTTEQRGVLLQHGIKLARRYRGS

LLFGQLIPRFDNRIISRCPVTWAQVYEAELKKGNSEQSARERAEKLSKVPTANCPEFYEYRMAR

ILCNIRADGEPLSAEIRRELMNQARQEGKLTKASLEKAISSRLGKETETNVSNYFTLHPDSEEA

LYLNPAVEVLQRSGIGQILSPSVYRIAANRLRRGKSVTPNYLLNLLKSRGESGEALEKKIEKES

KKKEADYADTPLKPKYATGRAPYARTVLKKVVEEILDGEDPTRPARGEAHPDGELKAHDGCLYC

LLDTDSSVNQHQKERRLDTMTNNHLVRHRMLILDRLLKDLIQDFADGQKDRISRVCVEVGKELT

TFSAMDSKKIQRELTLRQKSHTDAVNRLKRKLPGKALSANLIRKCRIAMDMNWTCPFTGATYGD

HELENLELEHIVPHSFRQSNALSSLVLTWPGVNRMKGQRTGYDFVEQEQENPVPDKPNLHICSL

NNYRELVEKLDDKKGHEDDRRRKKKRKALLMVRGLSHKHQSQNHEAMKEIGMTEGMMTQSSHLM

KLACKSIKTSLPDAHIDMIPGAVTAEVRKAWDVFGVFKELCPEAADPDSGKILKENLRSLTHLH

HALDACVLGLIPYIIPAHHNGLLRRVLAMRRIPEKLIPQVRPVANQRHYVLNDDGRMMLRDLSA

SLKENIREQLMEQRVIQHVPADMGGALLKETMQRVLSVDGSGEDAMVSLSKKKDGKKEKNQVKA

SKLVGVFPEGPSKLKALKAAIEIDGNYGVALDPKPVVIRHIKVFKRIMALKEQNGGKPVRILKK

GMLIHLTSSKDPKHAGVWRIESIQDSKGGVKLDLQRAHCAVPKNKTHECNWREVDLISLLKKYQ

MKRYPTSYTGTPR

SEQ ID NO: 339
MTQKVLGLDLGTNSIGSAVRNLDLSDDLQWQLEFFSSDIFRSSVNKESNGREYSLAAQRSAHRR

SRGLNEVRRRRLWATLNLLIKHGFCPMSSESLMRWCTYDKRKGLFREYPIDDKDFNAWILLDFN

GDGRPDYSSPYQLRRELVTRQFDFEQPIERYKLGRALYHIAQHRGFKSSKGETLSQQETNSKPS

STDEIPDVAGAMKASEEKLSKGLSTYMKEHNLLTVGAAFAQLEDEGVRVRNNNDYRAIRSQFQH

EIETIFKFQQGLSVESELYERLISEKKNVGTIFYKRPLRSQRGNVGKCTLERSKPRCAIGHPLF

-continued

EKFRAWTLINNIKVRMSVDTLDEQLPMKLRLDLYNECFLAFVRTEFKFEDIRKYLEKRLGIHFS
YNDKTINYKDSTSVAGCPITARFRKMLGEEWESFRVEGQKERQAHSKNNISFHRVSYSIEDIWH
FCYDAEEPEAVLAFAQETLRLERKKAEELVRIWSAMPQGYAMLSQKAIRNINKILMLGLKYSDA
VILAKVPELVDVSDEELLSIAKDYYLVEAQVNYDKRINSIVNGLIAKYKSVSEEYRFADHNYEY
LLDESDEKDIIRQIENSLGARRWSLMDANEQTDILQKVRDRYQDFFRSHERKFVESPKLGESFE
NYLTKKFPMVEREQWKKLYHPSQITIYRPVSVGKDRSVLRLGNPDIGAIKNPTVLRVLNTLRRR
VNQLLDDGVISPDETRVVVETARELNDANRKWALDTYNRIRHDENEKIKKILEEFYPKRDGIST
DDIDKARYVIDQREVDYFTGSKTYNKDIKKYKFWLEQGGQCMYTGRTINLSNLFDPNAFDIEHT
IPESLSFDSSDMNLTLCDAHYNRFIKKNHIPTDMPNYDKAITIDGKEYPAITSQLQRWVERVER
LNRNVEYWKGQARRAQNKDRKDQCMREMHLWKMELEYWKKKLERFTVTEVTDGFKNSQLVDTRV
ITRHAVLYLKSIFPHVDVQRGDVTAKFRKILGIQSVDEKKDRSLHSHHAIDATTLTIIPVSAKR
DRMLELFAKIEEINKMLSFSGSEDRTGLIQELEGLKNKLQMEVKVCRIGHNVSEIGTFINDNII
VNHHIKNQALTPVRRRLRKKGYIVGGVDNPRWQTGDALRGEIHKASYYGAITQFAKDDEGKVLM
KEGRPQVNPTIKFVIRRELKYKKSAADSGFASWDDLGKAIVDKELFALMKGQFPAETSFKDACE
QGIYMIKKGKNGMPDIKLHHIRHVRCEAPQSGLKIKEQTYKSEKEYKRYFYAAVGDLYAMCCYT
NGKIREFRIYSLYDVSCHRKSDIEDIPEFITDKKGNRLMLDYKLRTGDMILLYKDNPAELYDLD
NVNLSRRLYKINRFESQSNLVLMTHHLSTSKERGRSLGKTVDYQNLPESIRSSVKSLNFLIMGE
NRDFVIKNGKIIFNHR

SEQ ID NO: 340
MLVSPISVDLGGKNTGFFSFTDSLDNSQSGTVIYDESFVLSQVGRRSKRHSKRNNLRNKLVKRL
FLLILQEHHGLSIDVLPDEIRGLFNKRGYTYAGFELDEKKKDALESDTLKEFLSEKLQSIDRDS
DVEDFLNQIASNAESFKDYKKGFEAVFASATHSPNKKLELKDELKSEYGENAKELLAGLRVTKE
ILDEFDKQENQGNLPRAKYFEELGEYIATNEKVKSFFDSNSLKLTDMTKLIGNISNYQLKELRR
YFNDKEMEKGDIWIPNKLHKITERFVRSWHPKNDADRQRRAELMKDLKSKEIMELLTTTEPVMT
IPPYDDMNNRGAVKCQTLRLNEEYLDKHLPNWRDIAKRLNHGKFNDDLADSTVKGYSEDSTLLH
RLLDTSKEIDIYELRGKKPNELLVKTLGQSDANRLYGFAQNYYELIRQKVRAGIWVPVKNKDDS
LNLEDNSNMLKRCNHNPPHKKNQIHNLVAGILGVKLDEAKFAEFEKELWSAKVGNKKLSAYCKN
IEELRKTHGNTFKIDIEELRKKDPAELSKEEKAKLRLTDDVILNEWSQKIANFFDIDDKHRQRF
NNLFSMAQLHTVIDTPRSGFSSTCKRCTAENRFRSETAFYNDETGEFHKKATATCQRLPADTQR
PFSGKIERYIDKLGYELAKIKAKELEGMEAKEIKVPIILEQNAFEYEESLRKSKTGSNDRVINS
KKDRDGKKLAKAKENAEDRLKDKDKRIKAFSSGICPYCGDTIGDDGEIDHILPRSHTLKIYGTV
FNPEGNLIYVHQKCNQAKADSIYKLSDIKAGVSAQWIEEQVANIKGYKTFSVLSAEQQKAFRYA
LFLQNDNEAYKKVVDWLRTDQSARVNGTQKYLAKKIQEKLTKMLPNKHLSFEFILADATEVSEL
RRQYARQNPLLAKAEKQAPSSHAIDAVMAFVARYQKVFKDGTPPNADEVAKLAMLDSWNPASNE
PLTKGLSTNQKIEKMIKSGDYGQKNMREVFGKSIFGENAIGERYKPIVVQEGGYYIGYPATVKK
GYELKNCKVVTSKNDIAKLEKIIKNQDLISLKENQYIKIFSINKQTISELSNRYFNMNYKNLVE
RDKEIVGLLEFIVENCRYYTKKVDVKFAPKYIHETKYPFYDDWRRFDEAWRYLQENQNKTSSKD
RFVIDKSSLNEYYQPDKNEYKLDVDTQPIWDDFCRWYFLDRYKTANDKKSIRIKARKTFSLLAE
SGVQGKVFRAKRKIPTGYAYQALPMDNNVIAGDYANILLEANSKTLSLVPKSGISIEKQLDKKL
DVIKKTDVRGLAIDNNSFFNADFDTHGIRLIVENTSVKVGNFPISAIDKSAKRMIFRALFEKEK

GKRKKKTTISFKESGPVQDYLKVFLKKIVKIQLRTDGSISNIVVRKNAADFTLSFRSEHIQKLL
K

SEQ ID NO: 341
MAYRLGLDIGITSVGWAVVALEKDESGLKPVRIQDLGVRIFDKAEDSKTGASLALPRREARSAR
RRTRRRRHRLWRVKRLLEQHGILSMEQIEALYAQRTSSPDVYALRVAGLDRCLIAEEIARVLIH
IAHRRGFQSNRKSEIKDSDAGKLLKAVQENENLMQSKGYRTVAEMLVSEATKTDAEGKLVHGKK
HGYVSNVRNKAGEYRHTVSRQAIVDEVRKIFAAQRALGNDVMSEELEDSYLKILCSQRNFDDGP
GGDSPYGHGSVSPDGVRQSIYERMVGSCTFETGEKRAPRSSYSFERFQLLTKVVNLRIYRQQED
GGRYPCELTQTERARVIDCAYEQTKITYGKLRKLLDMKDTESFAGLTYGLNRSRNKTEDTVFVE
MKFYHEVRKALQRAGVFIQDLSIETLDQIGWILSVWKSDDNRRKKLSTLGLSDNVIEELLPLNG
SKFGHLSLKAIRKILPFLEDGYSYDVACELAGYQFQGKTEYVKQRLLPPLGEGEVTNPVVRRAL
SQAIKVVNAVIRKHGSPESIHIELARELSKNLDERRKIEKAQKENQKNNEQIKDEIREILGSAH
VTGRDIVKYKLFKQQQEFCMYSGEKLDVTRLFEPGYAEVDHIIPYGISFDDSYDNKVLVKTEQN
RQKGNRTPLEYLRDKPEQKAKFIALVESIPLSQKKKNHLLMDKRAIDLEQEGFRERNLSDTRYI
TRALMNHIQAWLLFDETASTRSKRVVCVNGAVTAYMRARWGLTKDRDAGDKHHAADAVVACIG
DSLIQRVTKYDKFKRNALADRNRYVQQVSKSEGITQYVDKETGEVFTWESFDERKFLPNEPLEP
WPFFRDELLARLSDDPSKNIRAIGLLTYSETEQIDPIFVSRMPTRKVTGAAHKETIRSPRIVKV
DDNKGTEIQVVVSKVALTELKLTKDGEIKDYFRPEDDPRLYNTLRERLVQFGGDAKAAFKEPVY
KISKDGSVRTPVRKVKIQEKLTLGVPVHGGRGIAENGGMVRIDVFAKGGKYYFVPIYVADVLKR
ELPNRLATAHKPYSEWRVVDDSYQFKFSLYPNDAVMIKPSREVDITYKDRKEPVGCRIMYFVSA
NIASASISLRTHDNSGELEGLGIQGLEVFEKYVVGPLGDTHPVYKERRMPFRVERKMN

SEQ ID NO: 342
MPVLSPLSPNAAQGRRRWSLALDIGEGSIGWAVAEVDAEGRVLQLTGTGVTLFPSAWSNENGTY
VAHGAADRAVRGQQQRHDSRRRRLAGLARLCAPVLERSPEDLKDLTRTPPKADPRAIFFLRADA
ARRPLDGPELFRVLHHMAAHRGIRLAELQEVDPPPESDADDAAPAATEDEDGTRRAAADERAFR
RLMAEHMRHGTQPTCGEIMAGRLRETPAGAQPVTRARDGLRVGGGVAVPTRALIEQEFDAIRA
IQAPRHPDLPWDSLRRLVLDQAPIAVPPATPCLFLEELRRRGETFQGRTITREAIDRGLTVDPL
IQALRIRETVGNLRLHERITEPDGRQRYVPRAMPELGLSHGELTAPERDTLVRALMHDPDGLAA
KDGRIPYTRLRKLIGYDNSPVCFAQERDTSGGGITVNPTDPLMARWIDGWVDLPLKARSLYVRD
VVARGADSAALARLLAEGAHGVPPVAAAAVPAATAAILESDIMQPGRYSVCPWAAEAILDAWAN
APTEGFYDVTRGLFGFAPGEIVLEDLRRARGALLAHLPRTMAAARTPNRAAQQRGPLPAYESVI
PSQLITSLRRAHKGRAADWSAADPEERNPFLRTWTGNAATDHILNQVRKTANEVITKYGNRRGW
DPLPSRITVELAREAKHGVIRRNEIAKENRENEGRRKKESAALDTFCQDNTVSWQAGGLPKERA
ALRLRLAQRQEFFCPYCAERPKLRATDLFSPAETEIDHVIERRMGGDGPDNLVLAHKDCNNAKG
KKTPHEHAGDLLDSPALAALWQGWRKENADRLKGKGHKARTPREDKDFMDRVGWRFEEDARAKA
EENQERRGRRMLHDTARATRLARLYLAAAVMPEDPAEIGAPPVETPPSPEDPTGYTAIYRTISR
VQPVNGSVTHMLRQRLLQRDKNRDYQTHHAEDACLLLLAGPAVVQAFNTEAAQHGADAPDDRPV
DLMPTSDAYHQQRRARALGRVPLATVDAALADIVMPESDRQDPETGRVHWRLTRAGRGLKRRID
DLTRNCVILSRPRRPSETGTPGALHNATHYGRREITVDGRTDTVVTQRMNARDLVALLDNAKIV
PAARLDAAAPGDTILKEICTEIADRHDRVVDPEGTHARRWISARLAALVPAHAEAVARDIAELA
DLDALADADRTPEQEARRSALRQSPYLGRAISAKKADGRARAREQEILTRALLDPHWGPRGLRH

-continued

LIMREARAPSLVRIRANKTDAFGRPVPDAAVWVKTDGNAVSQLWRLTSVVTDDGRRIPLPKPIE

KRIEISNLEYARLNGLDEGAGVTGNNAPPRPLRQDIDRLTPLWRDHGTAPGGYLGTAVGELEDK

ARSALRGKAMRQTLTDAGITAEAGWRLDSEGAVCDLEVAKGDTVKKDGKTYKVGVITQGIFGMP

VDAAGSAPRTPEDCEKFEEQYGIKPWKAKGIPLA

SEQ ID NO: 343

MNYTEKEKLFMKYILALDIGIASVGWAILDKESETVIEAGSNIFPEASAADNQLRRDMRGAKRN

NRRLKTRINDFIKLWENNNLSIPQFKSTEIVGLKVRAITEEITLDELYLILYSYLKHRGISYLE

DALDDTVSGSSAYANGLKLNAKELETHYPCEIQQERLNTIGKYRGQSQIINENGEVLDLSNVFT

IGAYRKEIQRVFEIQKKYHPELTDEFCDGYMLIFNRKRKYYEGPGNEKSRTDYGRFTTKLDANG

NYITEDNIFEKLIGKCSVYPDELRAAAASYTAQEYNVLNDLNNLTINGRKLEENEKHEIVERIK

SSNTINMRKIISDCMGENIDDFAGARIDKSGKEIFHKFEVYNKMRKALLEIGIDISNYSREELD

EIGYIMTINTDKEAMMEAFQKSWIDLSDDVKQCLINMRKTNGALFNKWQSFSLKIMNELIPEMY

AQPKEQMTLLTEMGVTKGTQEEFAGLKYIPVDVVSEDIFNPVVRRSVRISFKILNAVLKKYKAL

DTIVIEMPRDRNSEEQKKRINDSQKLNEKEMEYIEKKLAVTYGIKLSPSDFSSQKQLSLKLKLW

NEQDGICLYSGKTIDPNDIINNPQLFEIDHIIPRSISFDDARSNKVLVYRSENQKKGNQTPYYY

LTHSHSEWSFEQYKATVMNLSKKKEYAISRKKIQNLLYSEDITKMDVLKGFINRNINDTSYASR

LVLNTIQNFFMANEADTKVKVIKGSYTHQMRCNLKLDKNRDESYSHHAVDAMLIGYSELGYEAY

HKLQGEFIDFETGEILRKDMWDENMSDEVYADYLYGKKWANIRNEVVKAEKNVKYWHYVMRKSN

RGLCNQTIRGTREYDGKQYKINKLDIRTKEGIKVFAKLAFSKKDSDRERLLVYLNDRRTFDDLC

KIYEDYSDAANPFVQYEKETGDIIRKYSKKHNGPRIDKLKYKDGEVGACIDISHKYGFEKGSKK

VILESLVPYRMDVYYKEENHSYYLVGVKQSDIKFEKGRNVIDEEAYARILVNEKMIQPGQSRAD

LENLGFKFKLSFYKNDIIEYEKDGKIYTERLVSRTMPKQRNYIETKPIDKAKFEKQNLVGLGKT

KFIKKYRYDILGNKYSCSEEKFTSFC

SEQ ID NO: 344

MLRLYCANNLVLNNVQNLWKYLLLLIFDKKIIFLFKIKVILIRRYMENNNKEKIVIGFDLGVAS

VGWSIVNAETKEVIDLGVRLFSEPEKADYRRAKRTTRRLLRRKKFKREKFHKLILKNAEIFGLQ

SRNEILNVYKDQSSKYRNILKLKINALKEEIKPSELVWILRDYLQNRGYFYKNEKLTDEFVSNS

FPSKKLHEHYEKYGFFRGSVKLDNKLDNKKDKAKEKDEEEESDAKKESEELIFSNKQWINEIVK

VFENQSYLTESFKEEYLKLFNYVRPFNKGPGSKNSRTAYGVFSTDIDPETNKFKDYSNIWDKTI

GKCSLFEEEIRAPKNLPSALIFNLQNEICTIKNEFTEFKNWWLNAEQKSEILKFVFTELFNWKD

KKYSDKKFNKNLQDKIKKYLLNFALENFNLNEEILKNRDLENDTVLGLKGVKYYEKSNATADAA

LEFSSLKPLYVFIKFLKEKKLDLNYLLGLENTEILYFLDSIYLAISYSSDLKERNEWFKKLLKE

LYPKIKNNNLEIIENVEDIFEITDQEKFESFSKTHSLSREAFNHIIPLLLSNNEGKNYESLKHS

NEELKKRTEKAELKAQQNQKYLKDNFLKEALVPLSVKTSVLQAIKIFNQIIKNFGKKYEISQVV

IEMARELTKPNLEKLLNNATNSNIKILKEKLDQTEKFDDFTKKKFIDKIENSVVFRNKLFLWFE

QDRKDPYTQLDIKINEIEDETEIDHVIPYSKSADDSWFNKLLVKKSTNQLKKNKTVWEYYQNES

DPEAKWNKFVAWAKRIYLVQKSDKESKDNSEKNSIFKNKKPNLKFKNITKKLFDPYKDLGFLAR

NLNDTRYATKVFRDQLNNYSKHHSKDDENKLFKVVCMNGSITSFLRKSMWRKNEEQVYRFNFWK

KDRDQFFHHAVDASIIAIFSLLTKTLYNKLRVYESYDVQRREDGVYLINKETGEVKKADKDYWK

DQHNFLKIRENAIEIKNVLNNVDFQNQVRYSRKANTKLNTQLFNETLYGVKEFENNFYKLEKVN

LFSRKDLRKFILEDLNEESEKNKKNENGSRKRILTEKYIVDEILQILENEEFKDSKSDINALNK

YMDSLPSKFSEFFSQDFINKCKKENSLILTFDAIKHNDPKKVIKIKNLKFFREDATLKNKQAVH

KDSKNQIKSFYESYKCVGFIWLKNKNDLEESIFVPINSRVIHFGDKDKDIFDFDSYNKEKLLNE

INLKRPENKKFNSINEIEFVKFVKPGALLLNFENQQIYYISTLESSSLRAKIKLLNKMDKGKAV

SMKKITNPDEYKIIEHVNPLGINLNWTKKLENNN

SEQ ID NO: 345
MLMSKHVLGLDLGVGSIGWCLIALDAQGDPAEILGMGSRVVPLNNATKAIEAFNAGAAFTASQE

RTARRTMRRGFARYQLRRYRLRRELEKVGMLPDAALIQLPLLELWELRERAATAGRRLTLPELG

RVLCHINQKRGYRHVKSDAAAIVGDEGEKKKDSNSAYLAGIRANDEKLQAEHKTVGQYFAEQLR

QNQSESPTGGISYRIKDQIFSRQCYIDEYDQIMAVQRVHYPDILTDEFIRMLRDEVIFMQRPLK

SCKHLVSLCEFEKQERVMRVQQDDGKGGWQLVERRVKFGPKVAPKSSPLFQLCCIYEAVNNIRL

TRPNGSPCDITPEERAKIVAHLQSSASLSFAALKKLLKEKALIADQLTSKSGLKGNSTRVALAS

ALQPYPQYHHLLDMELETRMMTVQLTDEETGEVTEREVAVVTDSYVRKPLYRLWHILYSIEERE

AMRRALITQLGMKEEDLDGGLLDQLYRLDFVKPGYGNKSAKFICKLLPQLQQGLGYSEACAAVG

YRHSNSPTSEEITERTLLEKIPLLQRNELRQPLVEKILNQMINLVNALKAEYGIDEVRVELARE

LKMSREERERMARNNKDREERNKGVAAKIRECGLYPTKPRIQKYMLWKEAGRQCLYCGRSIEEE

QCLREGGMEVEHIIPKSVLYDDSYGNKTCACRRCNKEKGNRTALEYIRAKGREAEYMKRINDLL

KEKKISYSKHQRLRWLKEDIPSDFLERQLRLTQYISRQAMAILQQGIRRVSASEGGVTARLRSL

WGYGKILHTLNLDRYDSMGETERVSREGEATEELHITNWSKRMDHRHHAIDALVVACTRQSYIQ

RLNRLSSEFGREDKKKEDQEAQEQQATETGRLSNLERWLTQRPHFSVRTVSDKVAEILISYRPG

QRVVTRGRNIYRKKMADGREVSCVQRGVLVPRGELMEASFYGKILSQGRVRIVKRYPLHDLKGE

VVDPHLRELITTYNQELKSREKGAPIPPLCLDKDKKQEVRSVRCYAKTLSLDKAIPMCFDEKGE

PTAFVKSASNHHLALYRTPKGKLVESIVTFWDAVDRARYGIPLVITHPREVMEQVLQRGDIPEQ

VLSLLPPSDWVFVDSLQQDEMVVIGLSDEELQRALEAQNYRKISEHLYRVQKMSSSYYVFRYHL

ETSVADDKNTSGRIPKFHRVQSLKAYEERNIRKVRVDLLGRISLL

SEQ ID NO: 346
MSDLVLGLDIGIGSVGVGILNKVTGEIIHKNSRIFPAAQAENNLVRRTNRQGRRLARRKKHRRV

RLNRLFEESGLITDFTKISINLNPYQLRVKGLTDELSNEELFIALKNMVKHRGISYLDDASDDG

NSSVGDYAQIVKENSKQLETKTPGQIQLERYQTYGQLRGDFTVEKDGKKHRLINVFPTSAYRSE

ALRILQTQQEFNPQITDEFINRYLEILTGKRKYYHGPGNEKSRTDYGRYRTSGETLDNIFGILI

GKCTFYPDEFRAAKASYTAQEFNLLNDLNNLTVPTETKKLSKEQKNQIINYVKNEKAMGPAKLF

KYIAKLLSCDVADIKGYRIDKSGKAEIHTFEAYRKMKTLETLDIEQMDRETLDKLAYVLTLNTE

REGIQEALEHEFADGSFSQKQVDELVQFRKANSSIFGKGWHNFSVKLMMELIPELYETSEEQMT

ILTRLGKQKTTSSSNKTKYIDEKLLTEEIYNPVVAKSVRQAIKIVNAAIKEYGDFDNIVIEMAR

ETNEDDEKKAIQKIQKANKDEKDAAMLKAANQYNGKAELPHSVFHGHKQLATKIRLWHQQGERC

LYTGKTISIHDLINNSNQFEVDHILPLSITFDDSLANKVLVYATANQEKGQRTPYQALDSMDDA

WSFRELKAFVRESKTLSNKKKEYLLTEEDISKFDVRKKFIERNLVDTRYASRVVLNALQEHFRA

HKIDTKVSVVRGQFTSQLRRHWGIEKTRDTYHHHAVDALIIAASSQLNLWKKQKNTLVSYSEDQ

LLDIETGELISDDEYKESVFKAPYQHFVDTLKSKEFEDSILFSYQVDSKFNRKISDATIYATRQ

AKVGKDKADETYVLGKIKDIYTQDGYDAFMKIYKKDKSKFLMYRHDPQTFEKVIEPILENYPNK

QINEKGKEVPCNPFLKYKEEHGYIRKYSKKGNGPEIKSLKYYDSKLGNHIDITPKDSNNKVVLQ

SVSPWRADVYFNKTTGKYEILGLKYADLQFEKGTGTYKISQEKYNDIKKKEGVDSDSEFKFTLY

-continued

KNDLLLVKDTETKEQQLFRFLSRTMPKQKHYVELKPYDKQKFEGGEALIKVLGNVANSGQCKKG

LGKSNISIYKVRTDVLGNQHIIKNEGDKPKLDF

SEQ ID NO: 347
MNAEHGKEGLLIMEENFQYRIGLDIGITSVGWAVLQNNSQDEPVRITDLGVRIFDVAENPKNGD

ALAAPRRDARTTRRRLRRRRHRLERIKFLLQENGLIEMDSFMERYYKGNLPDVYQLRYEGLDRK

LKDEELAQVLIHIAKHRGFRSTRKAETKEKEGGAVLKATTENQKIMQEKGYRTVGEMLYLDEAF

HTECLWNEKGYVLTPRNRPDDYKHTILRSMLVEEVHAIFAAQRAHGNQKATEGLEEAYVEIMTS

QRSFDMGPGLQPDGKPSPYAMEGFGDRVGKCTFEKDEYRAPKATYTAELFVALQKINHTKLIDE

FGTGRFFSEEERKTIIGLLLSSKELKYGTIRKKLNIDPSLKFNSLNYSAKKEGETEEERVLDTE

KAKFASMFWTYEYSKCLKDRTEEMPVGEKADLFDRIGEILTAYKNDDSRSSRLKELGLSGEEID

GLLDLSPAKYQRVSLKAMRKMQPYLEDGLIYDKACEAAGYDFRALNDGNKKHLLKGEEINAIVN

DITNPVVKRSVSQTIKVINAIIQKYGSPQAVNIELAREMSKNFQDRTNLEKEMKKRQQENERAK

QQIIELGKQNPTGQDILKYRLWNDQGGYCLYSGKKIPLEELFDGGYDIDHILPYSITFDDSYRN

KVLVTAQENRQKGNRTPYEYFGADEKRWEDYEASVRLLVRDYKKQQKLLKKNFTEEERKEFKER

NLNDTKYITRVVYNMIRQNLELEPFNHPEKKKQVWAVNGAVTSYLRKRWGLMQKDRSTDRHHAM

DAVVIACCTDGMIHKISRYMQGRELAYSRNFKFPDEETGEILNRDNFTREQWDEKFGVKVPLPW

NSFRDELDIRLLNEDPKNFLLTHADVQRELDYPGWMYGEEESPIEEGRYINYIRPLFVSRMPNH

KVTGSAHDATIRSARDYETRGVVITKVPLTDLKLNKDNEIEGYYDKDSDRLLYQALVRQLLLHG

NDGKKAFAEDFHKPKADGTEGPVVRKVKIEKKQTSGVMVRGGTGIAANGEMVRIDVFRENGKYY

FVPVYTADVVRKVLPNRAATHTKPYSEWRVMDDANFVFSLYSRDLIHVKSKKDIKTNLVNGGLL

LQKEIFAYYTGADIATASIAGFANDSNFKFRGLGIQSLEIFEKCQVDILGNISVVRHENRQEFH

SEQ ID NO: 348
MRVLGLDAGIASLGWALIEIEESNRGELSQGTIIGAGTWMFDAPEEKTQAGAKLKSEQRRTFRG

QRRVVRRRRQRMNEVRRILHSHGLLPSSDRDALKQPGLDPWRIRAEALDRLLGPVELAVALGHI

ARHRGFKSNSKGAKTNDPADDTSKMKRAVNETREKLARFGSAAKMLVEDESFVLRQTPTKNGAS

EIVRRFRNREGDYSRSLLRDDLAAEMRALFTAQARFQSAIATADLQTAFTKAAFFQRPLQDSEK

LVGPCPFEVDEKRAPKRGYSFELFRFLSRLNHVTLRDGKQERTLTRDELALAAADFGAAAKVSF

TALRKKLKLPETTVFVGVKADEESKLDVVARSGKAAEGTARLRSVIVDALGELAWGALLCSPEK

LDKIAEVISFRSDIGRISEGLAQAGCNAPLVDALTAAASDGRFDPFTGAGHISSKAARNILSGL

RQGMTYDKACCAADYDHTASRERGAFDVGGHGREALKRILQEERISRELVGSPTARKALIESIK

QVKAIVERYGVPDRIHVELARDVGKSIEEREEITRGIEKRNRQKDKLRGLFEKEVGRPPQDGAR

GKEELLRFELWSEQMGRCLYTDDYISPSQLVATDDAVQVDHILPWSRFADDSYANKTLCMAKAN

QDKKGRTPYEWFKAEKTDTEWDAFIVRVEALADMKGFKKRNYKLRNAEEAAAKFRNRNLNDTRW

ACRLLAEALKQLYPKGEKDKDGKERRRVFSRPGALTDRLRRAWGLQWMKKSTKGDRIPDDRHHA

LDAIVIAATTESLLQRATREVQEIEDKGLHYDLVKNVTPPWPGFREQAVEAVEKVFVARAERRR

ARGKAHDATIRHIAVREGEQRVYERRKVAELKLADLDRVKDAERNARLIEKLRNWIEAGSPKDD

PPLSPKGDPIFKVRLVTKSKVNIALDTGNPKRPGTVDRGEMARVDVFRKASKKGKYEYYLVPIY

PHDIATMKTPPIRAVQAYKPEDEWPEMDSSYEFCWSLVPMTYLQVISSKGEIFEGYYRGMNRSV

GAIQLSAHSNSSDVVQGIGARTLTEFKKFNVDRFGRKHEVERELRTWRGETWRGKAYI

SEQ ID NO: 349
MGNYYLGLDVGIGSIGWAVINIEKKRIEDFNVRIFKSGEIQEKNRNSRASQQCRRSRGLRRLYR

RKSHRKLRLKNYLSIIGLTTSEKIDYYYETADNNVIQLRNKGLSEKLTPEEIAACLIHICNNRG

-continued

```
YKDFYEVNVEDIEDPDERNEYKEEHDSIVLISNLMNEGGYCTPAEMICNCREFDEPNSVYRKFH

NSAASKNHYLITRHMLVKEVDLILENQSKYYGILDDKTIAKIKDIIFAQRDFEIGPGKNERFRR

FTGYLDSIGKCQFFKDQERGSRFTVIADIYAFVNVLSQYTYTNNRGESVFDTSFANDLINSALK

NGSMDKRELKAIAKSYHIDISDKNSDTSLTKCFKYIKVVKPLFEKYGYDWDKLIENYTDTDNNV

LNRIGIVLSQAQTPKRRREKLKALNIGLDDGLINELTKLKLSGTANVSYKYMQGSIEAFCEGDL

YGKYQAKFNKEIPDIDENAKPQKLPPFKNEDDCEFFKNPVVFRSINETRKLINAIIDKYGYPAA

VNIETADELNKTFEDRAIDTKRNNDNQKENDRIVKEIIECIKCDEVHARHLIEKYKLWEAQEGK

CLYSGETITKEDMLRDKDKLFEVDHIVPYSLILDNTINNKALVYAEENQKKGQRTPLMYMNEAQ

AADYRVRVNTMFKSKKCSKKKYQYLMLPDLNDQELLGGWRSRNLNDTRYICKYLVNYLRKNLRF

DRSYESSDEDDLKIRDHYRVFPVKSRFTSMFRRWWLNEKTWGRYDKAELKKLTYLDHAADAIII

ANCRPEYVVLAGEKLKLNKMYHQAGKRITPEYEQSKKACIDNLYKLFRMDRRTAEKLLSGHGRL

TPIIPNLSEEVDKRLWDKNIYEQFWKDDKDKKSCEELYRENVASLYKGDPKFASSLSMPVISLK

PDHKYRGTITGEEAIRVKEIDGKLIKLKRKSISEITAESINSIYTDDKILIDSLKTIFEQADYK

DVGDYLKKTNQHFFTTSSGKRVNKVTVIEKVPSRWLRKEIDDNNFSLLNDSSYYCIELYKDSKG

DNNLQGIAMSDIVHDRKTKKLYLKPDFNYPDDYYTHVMYIFPGDYLRIKSTSKKSGEQLKFEGY

FISVKNVNENSFRFISDNKPCAKDKRVSITKKDIVIKLAVDLMGKVQGENNGKGISCGEPLSLL

KEKN
```

SEQ ID NO: 350
```
MLSRQLLGASHLARPVSYSYNVQDNDVHCSYGERCFMRGKRYRIGIDVGLNSVGLAAVEVSDEN

SPVRLLNAQSVIHDGGVDPQKNKEAITRKNMSGVARRTRRMRRRKRERLHKLDMLLGKFGYPVI

EPESLDKPFEEWHVRAELATRYIEDDELRRESISIALRHMARHRGWRNPYRQVDSLISDNPYSK

QYGELKEKAKAYNDDATAAEEESTPAQLVVAMLDAGYAEAPRLRWRTGSKKPDAEGYLPVRLMQ

EDNANELKQIFRVQRVPADEWKPLFRSVFYAVSPKGSAEQRVGQDPLAPEQARALKASLAFQEY

RIANVITNLRIKDASAELRKLTVDEKQSIYDQLVSPSSEDITWSDLCDFLGFKRSQLKGVGSLT

EDGEERISSRPPRLTSVQRIYESDNKIRKPLVAWWKSASDNEHEAMIRLLSNTVDIDKVREDVA

YASAIEFIDGLDDDALTKLDSVDLPSGRAAYSVETLQKLTRQMLTTDDDLHEARKTLFNVTDSW

RPPADPIGEPLGNPSVDRVLKNVNRYLMNCQQRWGNPVSVNIEHVRSSFSSVAFARKDKREYEK

NNEKRSIFRSSLSEQLRADEQMEKVRESDLRRLEAIQRQNGQCLYCGRTITFRTCEMDHIVPRK

GVGSTNTRTNFAAVCAECNRMKSNTPFAIWARSEDAQTRGVSLAEAKKRVTMFTFNPKSYAPRE

VKAFKQAVIARLQQTEDDAAIDNRSIESVAWMADELHRRIDWYFNAKQYVNSASIDDAEAETMK

TTVSVFQGRVTASARRAAGIEGKIHFIGQQSKTRLDRRHHAVDASVIAMMNTAAAQTLMERESL

RESQRLIGLMPGERSWKEYPYEGTSRYESFHLWLDNMDVLLELLNDALDNDRIAVMQSQRYVLG

NSIAHDATIHPLEKVPLGSAMSADLIRRASTPALWCALTRLPDYDEKEGLPEDSHREIRVHDTR

YSADDEMGFFASQAAQIAVQEGSADIGSAIHHARVYRCWKTNAKGVRKYFYGMIRVFQTDLLRA

CHDDLFTVPLPPQSISMRYGEPRVVQALQSGNAQYLGSLVVGDEIEMDFSSLDVDGQIGEYLQF

FSQFSGGNLAWKHWVVDGFFNQTQLRIRPRYLAAEGLAKAFSDDVVPDGVQKIVTKQGWLPPVN

TASKTAVRIVRRNAFGEPRLSSAHHMPCSWQWRHE
```

SEQ ID NO: 351
```
MYSIGLDLGISSVGWSVIDERTGNVIDLGVRLFSAKNSEKNLERRTNRGGRRLIRRKTNRLKDA

KKILAAVGFYEDKSLKNSCPYQLRVKGLTEPLSRGEIYKVTLHILKKRGISYLDEVDTEAAKES

QDYKEQVRKNAQLLTKYTPGQIQLQRLKENNRVKTGINAQGNYQLNVFKVSAYANELATILKTQ
```

-continued

QAFYPNELTDDWIALFVQPGIAEEEAGLIYRKRPYYHGPGNEANNSPYGRWSDFQKTGEPATNIF

DKLIGKDFQGELRASGLSLSAQQYNLLNDLTNLKIDGEVPLSSEQKEYILTELMTKEFTRFGVN

DVVKLLGVKKERLSGWRLDKKGKPEIHTLKGYRNWRKIFAEAGIDLATLPTETIDCLAKVLTLN

TEREGIENTLAFELPELSESVKLLVLDRYKELSQSISTQSWHRFSLKTLHLLIPELMNATSEQN

TLLEQFQLKSDVRKRYSEYKKLPTKDVLAEIYNPTVNKTVSQAFKVIDALLVKYGKEQIRYITI

EMPRDDNEEDEKKRIKELHAKNSQRKNDSQSYFMQKSGWSQEKFQTTIQKNRRFLAKLLYYYEQ

DGICAYTGLPISPELLVSDSTEIDHIIPISISLDDSINNKVLVLSKANQVKGQQTPYDAWMDGS

FKKINGKFSNWDDYQKWVESRHFSHKKENNLLETRNIFDSEQVEKFLARNLNDTRYASRLVLNT

LQSFFTNQETKVRVVNGSFTHTLRKKWGADLDKTRETHHHHAVDATLCAVTSFVKVSRYHYAVK

EETGEKVMREIDFETGEIVNEMSYWEFKKSKKYERKTYQVKWPNFREQLKPVNLHPRIKFSHQV

DRKANRKLSDATIYSVREKTEVKTLKSGKQKITTDEYTIGKIKDIYTLDGWEAFKKKQDKLLMK

DLDEKTYERLLSIAETTPDFQEVEEKNGKVKRVKRSPFAVYCEENDIPAIQKYAKKNNGPLIRS

LKYYDGKLNKHINITKDSQGRPVEKTKNGRKVTLQSLKPYRYDIYQDLETKAYYTVQLYYSDLR

FVEGKYGITEKEYMKKVAEQTKGQVVRFCFSLQKNDGLEIEWKDSQRYDVRFYNFQSANSINFK

GLEQEMMPAENQFKQKPYNNGAINLNIAKYGKEGKKLRKFNTDILGKKHYLFYEKEPKNIIK

SEQ ID NO: 352

MYFYKNKENKLNKKVVLGLDLGIASVGWCLTDISQKEDNKFPIILHGVRLFETVDDSDDKLLNE

TRRKKRGQRRRNRRLFTRKRDFIKYLIDNNIIELEFDKNPKILVRNFIEKYINPFSKNLELKYK

SVTNLPIGFHNLRKAAINEKYKLDKSELIVLLYFYLSLRGAFFDNPEDTKSKEMNKNEIEIFDK

NESIKNAEFPIDKIIEFYKISGKIRSTINLKFGHQDYLKEIKQVFEKQNIDFMNYEKFAMEEKS

FFSRIRNYSEGPGNEKSFSKYGLYANENGNPELIINEKGQKIYTKIFKTLWESKIGKCSYDKKL

YRAPKNSFSAKVFDITNKLTDWKHKNEYISERLKRKILLSRFLNKDSKSAVEKILKEENIKFEN

LSEIAYNKDDNKINLPIINAYHSLTTIFKKHLINFENYLISNENDLSKLMSFYKQQSEKLFVPN

EKGSYEINQNNNVLHIFDAISNILNKFSTIQDRIRILEGYFEFSNLKKDVKSSEIYSEIAKLRE

FSGTSSLSFGAYYKFIPNLISEGSKNYSTISYEEKALQNQKNNFSHSNLFEKTWVEDLIASPTV

KRSLRQTMNLLKEIFKYSEKNNLEIEKIVVEVTRSSNNKHERKKIEGINKYRKEKYEELKKVYD

LPNENTTLLKKLWLLRQQQGYDAYSLRKIEANDVINKPWNYDIDHIVPRSISFDDSFSNLVIVN

KLDNAKKSNDLSAKQFIEKIYGIEKLKEAKENWGNWYLRNANGKAFNDKGKFIKLYTIDNLDEF

DNSDFINRNLSDTSYITNALVNHLTFSNSKYKYSVVSVNGKQTSNLRNQIAFVGIKNNKETERE

WKRPEGFKSINSNDFLIREEGKNDVKDDVLIKDRSFNGHHAEDAYFITIISQYFRSFKRIERLN

VNYRKETRELDDLEKNNIKFKEKASFDNFLLINALDELNEKLNQMRFSRMVITKKNTQLFNETL

YSGKYDKGKNTIKKVEKLNLLDNRTDKIKKIEEFFDEDKLKENELTKLHIFNHDKNLYETLKII

WNEVKIEIKNKNLNEKNYFKYFVNKKLQEGKISFNEWVPILDNDFKIIRKIRYIKFSSEEKETD

EIIFSQSNFLKIDQRQNFSFHNTLYWVQIWVYKNQKDQYCFISIDARNSKFEKDEIKINYEKLK

TQKEKLQIINEEPILKINKGDLFENEEKELFYIVGRDEKPQKLEIKYILGKKIKDQKQIQKPVK

KYFPNWKKVNLTYMGEIFKK

SEQ ID NO: 353

MDNKNYRIGIDVGLNSIGFCAVEVDQHDTPLGFLNLSVYRHDAGIDPNGKKTNTTRLAMSGVAR

RTRRLFRKRKRRLAALDRFIEAQGWTLPDHADYKDPYTPWLVRAELAQTPIRDENDLHEKLAIA

VRHIARHRGWRSPWVPVRSLHVEQPPSDQYLALKERVEAKTLLQMPEGATPAEMVVALDLSVDV

NLRPKNREKTDTRPENKKPGFLGGKLMQSDNANELRKIAKIQGLDDALLRELIELVFAADSPKG

ASGELVGYDVLPGQHGKRRAEKAHPAFQRYRIASIVSNLRIRHLGSGADERLDVETQKRVFEYL

-continued

LNAKPTADITWSDVAEEIGVERNLLMGTATQTADGERASAKPPVDVTNVAFATCKIKPLKEWWL

NADYEARCVMVSALSHAEKLTEGTAAEVEVAEFLQNLSDEDNEKLDSFSLPIGRAAYSVDSLER

LTKRMIENGEDLFEARVNEFGVSEDWRPPAEPIGARVGNPAVDRVLKAVNRYLMAAEAEWGAPL

SVNIEHVREGFISKRQAVEIDRENQKRYQRNQAVRSQIADHINATSGVRGSDVTRYLAIQRQNG

ECLYCGTAITFVNSEMDHIVPRAGLGSTNTRDNLVATCERCNKSKSNKPFAVWAAECGIPGVSV

AEALKRVDFWIADGFASSKEHRELQKGVKDRLKRKVSDPEIDNRSMESVAWMARELAHRVQYYF

DEKHTGTKVRVFRGSLTSAARKASGFESRVNFIGGNGKTRLDRRHHAMDAATVAMLRNSVAKTL

VLRGNIRASERAIGAAETWKSFRGENVADRQIFESWSENMRVLVEKFNLALYNDEVSIFSSLRL

QLGNGKAHDDTITKLQMHKVGDAWSLTEIDRASTPALWCALTRQPDFTWKDGLPANEDRTIIVN

GTHYGPLDKVGIFGKAAASLLVRGGSVDIGSAIHHARIYRIAGKKPTYGMVRVFAPDLLRYRNE

DLFNVELPPQSVSMRYAEPKVREAIREGKAEYLGWLVVGDELLLDLSSETSGQIAELQQDFPGT

THWTVAGFFSPSRLRLRPVYLAQEGLGEDVSEGSKSIIAGQGWRPAVNKVFGSAMPEVIRRDGL

GRKRRFSYSGLPVSWQG

SEQ ID NO: 354
MRLGLDIGTSSIGWWLYETDGAGSDARITGVVDGGVRIFSDGRDPKSGASLAVDRRAARAMRRR

RDRYLRRRATLMKVLAETGLMPADPAEAKALEALDPFALRAAGLDEPLPLPHLGRALFHLNQRR

GFKSNRKTDRGDNESGKIKDATARLDMEMMANGARTYGEFLHKRRQKATDPRHVPSVRTRLSIA

NRGGPDGKEEAGYDFYPDRRHLEEEFHKLWAAQGAHHPELTETLRDLLFEKIFFQRPLKEPEVG

LCLFSGHHGVPPKDPRLPKAHPLTQRRVLYETVNQLRVTADGREARPLTREERDQVIHALDNKK

PTKSLSSMVLKLPALAKVLKLRDGERFTLETGVRDAIACDPLRASPAHPDRFGPRWSILDADAQ

WEVISRIRRVQSDAEHAALVDWLTEAHGLDRAHAEATAHAPLPDGYGRLGLTATTRILYQLTAD

VVTYADAVKACGWHHSDGRTGECFDRLPYYGEVLERHVIPGSYHPDDDDITRFGRITNPTVHIG

LNQLRRLVNRIIETHGKPHQIVVELARDLKKSEEQKRADIKRIRDTTEAAKKRSEKLEELEIED

NGRNRMLLRLWEDLNPDDAMRRFCPYTGTRISAAMIFDGSCDVDHILPYSRTLDDSFPNRTLCL

REANRQKRNQTPWQAWGDTPHWHAIAANLKNLPENKRWRFAPDAMTRFEGENGFLDRALKDTQY

LARISRSYLDTLFTKGGHVWVVPGRFTEMLRRHWGLNSLLSDAGRGAVKAKNRTDHRHHAIDAA

VIAATDPGLLNRISRAAGQGEAAGQSAELIARDTPPPWEGFRDDLRVRLDRIIVSHRADHGRID

HAARKQGRDSTAGQLHQETAYSIVDDIHVASRTDLLSLKPAQLLDEPGRSGQVRDPQLRKALRV

ATGGKTGKDFENALRYFASKPGPYQAIRRVRIIKPLQAQARVPVPAQDPIKAYQGGSNHLFEIW

RLPDGEIEAQVITSFEAHTLEGEKRPHPAAKRLLRVHKGDMVALERDGRRVVGHVQKMDIANGL

FIVPHNEANADTRNNDKSDPFKWIQIGARPAIASGIRRVSVDEIGRLRDGGTRPI

SEQ ID NO: 355
MLHCIAVIRVPPSEEPGFFETHADSCALCHHGCMTYAANDKAIRYRVGIDVGLRSIGFCAVEVD

DEDHPIRILNSVVHVHDAGTGGPGETESLRKRSGVAARARRRGRAEKQRLKKLDVLLEELGWGV

SSNELLDSHAPWHIRKRLVSEYIEDETERRQCLSVAMAHIARHRGWRNSFSKVDTLLLEQAPSD

RMQGLKERVEDRTGLQFSEEVTQGELVATLLEHDGDVTIRGFVRKGGKATKVHGVLEGKYMQSD

LVAELRQICRTQRVSETTFEKLVLSIFHSKEPAPSAARQRERVGLDELQLALDPAAKQPRAERA

HPAFQKFKVVATLANMRIREQSAGERSLTSEELNRVARYLLNHTESESPTWDDVARKLEVPRHR

LRGSSRASLETGGGLTYPPVDDTTVRVMSAEVDWLADWWDCANDESRGHMIDAISNGCGSEPDD

VEDEEVNELISSATAEDMLKLELLAKKLPSGRVAYSLKTLREVTAAILETGDDLSQAITRLYGV

DPGWVPTPAPIEAPVGNPSVDRVLKQVARWLKFASKRWGVPQTVNIEHTREGLKSASLLEEERE

-continued

RWERFEARREIRQKEMYKRLGISGPFRRSDQVRYEILDLQDCACLYCGNEINFQTFEVDHIIPR

VDASSDSRRTNLAAVCHSCNSAKGGLAFGQWVKRGDCPSGVSLENAIKRVRSWSKDRLGLTEKA

MGKRKSEVISRLKTEMPYEEFDGRSMESVAWMAIELKKRIEGYFNSDRPEGCAAVQVNAYSGRL

TACARRAAHVDKRVRLIRLKGDDGHHKNRFDRRNHAMDALVIALMTPAIARTIAVREDRREAQQ

LTRAFESWKNFLGSEERMQDRWESWIGDVEYACDRLNELIDADKIPVTENLRLRNSGKLHADQP

ESLKKARRGSKRPRPQRYVLGDALPADVINRVTDPGLWTALVRAPGFDSQLGLPADLNRGLKLR

GKRISADFPIDYFPTDSPALAVQGGYVGLEFHHARLYRIIGPKEKVKYALLRVCAIDLCGIDCD

DLFEVELKPSSISMRTADAKLKEAMGNGSAKQIGWLVLGDEIQIDPTKFPKQSIGKFLKECGPV

SSWRVSALDTPSKITLKPRLLSNEPLLKTSRVGGHESDLVVAECVEKIMKKTGWVVEINALCQS

GLIRVIRRNALGEVRTSPKSGLPISLNLR

SEQ ID NO: 356
MRYRVGLDLGTASVGAAVFSMDEQGNPMELIWHYERLFSEPLVPDMGQLKPKKAARRLARQQRR

QIDRRASRLRRIAIVSRRLGIAPGRNDSGVHGNDVPTLRAMAVNERIELGQLRAVLLRMGKKRG

YGGTFKAVRKVGEAGEVASGASRLEEEMVALASVQNKDSVTVGEYLAARVEHGLPSKLKVAANN

EYYAPEYALFRQYLGLPAIKGRPDCLPNMYALRHQIEHEFERIWATQSQFHDVMKDHGVKEEIR

NAIFFQRPLKSPADKVGRCSLQTNLPRAPRAQIAAQNFRIEKQMADLRWGMGRRAEMLNDHQKA

VIRELLNQQKELSFRKIYKELERAGCPGPEGKGLNMDRAALGGRDDLSGNTTLAAWRKLGLEDR

WQELDEVTQIQVINFLADLGSPEQLDTDDWSCRFMGKNGRPRNFSDEFVAFMNELRMTDGFDRL

SKMGFEGGRSSYSIKALKALTEWMIAPHWRETPETHRVDEEAAIRECYPESLATPAQGGRQSKL

EPPPLTGNEVVDVALRQVRHTINMMIDDLGSVPAQIVVEMAREMKGGVTRRNDIEKQNKRFASE

RKKAAQSIEENGKTPTPARILRYQLWIEQGHQCPYCESNISLEQALSGAYTNFEHILPRTLTQI

GRKRSELVLAHRECNDEKGNRTPYQAFGHDDRRWRIVEQRANALPKKSSRKTRLLLLKDFEGEA

LTDESIDEFADRQLHESSWLAKVTTQWLSSLGSDVYVSRGSLTAELRRRWGLDTVIPQVRFESG

MPVVDEEGAEITPEEFEKFRLQWEGHRVTREMRTDRRPDKRIDHRHHLVDAIVTALTSRSLYQQ

YAKAWKVADEKQRHGRVDVKVELPMPILTIRDIALEAVRSVRISHKPDRYPDGRFFEATAYGIA

QRLDERSGEKVDWLVSRKSLTDLAPEKKSIDVDKVRANISRIVGEAIRLHISNIFEKRVSKGMT

PQQALREPIEFQGNILRKVRCFYSKADDCVRIEHSSRRGHHYKMLLNDGFAYMEVPCKEGILYG

VPNLVRPSEAVGIKRAPESGDFIRFYKGDTVKNIKTGRVYTIKQILGDGGGKLILTPVTETKPA

DLLSAKWGRLKVGGRNIHLLRLCAE

SEQ ID NO: 357
MIGEHVRGGCLFDDHWTPNWGAFRLPNTVRTFTKAENPKDGSSLAEPRRQARGLRRRLRRKTQR

LEDLRRLLAKEGVLSLSDLETLFRETPAKDPYQLRAEGLDRPLSFPEWVRVLYHITKHRGFQSN

RRNPVEDGQERSRQEEEGKLLSGVGENERLLREGGYRTAGEMLARDPKFQDHRRNRAGDYSHTL

SRSLLLEEARRLFQSQRTLGNPHASSNLEEAFLHLVAFQNPFASGEDIRNKAGHCSLEPDQIRA

PRRSASAETFMLLQKTGNLRLIHRRTGEERPLTDKEREQIHLLAWKQEKVTHKTLRRHLEIPEE

WLFTGLPYHRSGDKAEEKLFVHLAGIHEIRKALDKGPDPAVWDTLRSRRDLLDSIADTLTFYKN

EDEILPRLESLGLSPENARALAPLSFSGTAHLSLSALGKLLPHLEEGKSYTQARADAGYAAPPP

DRHPKLPPLEEADWRNPVVFRALTQTRKVVNALVRRYGPPWCIHLETARELSQPAKVRRRIETE

QQANEKKQQAEREFLDIVGTAPGPGDLLKMRLWREQGGFCPYCEEYLNPTRLAEPGYAEMDHI

LPYSRSLDNGWHNRVLVHGKDNRDKGNRTPFEAFGGDTARWDRLVAWVQASHLSAPKKRNLLRE

DFGEEAERELKDRNLTDTRFITKTAATLLRDRLTFHPEAPKDPVMTLNGRLTAFLRKQWGLHKN

RKNGDLHHALDAAVLAVASRSFVYRLSSHNAAWGELPRGREAENGFSLPYPAFRSEVLARLCPT

-continued

REEILLRLDQGGVGYDEAFRNGLRPVFVSRAPSRRLRGKAHMETLRSPKWKDHPEGPRTASRIP

LKDLNLEKLERMVGKDRDRKLYEALRERLAAFGGNGKKAFVAPFRKPCRSGEGPLVRSLRIFDS

GYSGVELRDGGEVYAVADHESMVRVDVYAKKNRFYLVPVYVADVARGIVKNRAIVAHKSEEEWD

LVDGSFDFRFSLFPGDLVEIEKKDGAYLGYYKSCHRGDGRLLLDRHDRMPRESDCGTFYVSTRK

DVLSMSKYQVDPLGEIRLVGSEKPPFVL

SEQ ID NO: 358
MEKKRKVTLGFDLGIASVGWAIVDSETNQVYKLGSRLFDAPDTNLERRTQRGTRRLLRRRKYRN

QKFYNLVKRTEVFGLSSREAIENRFRELSIKYPNIIELKTKALSQEVCPDEIAWILHDYLKNRG

YFYDEKETKEDFDQQTVESMPSYKLNEFYKKYGYFKGALSQPTESEMKDNKDLKEAFFFDFSNK

EWLKEINYFFNVQKNILSETFIEEFKKIFSFTRDISKGPGSDNMPSPYGIFGEFGDNGQGGRYE

HIWDKNIGKCSIFTNEQRAPKYLPSALIFNFLNELANIRLYSTDKKNIQPLWKLSSVDKLNILL

NLFNLPISEKKKKLTSTNINDIVKKESIKSIMISVEDIDMIKDEWAGKEPNVYGVGLSGLNIEE

SAKENKFKFQDLKILNVLINLLDNVGIKFEFKDRNDIIKNLELLDNLYLFLIYQKESNNKDSSI

DLFIAKNESLNIENLKLKLKEFLLGAGNEFENHNSKTHSLSKKAIDEILPKLLDNNEGWNLEAI

KNYDEEIKSQIEDNSSLMAKQDKKYLNDNFLKDAILPPNVKVTFQQAILIFNKIIQKFSKDFEI

DKVVIELAREMTQDQENDALKGIAKAQKSKKSLVEERLEANNIDKSVFNDKYEKLIYKIFLWIS

QDFKDPYTGAQISVNEIVNNKVEIDHIIPYSLCFDDSSANKVLVHKQSNQEKSNSLPYEYIKQG

HSGWNWDEFTKYVKRVFVNNVDSILSKKERLKKSENLLTASYDGYDKLGFLARNLNDTRYATIL

FRDQLNNYAEHHLIDNKKMFKVIAMNGAVTSFIRKNMSYDNKLRLKDRSDFSHHAYDAAIIALF

SNKTKTLYNLIDPSLNGIISKRSEGYWVIEDRYTGEIKELKKEDWTSIKNNVQARKIAKEIEEY

LIDLDDEVFFSRKTKRKTNRQLYNETIYGIATKTDEDGITNYYKKEKFSILDDKDIYLRLLRER

EKFVINQSNPEVIDQIIEIIESYGKENNIPSRDEAINIKYTKNKINYNLYLKQYMRSLTKSLDQ

FSEEFINQMIANKTFVLYNPTKNTTRKIKFLRLVNDVKINDIRKNQVINKFNGKNNEPKAFYEN

INSLGAIVFKNSANNFKTLSINTQIAIFGDKNWDIEDFKTYNMEKIEKYKEIYGIDKTYNFHSF

IFPGTILLDKQNKEFYYISSIQTVRDIIEIKFLNKIEFKDENKNQDTSKTPKRLMFGIKSIMNN

YEQVDISPFGINKKIFE

SEQ ID NO: 359
MGYRIGLDVGITSTGYAVLKTDKNGLPYKILTLDSVIYPRAENPQTGASLAEPRRIKRGLRRRT

RRTKFRKQRTQQLFIHSGLLSKPEIEQILATPQAKYSVYELRVAGLDRRLTNSELFRVLYFFIG

HRGFKSNRKAELNPENEADKKQMGQLLNSIEEIRKAIAEKGYRTVGELYLKDPKYNDHKRNKGY

IDGYLSTPNRQMLVDEIKQILDKQRELGNEKLTDEFYATYLLGDENRAGIFQAQRDFDEGPGAG

PYAGDQIKKMVGKDIFEPTEDRAAKATYTFQYFNLLQKMTSLNYQNTTGDTWHTLNGLDRQAII

DAVFAKAEKPTKTYKPTDFGELRKLLKLPDDARFNLVNYGSLQTQKEIETVEKKTRFVDFKAYH

DLVKVLPEEMWQSRQLLDHIGTALTLYSSDKRRRYFAEELNLPAELIEKLLPLNFSKFGHLSI

KSMQNIIPYLEMGQVYSEATTNTGYDFRKKQISKDTIREEITNPVVRRAVTKTIKIVEQIIRRY

GKPDGINIELARELGRNFKERGDIQKRQDKNRQTNDKIAAELTELGIPVNGQNIIRYKLHKEQN

GVDPYTGDQIPFERAFSEGYEVDHIIPYSISWDDSYTNKVLTSAKCNREKGNRIPMVYLANNEQ

RLNALTNIADNIIRNSRKRQKLLKQKLSDEELKDWKQRNINDTRFITRVLYNYFRQAIEFNPEL

EKKQRVLPLNGEVTSKIRSRWGFLKVREDGDLHHAIDATVIAAITPKFIQQVTKYSQHQEVKNN

QALWHDAEIKDAEYAAEAQRMDADLFNKIFNGFPLPWPEFLDELLARISDNPVEMMKSRSWNTY

TPIEIAKLKPVFVVRLANHKISGPAHLDTIRSAKLFDEKGIVLSRVSITKLKINKKGQVATGDG

-continued

IYDPENSNNGDKVVYSAIRQALEAHNGSGELAFPDGYLEYVDHGTKKLVRKVRVAKKVSLPVRL

KNKAAADNGSMVRIDVFNTGKKFVFVPIYIKDTVEQVLPNKAIARGKSLWYQITESDQFCFSLY

PGDMVHIESKTGIKPKYSNKENNTSVVPIKNFYGYFDGADIATASILVRAHDSSYTARSIGIAG

LLKFEKYQVDYFGRYHKVHEKKRQLFVKRDE

SEQ ID NO: 360

MQKNINTKQNHIYIKQAQKIKEKLGDKPYRIGLDLGVGSIGFAIVSMEENDGNVLLPKEIIMVG

SRIFKASAGAADRKLSRGQRNNHRHTRERMRYLWKVLAEQKLALPVPADLDRKENSSEGETSAK

RFLGDVLQKDIYELRVKSLDERLSLQELGYVLYHIAGHRGSSAIRTFENDSEEAQKENTENKKI

AGNIKRLMAKKNYRTYGEYLYKEFFENKEKHKREKISNAANNHKFSPTRDLVIKEAEAILKKQA

GKDGFHKELTEEYIEKLTKAIGYESEKLIPESGFCPYLKDEKRLPASHKLNEERRLWETLNNAR

YSDPIVDIVTGEITGYYEKQFTKEQKQKLFDYLLTGSELTPAQTKKLLGLKNTNFEDIILQGRD

KKAQKIKGYKLIKLESMPFWARLSEAQQDSFLYDWNSCPDEKLLTEKLSNEYHLTEEEIDNAFN

EIVLSSSYAPLGKSAMLIILEKIKNDLSYTEAVEEALKEGKLTKEKQAIKDRLPYYGAVLQEST

QKIIAKGFSPQFKDKGYKTPHTNKYELEYGRIANPVVHQTLNELRKLVNEIIDILGKKPCEIGL

ETARELKKSAEDRSKLSREQNDNESNRNRIYEIYIRPQQQVIITRRENPRNYILKFELLEEQKS

QCPFCGGQISPNDIINNQADIEHLFPIAESEDNGRNNLVISHSACNADKAKRSPWAAFASAAKD

SKYDYNRILSNVKENIPHKAWRFNQGAFEKFIENKPMAARFKTDNSYISKVAHKYLACLFEKPN

IICVKGSLTAQLRMAWGLQGLMIPFAKQLITEKESESFNKDVNSNKKIRLDNRHHALDAIVIAY

ASRGYGNLLNKMAGKDYKINYSERNWLSKILLPPNNIVWENIDADLESFESSVKTALKNAFISV

KHDHSDNGELVKGTMYKIFYSERGYTLTTYKKLSALKLTDPQKKKTPKDFLETALLKFKGRESE

MKNEKIKSAIENNKRLFDVIQDNLEKAKKLLEEENEKSKAEGKKEKNINDASIYQKAISLSGDK

YVQLSKKEPGKFFAISKPTPTTTGYGYDTGDSLCVDLYYDNKGKLCGEIIRKIDAQQKNPLKYK

EQGFTLFERIYGGDILEVDFDIHSDKNSFRNNTGSAPENRVFIKVGTFTEITNNNIQIWFGNII

KSTGGQDDSFTINSMQQYNPRKLILSSCGFIKYRSPILKNKEG

SEQ ID NO: 361

MAAFKPNPINYILGLDIGIASVGWAMVEIDEDENPICLIDLGVRVFERAEVPKTGDSLAMARRL

ARSVRRLTRRRAHRLLRARRLLKREGVLQAADFDENGLIKSLPNTPWQLRAAALDRKLTPLEWS

AVLLHLIKHRGYLSQRKNEGETADKELGALLKGVADNAHALQTGDFRTPAELALNKFEKESGHI

RNQRGDYSHTFSRKDLQAELILLFEKQKEFGNPHVSGGLKEGIETLLMTQRPALSGDAVQKMLG

HCTFEPAEPKAAKNTYTAERFIWLTKLNNLRILEQGSERPLTDTERATLMDEPYRKSKLTYAQA

RKLLGLEDTAFFKGLRYGKDNAEASTLMEMKAYHAISRALEKEGLKDKKSPLNLSPELQDEIGT

AFSLFKTDEDITGRLKDRIQPEILEALLKHISFDKFVQISLKALRRIVPLMEQGKRYDEACAEI

YGDHYGKKNTEEKIYLPPIPADEIRNPVVLRALSQARKVINGVVRRYGSPARIHIETAREVGKS

FKDRKEIEKRQEENRKDREKAAAKFREYFPNFVGEPKSKDILKLRLYEQQHGKCLYSGKEINLG

RLNEKGYVEIDHALPFSRTWDDSFNNKVLVLGSENQNKGNQTPYEYFNGKDNSREWQEFKARVE

TSRFPRSKKQRILLQKFDEDGFKERNLNDTRYVNRFLCQFVADRMRLTGKGKKRVFASNGQITN

LLRGFWGLRKVRAENDRHHALDAVVVACSTVAMQQKITRFVRYKEMNAFDGKTIDKETGEVLHQ

KTHFPQPWEFFAQEVMIRVFGKPDGKPEFEEADTPEKLRTLLAEKLSSRPEAVHEYVTPLFVSR

APNRKMSGQGHMETVKSAKRLDEGVSVLRVPLTQLKLKDLEKMVNREREPKLYEALKARLEAHK

DDPAKAFAEPFYKYDKAGNRTQQVKAVRVEQVQKTGVWVRNHNGIADNATMVRVDVFEKGDKYY

LVPIYSWQVAKGILPDRAVVQGKDEEDWQLIDDSFNFKFSLHPNDLVEVITKKARMFGYFASCH

RGTGNINIRIHDLDHKIGKNGILEGIGVKTALSFQKYQIDELGKEIRPCRLKKRPPVR

SEQ ID NO: 362

MQTTNLSYILGLDLGIASVGWAVVEINENEDPIGLIDVGVRIFERAEVPKTGESLALSRRLARS

TRRLIRRRAHRLLLAKRFLKREGILSTIDLEKGLPNQAWELRVAGLERRLSAIEWGAVLLHLIK

HRGYLSKRKNESQTNNKELGALLSGVAQNHQLLQSDDYRTPAELALKKFAKEEGHIRNQRGAYT

HTFNRLDLLAELNLLFAQQHQFGNPHCKEHIQQYMTELLMWQKPALSGEAILKMLGKCTHEKNE

FKAAKHTYSAERFVWLTKLNNLRILEDGAERALNEEERQLLINHPYEKSKLTYAQVRKLLGLSE

QAIFKHLRYSKENAESATFMELKAWHAIRKALENQGLKDTWQDLAKKPDLLDEIGTAFSLYKTD

EDIQQYLTNKVPNSVINALLVSLNFDKFIELSLKSLRKILPLMEQGKRYDQACREIYGHHYGEA

NQKTSQLLPAIPAQEIRNPVVLRTLSQARKVINAIIRQYGSPARVHIETGRELGKSFKERREIQ

KQQEDNRTKRESAVQKFKELFSDFSSEPKSKDILKFRLYEQQHGKCLYSGKEINIHRLNEKGYV

EIDHALPFSRTWDDSFNNKVLVLASENQNKGNQTPYEWLQGKINSERWKNFVALVLGSQCSAAK

KQRLLTQVIDDNKFIDRNLNDTRYIARFLSNYIQENLLLVGKNKKNVFTPNGQITALLRSRWGL

IKARENNNRHHALDAIVVACATPSMQQKITRFIRFKEVHPYKIENRYEMVDQESGEIISPHFPE

PWAYFRQEVNIRVFDNHPDTVLKEMLPDRPQANHQFVQPLFVSRAPTRKMSGQGHMETIKSAKR

LAEGISVLRIPLTQLKPNLLENMVNKEREPALYAGLKARLAEFNQDPAKAFATPFYKQGGQQVK

AIRVEQVQKSGVLVRENNGVADNASIVRTDVFIKNNKFFLVPIYTWQVAKGILPNKAIVAHKNE

DEWEEMDEGAKFKFSLFPNDLVELKTKKEYFFGYYIGLDRATGNISLKEHDGEISKGKDGVYRV

GVKLALSFEKYQVDELGKNRQICRPQQRQPVR

SEQ ID NO: 363

MGIRFAFDLGTNSIGWAVWRTGPGVFGEDTAASLDGSGVLIFKDGRNPKDGQSLATMRRVPRQS

RKRRDRFVLRRRDLLAALRKAGLFPVDVEEGRRLAATDPYHLRAKALDESLTPHEMGRVIFHLN

QRRGFRSNRKADRQDREKGKIAEGSKRLAETLAATNCRTLGEFLWSRHRGTPRTRSPTRIRMEG

EGAKALYAFYPTREMVRAEFERLWTAQSRFAPDLLTPERHEEIAGILFRQRDLAPPKIGCCTFE

PSERRLPRALPSVEARGIYERLAHLRITTGPVSDRGLTRPERDVLASALLAGKSLTFKAVRKTL

KILPHALVNFEEAGEKGLDGALTAKLLSKPDHYGAAWHGLSFAEKDTFVGKLLDEADEERLIRR

LVTENRLSEDAARRCASIPLADGYGRLGRTANTEILAALVEETDETGTVVTYAEAVRRAGERTG

RNWHHSDERDGVILDRLPYYGEILQRHVVPGSGEPEEKNEAARWGRLANPTVHIGLNQLRKVVN

RLIAAHGRPDQIVVELARELKLNREQKERLDRENRKNREENERRTAILAEHGQRDTAENKIRLR

LFEEQARANAGIALCPYTGRAIGIAELFTSEVEIDHILPVSLTLDDSLANRVLCRREANREKRR

QTPFQAFGATPAWNDIVARAAKLPPNKRWRFDPAALERFEREGGFLGRQLNETKYLSRLAKIYL

GKICDPDRVYVTPGTLTGLLRARWGLNSILSDSNFKNRSDHRHHAVDAVVIGVLTRGMIQRIAH

DAARAEDQDLDRVFRDVPVPFEDFRDHVRERVSTITVAVKPEHGKGGALHEDTSYGLVPDTDPN

AALGNLVVRKPIRSLTAGEVDRVRDRALRARLGALAAPFRDESGRVRDAKGLAQALEAFGAENG

IRRVRILKPDASVVTIADRRTGVPYRAVAPGENHHVDIVQMRDGSWRGFAASVFEVNRPGWRPE

WEVKKLGGKLVMRLHKGDMVELSDKDGQRRVKVVQQIEISANRVRLSPHNDGGKLQDRHADADD

PFRWDLATIPLLKDRGCVAVRVDPIGVVTLRRSNV

SEQ ID NO: 364

MMEVFMGRLVLGLDIGITSVGFGIIDLDESEIVDYGVRLFKEGTAAENETRRTKRGGRRLKRRR

VTRREDMLHLLKQAGIISTSFHPLNNPYDVRVKGLNERLNGEELATALLHLCKHRGSSVETIED

DEAKAKEAGETKKVLSMNDQLLKSGKYVCEIQKERLRTNGHIRGHENNFKTRAYVDEAFQILSH

QDLSNELKSAIITIISRKRMYYDGPGGPLSPTPYGRYTYFGQKEPIDLIEKMRGKCSLFPNEPR

APKLAYSAELFNLLNDLNNLSIEGEKLTSEQKAMILKIVHEKGKITPKQLAKEVGVSLEQIRGF

-continued

RIDTKGSPLLSELTGYKMIREVLEKSNDEHLEDHVFYDEIAEILTKTKDIEGRKKQISELSSDL
NEESVHQLAGLTKFTAYHSLSFKALRLINEEMLKTELNQMQSITLFGLKQNNELSVKGMKNIQA
DDTAILSPVAKRAQRETFKVVNRLREIYGEFDSIVVEMAREKNSEEQRKAIRERQKFFEMRNKQ
VADIIGDDRKINAKLREKLVLYQEQDGKTAYSLEPIDLKLLIDDPNAYEVDHIIPISISLDDSI
TNKVLVTHRENQEKGNLTPISAFVKGRFTKGSLAQYKAYCLKLKEKNIKTNKGYRKKVEQYLLN
ENDIYKYDIQKEFINRNLVDTSYASRVVLNTLTTYFKQNEIPTKVFTVKGSLTNAFRRKINLKK
DRDEDYGHHAIDALIIASMPKMRLLSTIFSRYKIEDIYDESTGEVFSSGDDSMYYDDRYFAFIA
SLKAIKVRKFSHKIDTKPNRSVADETIYSTRVIDGKEKVVKKYKDIYDPKFTALAEDILNNAYQ
EKYLMALHDPQTFDQIVKVVNYYFEEMSKSEKYFTKDKKGRIKISGMNPLSLYRDEHGMLKKYS
KKGDGPAITQMKYFDGVLGNHIDISAHYQVRDKKVVLQQISPYRTDFYYSKENGYKFVTIRYKD
VRWSEKKKKYVIDQQDYAMKKAEKKIDDTYEFQFSMHRDELIGITKAEGEALIYPDETWHNFNF
FFHAGETPEILKFTATNNDKSNKIEVKPIHCYCKMRLMPTISKKIVRIDKYATDVVGNLYKVKK
NTLKFEFD

SEQ ID NO: 365
MKKILGVDLGITSFGYAILQETGKDLYRCLDNSVVMRNNPYDEKSGESSQSIRSTQKSMRRLIE
KRKKRIRCVAQTMERYGILDYSETMKINDPKNNPIKNRWQLRAVDAWKRPLSPQELFAIFAHMA
KHRGYKSIATEDLIYELELELGLNDPEKESEKKADERRQVYNALRHLEELRKKYGGETIAQTIH
RAVEAGDLRSYRNHDDYEKMIRREDIEEEIEKVLLRQAELGALGLPEEQVSELIDELKACITDQ
EMPTIDESLFGKCTFYKDELAAPAYSYLYDLYRLYKKLADLNIDGYEVTQEDREKVIEWVEKKI
AQGKNLKKITHKDLRKILGLAPEQKIFGVEDERIVKGKKEPRTFVPFFFLADIAKFKELFASIQ
KHPDALQIFRELAEILQRSKTPQEALDRLRALMAGKGIDTDDRELLELFKNKRSGTRELSHRYI
LEALPLFLEGYDEKEVQRILGFDDREDYSRYPKSLRHLHLREGNLFEKEENPINNHAVKSLASW
ALGLIADLSWRYGPFDEIILETTRDALPEKIRKEIDKAMREREKALDKIIGKYKKEFPSIDKRL
ARKIQLWERQKGLDLYSGKVINLSQLLDGSADIEHIVPQSLGGLSTDYNTIVTLKSVNAAKGNR
LPGDWLAGNPDYRERIGMLSEKGLIDWKKRKNLLAQSLDEIYTENTHSKGIRATSYLEALVAQV
LKRYYPFPDPELRKNGIGVRMIPGKVTSKTRSLLGIKSKSRETNFHHAEDALILSTLTRGWQNR
LHRMLRDNYGKSEAELKELWKKYMPHIEGLTLADYIDEAFRRFMSKGEESLFYRDMFDTIRSIS
YWVDKKPLSASSHKETVYSSRHEVPTLRKNILEAFDSLNVIKDRHKLTTEEFMKRYDKEIRQKL
WLHRIGNTNDESYRAVEERATQIAQILTRYQLMDAQNDKEIDEKFQQALKELITSPIEVTGKLL
RKMRFVYDKLNAMQIDRGLVETDKNMLGIHISKGPNEKLIFRRMDVNNAHELQKERSGILCYLN
EMLFIFNKKGLIHYGCLRSYLEKGQGSKYIALFNPRFPANPKAQPSKFTSDSKIKQVGIGSATG
IIKAHLDLDGHVRSYEVFGTLPEGSIEWFKEESGYGRVEDDPHH

SEQ ID NO: 366
MRPIEPWILGLDIGTDSLGWAVFSCEEKGPPTAKELLGGGVRLFDSGRDAKDHTSRQAERGAFR
RARRQTRTWPWRRDRLIALFQAAGLTPPAAETRQIALALRREAVSRPLAPDALWAALLHLAHHR
GFRSNRIDKRERAAAKALAKAKPAKATAKATAPAKEADDEAGFWEGAEAALRQRMAASGAPTVG
ALLADDLDRGQPVRMRYNQSDRDGVVAPTRALIAEELAEIVARQSSAYPGLDWPAVTRLVLDQR
PLRSKGAGPCAFLPGEDRALRALPTVQDFIIRQTLANLRLPSTSADEPRPLTDEEHAKALALLS
TARFVEWPALRRALGLKRGVKFTAETERNGAKQAARGTAGNLTEAILAPLIPGWSGWDLDRKDR
VFSDLWAARQDRSALLALIGDPRGPTRVTEDETAEAVADAIQIVLPTGRASLSAKAARAIAQAM
APGIGYDEAVTLALGLHHSHRPRQERLARLPYYAAALPDVGLDGDPVGPPPAEDDGAAAEAYYG

-continued

RIGNISVHIALNETRKIVNALLHRHGPILRLVMVETTRELKAGADERKRMIAEQAERERENAEI

DVELRKSDRWMANARERRQRVRLARRQNNLCPYTSTPIGHADLLGDAYDIDHVIPLARGGRDSL

DNMVLCQSDANKTKGDKTPWEAFHDKPGWIAQRDDFLARLDPQTAKALAWRFADDAGERVARKS

AEDEDQGFLPRQLTDTGYIARVALRYLSLVTNEPNAVVATNGRLTGLLRLAWDITPGPAPRDLL

PTPRDALRDDTAARRFLDGLTPPPLAKAVEGAVQARLAALGRSRVADAGLADALGLTLASLGGG

GKNRADHRHHFIDAAMIAVTTRGLINQINQASGAGRILDLRKWPRTNFEPPYPTFRAEVMKQWD

HIHPSIRPAHRDGGSLHAATVFGVRNRPDARVLVQRKPVEKLFLDANAKPLPADKIAEIIDGFA

SPRMAKRFKALLARYQAAHPEVPPALAALAVARDPAFGPRGMTANTVIAGRSDGDGEDAGLITP

FRANPKAAVRTMGNAVYEVWEIQVKGRPRWTHRVLTRFDRTQPAPPPPPENARLVMRLRRGDLV

YWPLESGDRLFLVKKMAVDGRLALWPARLATGKATALYAQLSCPNINLNGDQGYCVQSAEGIRK

EKIRTTSCTALGRLRLSKKAT

SEQ ID NO: 367
MKYTLGLDVGIASVGWAVIDKDNNKIIDLGVRCFDKAEESKTGESLATARRIARGMRRRISRRS

QRLRLVKKLFVQYEIIKDSSEFNRIFDTSRDGWKDPWELRYNALSRILKPYELVQVLTHITKRR

GFKSNRKEDLSTTKEGVVITSIKNNSEMLRTKNYRTIGEMIFMETPENSNKRNKVDEYIHTIAR

EDLLNEIKYIFSIQRKLGSPFVTEKLEHDFLNIWEFQRPFASGDSILSKVGKCTLLKEELRAPT

SCYTSEYFGLLQSINNLVLVEDNNTLTLNNDQRAKIIEYAHFKNEIKYSEIRKLLDIEPEILFK

AHNLTHKNPSGNNESKKFYEMKSYHKLKSTLPTDIWGKLHSNKESLDNLFYCLTVYKNDNEIKD

YLQANNLDYLIEYIAKLPTFNKFKHLSLVAMKRIIPFMEKGYKYSDACNMAELDFTGSSKLEKC

NKLTVEPIIENVTNPVVIRALTQARKVINAIIQKYGLPYMVNIELAREAGMTRQDRDNLKKEHE

NNRKAREKISDLIRQNGRVASGLDILKWRLWEDQGGRCAYSGKPIPVCDLLNDSLTQIDHIYPY

SRSMDDSYMNKVLVLTDENQNKRSYTPYEVWGSTEKWEDFEARIYSMHLPQSKEKRLLNRNFIT

KDLDSFISRNLNDTRYISRFLKNYIESYLQFSNDSPKSCVVCVNGQCTAQLRSRWGLNKNREES

DLHHALDAAVIACADRKIIKEITNYYNERENHNYKVKYPLPWHSFRQDLMETLAGVFISRAPRR

KITGPAHDETIRSPKHFNKGLTSVKIPLTTVTLEKLETMVKNTKGGISDKAVYNVLKNRLIEHN

NKPLKAFAEKIYKPLKNGTNGAIIRSIRVETPSYTGVFRNEGKGISDNSLMVRVDVFKKKDKYY

LVPIYVAHMIKKELPSKAIVPLKPESQWELIDSTHEFLFSLYQNDYLVIKTKKGITEGYYRSCH

RGTGSLSLMPHFANNKNVKIDIGVRTAISIEKYNVDILGNKSIVKGEPRRGMEKYNSFKSN

SEQ ID NO: 368
MIRTLGIDIGIASIGWAVIEGEYTDKGLENKEIVASGVRVFTKAENPKNKESLALPRTLARSAR

RRNARKKGRIQQVKHYLSKALGLDLECFVQGEKLATLFQTSKDFLSPWELRERALYRVLDKEEL

ARVILHIAKRRGYDDITYGVEDNDSGKIKKAIAENSKRIKEEQCKTIGEMMYKLYFQKSLNVRN

KKESYNRCVGRSELREELKTIFQIQQELKSPWVNEELIYKLLGNPDAQSKQEREGLIFYQRPLK

GFGDKIGKCSHIKKGENSPYRACKHAPSAEEFVALTKSINFLKNLTNRHGLCFSQEDMCVYLGK

ILQEAQKNEKGLTYSKLKLLLDLPSDFEFLGLDYSGKNPEKAVFLSLPSTFKLNKITQDRKTQD

KIANILGANKDWEAILKELESLQLSKEQIQTIKDAKLNFSKHINLSLEALYHLLPLMREGKRYD

EGVEILQERGIFSKPQPKNRQLLPPLSELAKEESYFDIPNPVLRRALSEFRKVVNALLEKYGGF

HYFHIELTRDVCKAKSARMQLEKINKKNKSENDAASQLLEVLGLPNTYNNRLKCKLWKQQEEYC

LYSGEKITIDHLKDQRALQIDHAFPLSRSLDDSQSNKVLCLTSSNQEKSNKTPYEWLGSDEKKW

DMYVGRVYSSNFSPSKKRKLTQKNFKERNEEDFLARNLDTGYIGRVTKEYIKHSLSFLPLPDG

KKEHIRIISGSMTSTMRSFWGVQEKNRDHHLHHAQDAIIACIEPSMIQKYTTYLKDKETHRLK

SHQKAQILREGDHKLSLRWPMSNFKDKIQESIQNIIPSHHVSHKVTGELHQETVRTKEFYYQAF

-continued

GGEEGVKKALKFGKIREINQGIVDNGAMVRVDIFKSKDKGKFYAVPIYTYDFAIGKLPNKAIVQ

GKKNGIIKDWLEMDENYEFCFSLFKNDCIKIQTKEMQEAVLAIYKSTNSAKATIELEHLSKYAL

KNEDEEKMFTDTDKEKNKTMTRESCGIQGLKVFQKVKLSVLGEVLEHKPRNRQNIALKTTPKHV

SEQ ID NO: 369
MKYSIGLDIGIASVGWSVINKDKERIEDMGVRIFQKAENPKDGSSLASSRREKRGSRRRNRRKK

HRLDRIKNILCESGLVKKNEIEKIYKNAYLKSPWELRAKSLEAKISNKEIAQILLHIAKRRGFK

SFRKTDRNADDTGKLLSGIQENKKIMEEKGYLTIGDMVAKDPKFNTHVRNKAGSYLFSFSRKLL

EDEVRKIQAKQKELGNTHFTDDVLEKYIEVFNSQRNFDEGPSKPSPYYSEIGQIAKMIGNCTFE

SSEKRTAKNTWSGERFVFLQKLNNFRIVGLSGKRPLTEEERDIVEKEVYLKKEVRYEKLRKILY

LKEEERFGDLNYSKDEKQDKKTEKTKFISLIGNYTIKKLNLSEKLKSEIEEDKSKLDKIIEILT

FNKSDKTIESNLKKLELSREDIEILLSEEFSGTLNLSLKAIKKILPYLEKGLSYNEACEKADYD

YKNNGIKFKRGELLPVVDKDLIANPVVLRAISQTRKVVNAIIRKYGTPHTIHVEVARDLAKSYD

DRQTIIKENKKRELENEKTKKFISEEFGIKNVGKLLLKYRLYQEQEGRCAYSRKELSLSEVIL

DESMTDIDHIIPYSRSMDDSYSNKVLVLSGENRKKSNLLPKEYFDRQGRDWDTFVLNVKAMKIH

PRKKSNLLKEKFTREDNKDWKSRALNDTRYISRFVANYLENALEYRDDSPKKRVFMIPGQLTAQ

LRARWRLNKVRENGDLHHALDAAVVAVTDQKAINNISNISRYKELKNCKDVIPSIEYHADEETG

EVYFEEVKDTRFPMPWSGFDLELQKRLESENPREEFYNLLSDKRYLGWFNYEEGFIEKLRPVFV

SRMPNRGVKGQAHQETIRSSKKISNQIAVSKKPLNSIKLKDLEKMQGRDTDRKLYEALKNRLEE

YDDKPEKAFAEPFYKPTNSGKRGPLVRGIKVEEKQNVGVYVNGGQASNGSMVRIDVFRKNGKFY

TVPIYVHQTLLKELPNRAINGKPYKDWDLIDGSFEFLYSFYPNDLIEIEFGKSKSIKNDNKLTK

TEIPEVNLSEVLGYYRGMDTSTGAATIDTQDGKIQMRIGIKTVKNIKKYQVDVLGNVYKVKREK

RQTF

SEQ ID NO: 370
MSKKVSRRYEEQAQEICQRLGSRPYSIGLDLGVGSIGVAVAAYDPIKKQPSDLVFVSSRIFIPS

TGAAERRQKRGQRNSLRHRANRLKFLWKLLAERNLMLSYSEQDVPDPARLRFEDAVVRANPYEL

RLKGLNEQLTLSELGYALYHIANHRGSSSVRTFLDEEKSSDDKKLEEQQAMTEQLAKEKGISTF

IEVLTAFNTNGLIGYRNSESVKSKGVPVPTRDIISNEIDVLLQTQKQFYQEILSDEYCDRIVSA

ILFENEKIVPEAGCCPYFPDEKKLPRCHFLNEERRLWEAINNARIKMPMQEGAAKRYQSASFSD

EQRHILFHIARSGTDITPKLVQKEFPALKTSIIVLQGKEKAIQKIAGFRFRRLEEKSFWKRLSE

EQKDDFFSAWTNTPDDKRLSKYLMKHLLLTENEVVDALKTVSLIGDYGPIGKTATQLLMKHLED

GLTYTEALERGMETGEFQELSVWEQQSLLPYYGQILTGSTQALMGKYWHSAFKEKRDSEGFFKP

NTNSDEEKYGRIANPVVHQTLNELRKLMNELITILGAKPQEITVELARELKVGAEKREDIIKQQ

TKQEKEAVLAYSKYCEPNNLDKRYIERFRLLEDQAFVCPYCLEHISVADIAAGRADVDHIFPRD

DTADNSYGNKVVAHRQCNDIKGKRTPYAAFSNTSAWGPIMHYLDETPGMWRKRRKFETNEEEYA

KYLQSKGFVSRFESDNSYIAKAAKEYLRCLFNPNNVTAVGSLKGMETSILRKAWNLQGIDDLLG

SRHWSKDADTSPTMRKNRDDNRHHGLDAIVALYCSRSLVQMINTMSEQGKRAVEIEAMIPIGY

ASEPNLSFEAQRELFRKKILEFMDLHAFVSMKTDNDANGALLKDTVYSILGADTQGEDLVFVVK

KKIKDIGVKIGDYEEVASAIRGRITDKQPKWYPMEMKDKIEQLQSKNEAALQKYKESLVQAAAV

LEESNRKLIESGKKPIQLSEKTISKKALELVGGYYYLISNNKRTKTFVVKEPSNEVKGFAFDTG

SNLCLDFYHDAQGKLCGEIIRKIQAMNPSYKPAYMKQGYSLYVRLYQGDVCELRASDLTEAESN

-continued

LAKTTHVRLPNAKPGRTFVIIITFTEMGSGYQIYFSNLAKSKKGQDTSFTLTTIKNYDVRKVQL

SSAGLVRYVSPLLVDKIEKDEVALCGE

SEQ ID NO: 371
MNQKFILGLDIGITSVGYGLIDYETKNIIDAGVRLFPEANVENNEGRRSKRGSRRLKRRRIHRL

ERVKKLLEDYNLLDQSQIPQSTNPYAIRVKGLSEALSKDELVIALLHIAKRRGIHKIDVIDSND

DVGNELSTKEQLNKNSKLLKDKFVCQIQLERMNEGQVRGEKNRFKTADIIKEIIQLLNVQKNFH

QLDENFINKYIELVEMRREYFEGPGKGSPYGWEGDPKAWYETLMGHCTYFPDELRSVKYAYSAD

LFNALNDLNNLVIQRDGLSKLEYHEKYHIIENVFKQKKKPTLKQIANEINVNPEDIKGYRITKS

GKPQFTEFKLYHDLKSVLFDQSILENEDVLDQIAEILTIYQDKDSIKSKLTELDILLNEEDKEN

IAQLTGYTGTHRLSLKCIRLVLEEQWYSSRNQMEIFTHLNIKPKKINLTAANKIPKAMIDEFIL

SPVVKRTFGQAINLINKIIEKYGVPEDIIIELARENNSKDKQKFINEMQKKNENTRKRINEIIG

KYGNQNAKRLVEKIRLHDEQEGKCLYSLESIPLEDLLNNPNHYEVDHIIPRSVSFDNSYHNKVL

VKQSENSKKSNLTPYQYFNSGKSKLSYNQFKQHILNLSKSQDRISKKKKEYLLEERDINKFEVQ

KEFINRNLVDTRYATRELTNYLKAYFSANNMNVKVKTINGSFTDYLRKVWKFKKERNHGYKHHA

EDALIIANADFLFKENKKLKAVNSVLEKPEIESKQLDIQVDSEDNYSEMFIIPKQVQDIKDFRN

FKYSHRVDKKPNRQLINDTLYSTRKKDNSTYIVQTIKDIYAKDNTTLKKQFDKSPEKFLMYQHD

PRTFEKLEVIMKQYANEKNPLAKYHEETGEYLTKYSKKNNGPIVKSLKYIGNKLGSHLDVTHQF

KSSTKKLVKLSIKPYRFDVYLTDKGYKFITISYLDVLKKDNYYYIPEQKYDKLKLGKAIDKNAK

FIASFYKNDLIKLDGEIYKIIGVNSDTRNMIELDLPDIRYKEYCELNNIKGEPRIKKTIGKKVN

SIEKLTTDVLGNVFTNTQYTKPQLLFKRGN

SEQ ID NO: 372
MIMKLEKWRLGLDLGTNSIGWSVFSLDKDNSVQDLIDMGVRIFSDGRDPKTKEPLAVARRTARS

QRKLIYRRKLRRKQVFKFLQEQGLFPKTKEECMTLKSLNPYELRIKALDEKLEPYELGRALFNL

AVRRGFKSNRKDGSREEVSEKKSPDEIKTQADMQTHLEKAIKENGCRTITEFLYKNQGENGGIR

FAPGRMTYYPTRKMYEEEFNLIRSKQEKYYPQVDWDDIYKAIFYQRPLKPQQRGYCIYENDKER

TFKAMPCSQKLRILQDIGNLAYYEGGSKKRVELNDNQDKVLYELLNSKDKVTFDQMRKALCLAD

SNSFNLEENRDFLIGNPTAVKMRSKNRFGKLWDEIPLEEQDLIIETIITADEDDAVYEVIKKYD

LTQEQRDFIVKNTILQSGTSMLCKEVSEKLVKRLEEIADLKYHEAVESLGYKFADQTVEKYDLL

PYYGKVLPGSTMEIDLSAPETNPEKHYGKISNPTVHVALNQTRVVVNALIKEYGKPSQIAIELS

RDLKNNVEKKAEIARKQNQRAKENIAINDTISALYHTAFPGKSFYPNRNDRMKYRLWSELGLGN

KCIYCGKGISGAELFTKEIEIEHILPFSRTLLDAESNLTVAHSSCNAFKAERSPFEAFGTNPSG

YSWQEIIQRANQLKNTSKKNKFSPNAMDSFEKDSSFIARQLSDNQYIAKAALRYLKCLVENPSD

VWTTNGSMTKLLRDKWEMDSILCRKFTEKEVALLGLKPEQIGNYKKNRFDHRHHAIDAVVIGLT

DRSMVQKLATKNSHKGNRIEIPEFPILRSDLIEKVKNIVVSFKPDHGAEGKLSKETLLGKIKLH

GKETFVCRENIVSLSEKNLDDIVDEIKSKVKDYVAKHKGQKIEAVLSDFSKENGIKKVRCVNRV

QTPIEITSGKISRYLSPEDYFAAVIWEIPGEKKTFKAQYIRRNEVEKNSKGLNVVKPAVLENGK

PHPAAKQVCLLHKDDYLEFSDKGKMYFCRIAGYAATNNKLDIRPVYAVSYCADWINSTNETMLT

GYWKPTPTQNWVSVNVLFDKQKARLVTVSPIGRVFRK

SEQ ID NO: 373
MSSKAIDSLEQLDLFKPQEYTLGLDLGIKSIGWAILSGERIANAGVYLFETAEELNSTGNKLIS

KAAERGRKRRIRRMLDRKARRGRHIRYLLEREGLPTDELEEVVVHQSNRTLWDVRAEAVERKLT

KQELAAVLFHLVRHRGYFPNTKKLPPDDESDSADEEQGKINRATSRLREELKASDCKTIGQFLA

-continued

QNRDRQRNREGDYSNLMARKLVFEEALQILAFQRKQGHELSKDFEKTYLDVLMGQRSGRSPKLG
NCSLIPSELRAPSSAPSTEWFKFLQNLGNLQISNAYREEWSIDAPRRAQIIDACSQRSTSSYWQ
IRRDFQIPDEYRFNLVNYERRDPDVDLQEYLQQQERKTLANFRNWKQLEKIIGTGHPIQTLDEA
ARLITLIKDDEKLSDQLADLLPEASDKAITQLCELDFTTAAKISLEAMYRILPHMNQGMGFFDA
CQQESLPEIGVPPAGDRVPPFDEMYNPVVNRVLSQSRKLINAVIDEYGMPAKIRVELARDLGKG
RELRERIKLDQLDKSKQNDQRAEDFRAEFQQAPRGDQSLRYRLWKEQNCTCPYSGRMIPVNSVL
SEDTQIDHILPISQSFDNSLSNKVLCFTEENAQKSNRTPFEYLDAADFQRLEAISGNWPEAKRN
KLLHKSFGKVAEEWKSRALNDTRYLTSALADHLRHHLPDSKIQTVNGRITGYLRKQWGLEKDRD
KHTHHAVDAIVVACTTPAIVQQVTLYHQDIRRYKKLGEKRPTPWPETFRQDVLDVEEEIFITRQ
PKKVSGGIQTKDTLRKHRSKPDRQRVALTKVKLADLERLVEKDASNRNLYEHLKQCLEESGDQP
TKAFKAPFYMPSGPEAKQRPILSKVTLLREKPEPPKQLTELSGGRRYDSMAQGRLDIYRYKPGG
KRKDEYRVVLQRMIDLMRGEENVHVFQKGVPYDQGPEIEQNYTFLFSLYFDDLVEFQRSADSEV
IRGYYRTFNIANGQLKISTYLEGRQDFDFFGANRLAHFAKVQVNLLGKVIK

SEQ ID NO: 374
MRSLRYRLALDLGSTSLGWALFRLDACNRPTAVIKAGVRIFSDGRNPKDGSSLAVTRRAARAMR
RRRDRLLKRKTRMQAKLVEHGFFPADAGKRKALEQLNPYALRAKGLQEALLPGEFARALFHINQ
RRGFKSNRKTDKKDNDSGVLKKAIGQLRQQMAEQGSRTVGEYLWTRLQQGQGVRARYREKPYTT
EEGKKRIDKSYDLYIDRAMIEQEFDALWAAQAAFNPTLFHEAARADLKDTLLHQRPLRPVKPGR
CTLLPEEERAPLALPSTQRFRIHQEVNHLRLLDENLREVALTLAQRDAVVTALETKAKLSFEQI
RKLLKLSGSVQFNLEDAKRTELKGNATSAALARKELFGAAWSGFDEALQDEIVWQLVTEEGEGA
LIAWLQTHTGVDEARAQAIVDVSLPEGYGNLSRKALARIVPALRAAVITYDKAVQAAGFDHHSQ
LGFEYDASEVEDLVHPETGEIRSVFKQLPYYGKALQRHVAFGSGKPEDPDEKRYGKIANPTVHI
GLNQVRMVVNALIRRYGRPTEVVIELARDLKQSREQKVEAQRRQADNQRRNARIRRSIAEVLGI
GEERVRGSDIQKWICWEELSFDAADRRCPYSGVQISAAMLLSDEVEVEHILPFSKTLDDSLNNR
TVAMRQANRIKRNRTPWDARAEFEAQGWSYEDILQRAERMPLRKRYRFAPDGYERWLGDDKDFL
ARALNDTRYLSRVAAEYLRLVCPGTRVIPGQLTALLRGKFGLNDVLGLDGEKNRNDHRHHAVDA
CVIGVTDQGLMQRFATASAQARGDGLTRLVDGMPMPWPTYRDHVERAVRHIWVSHRPDHGFEGA
MMEETSYGIRKDGSIKQRRKADGSAGREISNLIRIHEATQPLRHGVSADGQPLAYKGYVGGSNY
CIEITVNDKGKWEGEVISTFRAYGVVRAGGMGRLRNPHEGQNGRKLIMRLVIGDSVRLEVDGAE
RTMRIVKISGSNGQIFMAPIHEANVDARNTDKQDAFTYTSKYAGSLQKAKTRRVTISPIGEVRD
PGFKG

SEQ ID NO: 375
MARPAFRAPRREHVNGWTPDPHRISKPFFILVSWHLLSRVVIDSSSGCFPGTSRDHTDKFAEWE
CAVQPYRLSFDLGTNSIGWGLLNLDRQGKPREIRALGSRIFSDGRDPQDKASLAVARRLARQMR
RRRDRYLTRRTRLMGALVRFGLMPADPAARKRLEVAVDPYLARERATRERLEPFEIGRALFHLN
QRRGYKPVRTATKPDEEAGKVKEAVERLEAAIAAAGAPTLGAWFAWRKTRGETLRARLAGKGKE
AAYPFYPARRMLEAEFDTLWAEQARHHPDLLTAEAREILRHRIFHQRPLKPPPVGRCTLYPDDG
RAPRALPSAQRLRLFQELASLRVIHLDLSERPLTPAERDRIVAFVQGRPPKAGRKPGKVQKSVP
FEKLRGLLELPPGTGFSLESDKRPELLGDETGARIAPAFGPGWTALPLEEQDALVELLLTEAEP
ERAIAALTARWALDEATAAKLAGATLPDFHGRYGRRAVAELLPVLERETRGDPDGRVRPIRLDE
AVKLLRGGKDHSDFSREGALLDALPYYGAVLERHVAFGTGNPADPEEKRVGRVANPTVHIALNQ

-continued

LRHLVNAILARHGRPEEIVIELARDLKRSAEDRRREDKRQADNQKRNEERKRLILSLGERPTPR
NLLKLRLWEEQGPVENRRCPYSGETISMRMLLSEQVDIDHILPFSVSLDDSAANKVVCLREANR
IKRNRSPWEAFGHDSERWAGILARAEALPKNKRWRFAPDALEKLEGEGGLRARHLNDTRHLSRL
AVEYLRCVCPKVRVSPGRLTALLRRRWGIDAILAEADGPPPEVPAETLDPSPAEKNRADHRHHA
LDAVVIGCIDRSMVQRVQLAAASAEREAAAREDNIRRVLEGFKEEPWDGFRAELERRARTIVVS
HRPEHGIGGALHKETAYGPVDPPEEGFNLVVRKPIDGLSKDEINSVRDPRLRRALIDRLAIRRR
DANDPATALAKAAEDLAAQPASRGIRRVRVLKKESNPIRVEHGGNPSGPRSGGPFHKLLLAGEV
HHVDVALRADGRRWVGHWVTLFEAHGGRGADGAAAPPRLGDGERFLMRLHKGDCLKLEHKGRVR
VMQVVKLEPSSNSVVVVEPHQVKTDRSKHVKISCDQLRARGARRVTVDPLGRVRVHAPGARVGI
GGDAGRTAMEPAEDIS

SEQ ID NO: 376
MKRTSLRAYRLGVDLGANSLGWFVVWLDDHGQPEGLGPGGVRIFPDGRNPQSKQSNAAGRRLAR
SARRRRDRYLQRRGKLMGLLVKHGLMPADEPARKRLECLDPYGLRAKALDEVLPLHHVGRALFH
LNQRRGLFANRAIEQGDKDASAIKAAAGRLQTSMQACGARTLGEFLNRRHQLRATVRARSPVGG
DVQARYEFYPTRAMVDAEFEAIWAAQAPHHPTMTAEAHDTIREAIFSQRAMKRPSIGKCSLDPA
TSQDDVDGFRCAWSHPLAQRFRIWQDVRNLAVVETGPTSSRLGKEDQDKVARALLQTDQLSFDE
IRGLLGLPSDARFNLESDRRDHLKGDATGAILSARRHFGPAWHDRSLDRQIDIVALLESALDEA
AIIASLGTTHSLDEAAAQRALSALLPDGYCRLGLRAIKRVLPLMEAGRTYAEAASAAGYDHALL
PGGKLSPTGYLPYYGQWLQNDVVGSDDERDTNERRWGRLPNPTVHIGIGQLRRVVNELIRWHGP
PAEITVELTRDLKLSPRRLAELEREQAENQRKNDKRTSLLRKLGLPASTHNLLKLRLWDEQGDV
ASECPYTGEAIGLERLVSDDVDIDHLIPFSISWDDSAANKVVCMRYANREKGNRTPFEAFGHRQ
GRPYDWADIAERAARLPRGKRWRFGPGARAQFEELGDFQARLLNETSWLARVAKQYLAAVTHPH
RIHVLPGRLTALLRATWELNDLLPGSDDRAAKSRKDHRHHAIDALVAALTDQALLRRMANAHDD
TRRKIEVLLPWPTFRIDLETRLKAMLVSHKPDHGLQARLHEDTAYGTVEHPETEDGANLVYRKT
FVDISEKEIDRIRDRRLRDLVRAHVAGERQQGKTLKAAVLSFAQRRDIAGHPNGIRHVRLTKSI
KPDYLVPIRDKAGRIYKSYNAGENAFVDILQAESGRWIARATTVFQANQANESHDAPAAQPIMR
VFKGDMLRIDHAGAEKFVKIVRLSPSNNLLYLVEHHQAGVFQTRHDDPEDSFRWLFASFDKLRE
WNAELVRIDTLGQPWRRKRGLETGSEDATRIGWTRPKKWP

SEQ ID NO: 377
MERIFGFDIGTTSIGFSVIDYSSTQSAGNIQRLGVRIFPEARDPDGTPLNQQRRQKRMMRRQLR
RRRIRRKALNETLHEAGFLPAYGSADWPVVMADEPYELRRRGLEEGLSAYEFGRAIYHLAQRH
FKGRELEESDTPDPDVDDEKEAANERAATLKALKNEQTTLGAWLARRPPSDRKRGIHAHRNVVA
EEFERLWEVQSKFHPALKSEEMRARISDTIFAQRPVFWRKNTLGECRFMPGEPLCPKGSWLSQQ
RRMLEKLNNLAIAGGNARPLDAEERDAILSKLQQQASMSWPGVRSALKALYKQRGEPGAEKSLK
FNLELGGESKLLGNALEAKLADMFGPDWPAHPRKQEIRHAVHERLWAADYGETPDKKRVIILSE
KDRKAHREAAANSFVADFGITGEQAAQLQALKLPTGWEPYSIPALNLFLAELEKGERFGALVNG
PDWEGWRRTNFPHRNQPTGEILDKLPSPASKEERERISQLRNPTVVRTQNELRKVVNNLIGLYG
KPDRIRIEVGRDVGKSKEREEIQSGIRRNEKQRKKATEDLIKNGIANPSRDDVEKWILWKEGQ
ERCPYTGDQIGFNALFREGRYEVEHIWPRSRSFDNSPRNKTLCRKDVNIEKGNRMPFEAFGHDE
DRWSAIQIRLQGMVSAKGGTGMSPGKVKRFLAKTMPEDFAARQLNDTRYAAKQILAQLKRLWPD
MGPEAPVKVEAVTGQVTAQLRKLWTLNNILADDGEKTRADHRHHAIDALTVACTHPGMTNKLSR
YWQLRDDPRAEKPALTPPWDTIRADAEKAVSEIVVSHRVRKKVSGPLHKETTYGDTGTDIKTKS

-continued

GTYRQFVTRKKIESLSKGELDEIRDPRIKEIVAAHVAGRGGDPKKAFPPYPCVSPGGPEIRKVR

LTSKQQLNLMAQTGNGYADLGSNHHIAIYRLPDGKADFEIVSLFDASRRLAQRNPIVQRTRADG

ASFVMSLAAGEAIMIPEGSKKGIWIVQGVWASGQVVLERDTDADHSTTTRPMPNPILKDDAKKV

SIDPIGRVRPSND

SEQ ID NO: 378

MNKRILGLDTGTNSLGWAVVDWDEHAQSYELIKYGDVIFQEGVKIEKGIESSKAAERSGYKAIR

KQYFRRRLRKIQVLKVLVKYHLCPYLSDDDLRQWHLQKQYPKSDELMLWQRTSDEEGKNPYYDR

HRCLHEKLDLTVEADRYTLGRALYHLTQRRGFLSNRLDTSADNKEDGVVKSGISQLSTEMEEAG

CEYLGDYFYKLYDAQGNKVRIRQRYTDRNKHYQHEFDAICEKQELSSELIEDLQRAIFFQLPLK

SQRHGVGRCTFERGKPRCADSHPDYEEFRMLCFVNNIQVKGPHDLELRPLTYEEREKIEPLFFR

KSKPNFDFEDIAKALAGKKNYAWIHDKEERAYKFNYRMTQGVPGCPTIAQLKSIFGDDWKTGIA

ETYTLIQKKNGSKSLQEMVDDVWNVLYSFSSVEKLKEFAHHKLQLDEESAEKFAKIKLSHSFAA

LSLKAIRKFLPFLRKGMYYTHASFFANIPTIVGKEIWNKEQNRKYIMENVGELVFNYQPKHREV

QGTIEMLIKDFLANNFELPAGATDKLYHPSMIETYPNAQRNEFGILQLGSPRTNAIRNPMAMRS

LHILRRVVNQLLKESIIDENTEVHVEYARELNDANKRRAIADRQKEQDKQHKKYGDEIRKLYKE

ETGKDIEPTQTDVLKFQLWEEQNHHCLYTGEQIGITDFIGSNPKFDIEHTIPQSVGGDSTQMNL

TLCDNRFNREVKKAKLPTELANHEEILTRIEPWKNKYEQLVKERDKQRTFAGMDKAVKDIRIQK

RHKLQMEIDYWRGKYERFTMTEVPEGFSRRQGTGIGLISRYAGLYLKSLFHQADSRNKSNVYVV

KGVATAEFRKMWGLQSEYEKKCRDNHSHHCMDAITIACIGKREYDLMAEYYRMEETFKQGRGSK

PKFSKPWATFTEDVLNIYKNLLVVHDTPNNMPKHTKKYVQTSIGKVLAQGDTARGSLHLDTYYG

AIERDGEIRYVVRRPLSSFTKPEELENIVDETVKRTIKEAIADKNFKQAIAEPIYMNEEKGILI

KKVRCFAKSVKQPINIRQHRDLSKKEYKQQYHVMNENNYLLAIYEGLVKNKVVREFEIVSYIEA

AKYYKRSQDRNIFSSIVPTHSTKYGLPLKTKLLMGQLVLMFEENPDEIQVDNTKDLVKRLYKVV

GIEKDGRIKFKYHQEARKEGLPIFSTPYKNNDDYAPIFRQSINNINILVDGIDFTIDILGKVTL

KE

SEQ ID NO: 379

MNYKMGLDIGIASVGWAVINLDLKRIEDLGVRIFDKAEHPQNGESLALPRRIARSARRRLRRRK

HRLERIRRLLVSENVLTKEEMNLLFKQKKQIDVWQLRVDALERKLNNDELARVLLHLAKRRGFK

SNRKSERNSKESSEFLKNIEENQSILAQYRSVGEMIVKDSKFAYHKRNKLDSYSNMIARDDLER

EIKLIFEKQREFNNPVCTERLEEKYLNIWSSQRPFASKEDIEKKVGFCTFEPKEKRAPKATYTF

QSFIVWEHINKLRLVSPDETRALTEIERNLLYKQAFSKNKMTYYDIRKLLNLSDDIHFKGLLYD

PKSSLKQIENIRFLELDSYHKIRKCIENVYGKDGIRMFNETDIDTFGYALTIFKDDEDIVAYLQ

NEYITKNGKRVSNLANKVYDKSLIDELLNLSFSKFAHLSMKAIRNILPYMEQGEIYSKACELAG

YNFTGPKKKEKALLLPVIPNIANPVVMRALTQSRKVVNAIIKKYGSPVSIHIELARDLSHSFDE

RKKIQKDQTENRKKNETAIKQLIEYELTKNPTGLDIVKFKLWSEQQGRCMYSLKPIELERLLEP

GYVEVDHILPYSRSLDDSYANKVLVLTKENREKGNHTPVEYGLGSERWKKFEKFVLANKQFSK

KKKQNLLRLRYEETEEKEFKERNLNDTRYISKFFANFIKEHLKFADGDGGQKVYTINGKITAHL

RSRWDFNKNREESDLHHAVDAVIVACATQGMIKKITEFYKAREQNKESAKKKEPIFPQPWPHFA

DELKARLSKFPQESIEAFALGNYDRKKLESLRPVFVSRMPKRSVTGAAHQETLRRCVGIDEQSG

KIQTAVKTKLSDIKLDKDGHFPMYQKESDPRTYEAIRQRLLEHNNDPKKAFQEPLYKPKKNGEP

GPVIRTVKIIDTKNKVVHLDGSKTVAYNSNIVRTDVFEKDGKYYCVPVYTMDIMKGTLPNKAIE

-continued

ANKPYSEWKEMTEEYTFQFSLFPNDLVRIVLPREKTIKTSTNEEIIIKDIFAYYKTIDSATGGL

ELISHDRNFSLRGVGSKTLKRFEKYQVDVLGNIHKVKGEKRVGLAAPTNQKKGKTVDSLQSVSD

SEQ ID NO: 380
MRRLGLDLGTNSIGWCLLDLGDDGEPVSIFRTGARIFSDGRDPKSLGSLKATRREARLTRRRD

RFIQRQKNLINALVKYGLMPADEIQRQALAYKDPYPIRKKALDEAIDPYEMGRAIFHINQRRGF

KSNRKSADNEAGVVKQSIADLEMKLGEAGARTIGEFLADRQATNDTVRARRLSGTNALYEFYPD

RYMLEQEFDTLWAKQAAFNPSLYIEAARERLKEIVFFQRKLKPQEVGRCIFLSDEDRISKALPS

FQRFRIYQELSNLAWIDHDGVAHRITASLALRDHLFDELEHKKKLTFKAMRAILRKQGVVDYPV

GFNLESDNRDHLIGNLTSCIMRDAKKMIGSAWDRLDEEEQDSFILMLQDDQKGDDEVRSILTQQ

YGLSDDVAEDCLDVRLPDGHGSLSKKAIDRILPVLRDQGLIYYDAVKEAGLGEANLYDPYAALS

DKLDYYGKALAGHVMGASGKFEDSDEKRYGTISNPTVHIALNQVRAVVNELIRLHGKPDEVVIE

IGRDLPMGADGKRELERFQKEGRAKNERARDELKKLGHIDSRESRQKFQLWEQLAKEPVDRCCP

FTGKMMSISDLFSDKVEIEHLLPFSLTLDDSMANKTVCFRQANRDKGNRAPFDAFGNSPAGYDW

QEILGRSQNLPYAKRWRFLPDAMKRFEADGGFLERQLNDTRYISRYTTEYISTIIPKNKIWVVT

GRLTSLLRGFWGLNSILRGHNTDDGTPAKKSRDDHRHHAIDAIVVGMTSRGLLQKVSKAARRSE

DLDLTRLFEGRIDPWDGFRDEVKKHIDAIIVSHRPRKKSQGALHNDTAYGIVEHAENGASTVVH

RVPITSLGKQSDIEKVRDPLIKSALLNETAGLSGKSFENAVQKWCADNSIKSLRIVETVSIIPI

TDKEGVAYKGYKGDGNAYMDIYQDPTSSKWKGEIVSRFDANQKGFIPSWQSQFPTARLIMRLRI

NDLLKLQDGEIEEIYRVQRLSGSKILMAPHTEANVDARDRDKNDTFKLTSKSPGKLQSASARKV

HISPTGLIREG

SEQ ID NO: 381
MKNILGLDLGLSSIGWSVIRENSEEQELVAMGSRVVSLTAAELSSFTQGNGVSINSQRTQKRTQ

RKGYDRYQLRRTLLRNKLDTLGMLPDDSLSYLPKLQLWGLRAKAVTQRIELNELGRVLLHLNQK

RGYKSIKSDFSGDKKITDYVKTVKTRYDELKEMRLTIGELFFRRLTENAFFRCKEQVYPRQAYV

EEFDCIMNCQRKFYPDILTDETIRCIRDEIIYYQRPLKSCKYLVSRCEFEKRFYLNAAGKKTEA

GPKVSPRTSPLFQVCRLWESINNIVVKDRRNEIVFISAEQRAALFDFLNTHEKLKGSDLLKLLG

LSKTYGYRLGEQFKTGIQGNKTRVEIERALGNYPDKKRLLQFNLQEESSSMVNTETGEIIPMIS

LSFEQEPLYRLWHVLYSIDDREQLQSVLRQKFGIDDDEVLERLSAIDLVKAGFGNKSSKAIRRI

LPFLQLGMNYAEACEAAGYNHSNNYTKAENEARALLDRLPAIKKNELRQPVVEKILNQMVNVVN

ALMEKYGRFDEIRVELARELKQSKEERSNTYKSINKNQRENEQIAKRIVEYGVPTRSRIQKYKM

WEESKHCCIYCGQPVDVGDFLRGFDVEVEHIIPKSLYFDDSFANKVCSCRSCNKEKNNRTAYDY

MKSKGEKALSDYVERVNTMYTNNQISKTKWQNLLTPVDKISIDFIDRQLRESQYIARKAKEILT

SICYNVTATSGSVTSFLRHVWGWDTVLHDLNFDRYKKVGLTEVIEVNHRGSVIRREQIKDWSKR

FDHRHHAIDALTIACTKQAYIQRLNNLRAEEGPDFNKMSLERYIQSQPHFSVAQVREAVDRILV

SFRAGKRAVTPGKRYIRKNRKRISVQSVLIPRGALSEESVYGVIHVWEKDEQGHVIQKQRAVMK

YPITSINREMLDKEKVVDKRIHRILSGRLAQYNDNPKEAFAKPVYIDKECRIPIRTVRCFAKPA

INTLVPLKKDDKGNPVAWVNPGNNHHVAIYRDEDGKYKERTVTFWEAVDRCRVGIPAIVTQPDT

IWDNILQRNDISENVLESLPDVKWQFVLSLQQNEMFILGMNEEDYRYAMDQQDYALLNKYLYRV

QKLSKSDYSFRYHTETSVEDKYDGKPNLKLSMQMGKLKRVSIKSLLGLNPHKVHISVLGEIKEI

S

SEQ ID NO: 382
MAEKQHRWGLDIGTNSIGWAVIALIEGRPAGLVATGSRIFSDGRNPKDGSSLAVERRGPRQMRR

-continued

RRDRYLRRRDRFMQALINVGLMPGDAAARKALVTENPYVLRQRGLDQALTLPEFGRALFHLNQR

RGFQSNRKTDRATAKESGKVKNAIAAFRAGMGNARTVGEALARRLEDGRPVRARMVGQGKDEHY

ELYIAREWIAQEFDALWASQQRFHAEVLADAARDRLRAILLFQRKLLPVPVGKCFLEPNQPRVA

AALPSAQRFRLMQELNHLRVMTLADKRERPLSFQERNDLLAQLVARPKCGFDMLRKIVFGANKE

AYRFTIESERRKELKGCDTAAKLAKVNALGTRWQALSLDEQDRLVCLLLDGENDAVLADALREH

YGLTDAQIDTLLGLSFEDGHMRLGRSALLRVLDALESGRDEQGLPLSYDKAVVAAGYPAHTADL

ENGERDALPYYGELLWRYTQDAPTAKNDAERKFGKIANPTVHIGLNQLRKLVNALIQRYGKPAQ

IVVELARNLKAGLEEKERIKKQQTANLERNERIRQKLQDAGVPDNRENRLRMRLFEELGQGNGL

GTPCIYSGRQISLQRLFSNDVQVDHILPFSKTLDDSFANKVLAQHDANRYKGNRGPFEAFGANR

DGYAWDDIRARAAVLPRNKRNRFAETAMQDWLHNETDFLARQLTDTAYLSRVARQYLTAICSKD

DVYVSPGRLTAMLRAKWGLNRVLDGVMEEQGRPAVKNRDDHRHHAIDAVVIGATDRAMLQQVAT

LAARAREQDAERLIGDMPTPWPNFLEDVRAAVARCVVSHKPDHGPEGGLHNDTAYGIVAGPFED

GRYRVRHRVSLFDLKPGDLSNVRCDAPLQAELEPIFEQDDARAREVALTALAERYRQRKVWLEE

LMSVLPIRPRGEDGKTLPDSAPYKAYKGDSNYCYELFINERGRWDGELISTFRANQAAYRRFRN

DPARFRRYTAGGRPLLMRLCINDYIAVGTAAERTIFRVVKMSENKITLAEHFEGGTLKQRDADK

DDPFKYLTKSPGALRDLGARRIFVDLIGRVLDPGIKGD

SEQ ID NO: 383

MIERILGVDLGISSLGWAIVEYDKDDEAANRIIDCGVRLFTAAETPKKKESPNKARREARGIRR

VLNRRRVRMNMIKKLFLRAGLIQDVDLDGEGGMFYSKANRADVWELRHDGLYRLLKGDELARVL

IHIAKHRGYKFIGDDEADEESGKVKKAGVVLRQNFEAAGCRTVGEWLWRERGANGKKRNKHGDY

EISIHRDLLVEEVEAIFVAQQEMRSTIATDALKAAYREIAFFVRPMQRIEKMVGHCTYFPEERR

APKSAPTAEKFIAISKFFSTVIIDNEGWEQKIIERKTLEELLDFAVSREKVEFRHLRKFLDLSD

NEIFKGLHYKGKPKTAKKREATLFDPNEPTELEFDKVEAEKKAWISLRGAAKLREALGNEFYGR

FVALGKHADEATKILTYYKDEGQKRRELTKLPLEAEMVERLVKIGFSDFLKLSLKAIRDILPAM

ESGARYDEAVLMLGVPHKEKSAILPPLNKTDIDILNPTVIRAFAQFRKVANALVRKYGAFDRVH

FELAREINTKGEIEDIKESQRKNEKERKEAADWIAETSFQVPLTRKNILKKRLYIQQDGRCAYT

GDVIELERLFDEGYCEIDHILPRSRSADDSFANKVLCLARANQQKTDRTPYEWFGHDAARWNAF

ETRTSAPSNRVRTGKGKIDRLLKKNFDENSEMAFKDRNLNDTRYMARAIKTYCEQYWVFKNSHT

KAPVQVRSGKLTSVLRYQWGLESKDRESHTHHAVDAIIIAFSTQGMVQKLSEYYRFKETHREKE

RPKLAVPLANFRDAVEEATRIENTETVKEGVEVKRLLISRPPRARVTGQAHEQTAKPYPRIKQV

KNKKKWRLAPIDEEKFESFKADRVASANQKNFYETSTIPRVDVYHKKGKFHLVPIYLHEMVLNE

LPNLSLGTNPEAMDENFFKFSIFKDDLISIQTQGTPKKPAKIIMGYFKNMHGANMVLSSINNSP

CEGFTCTPVSMDKKHKDKCKLCPEENRIAGRCLQGFLDYWSQEGLRPPRKEFECDQGVKFALDV

KKYQIDPLGYYYEVKQEKRLGTIPQMRSAKKLVKK

SEQ ID NO: 384

MNNSIKSKPEVTIGLDLGVGSVGWAIVDNETNIIHHLGSRLFSQAKTAEDRRSFRGVRRLIRRR

KYKLKRFVNLIWKYNSYFGFKNKEDILNNYQEQQKLHNTVLNLKSEALNAKIDPKALSWILHDY

LKNRGHFYEDNRDFNVYPTKELAKYFDKYGYYKGIIDSKEDNDNKLEEELTKYKFSNKHWLEEV

KKVLSNQTGLPEKFKEEYESLFSYVRNYSEGPGSINSVSPYGIYHLDEKEGKVVQKYNNIWDKT

IGKCNIFPDEYRAPKNSPIAMIFNEINELSTIRSYSIYLTGWFINQEFKKAYLNKLLDLLIKTN

GEKPIDARQFKKLREETIAESIGKETLKDVENEEKLEKEDHKWKLKGLKLNTNGKIQYNDLSSL

AKFVHKLKQHLKLDFLLEDQYATLDKINFLQSLFVYLGKHLRYSNRVDSANLKEFSDSNKLFER

-continued

ILQKQKDGLFKLFEQTDKDDEKILAQTHSLSTKAMLLAITRMTNLDNDEDNQKNNDKGWNFEAI
KNFDQKFIDITKKNNNLSLKQNKRYLDDRFINDAILSPGVKRILREATKVFNAILKQFSEEYDV
TKVVIELARELSEEKELENTKNYKKLIKKNGDKISEGLKALGISEDEIKDILKSPTKSYKFLLW
LQQDHIDPYSLKEIAFDDIFTKTEKFEIDHIIPYSISFDDSSSNKLLVLAESNQAKSNQTPYEF
ISSGNAGIKWEDYEAYCRKFKDGDSSLLDSTQRSKKFAKMMKTDTSSKYDIGFLARNLNDTRYA
TIVFRDALEDYANNHLVEDKPMFKVVCINGSVTSFLRKNFDDSSYAKKDRDKNIHHAVDASIIS
IFSNETKTLFNQLTQFADYKLFKNTDGSWKKIDPKTGVVTEVTDENWKQIRVRNQVSEIAKVIE
KYIQDSNIERKARYSRKIENKTNISLFNDTVYSAKKVGYEDQIKRKNLKTLDIHESAKENKNSK
VKRQFVYRKLVNVSLLNNDKLADLFAEKEDILMYRANPWVINLAEQIFNEYTENKKIKSQNVFE
KYMLDLTKEFPEKFSEFLVKSMLRNKTAIIYDDKKNIVHRIKRLKMLSSELKENKLSNVIIRSK
NQSGTKLSYQDTINSLALMIMRSIDPTAKKQYIRVPLNTLNLHLGDHDFDLHNMDAYLKKPKFV
KYLKANEIGDEYKPWRVLTSGTLLIHKKDKKLMYISSFQNLNDVIEIKNLIETEYKENDDSDSK
KKKKANRFLMTLSTILNDYILLDAKDNFDILGLSKNRIDEILNSKLGLDKIVK

SEQ ID NO: 385
MGGSEVGTVPVTWRLGVDVGERSIGLAAVSYEEDKPKEILAAVSWIHDGGVGDERSGASRLALR
GMARRARRLRRFRRARLRDLDMLLSELGWTPLPDKNVSPVDAWLARKRLAEEYVVDETERRRLL
GYAVSHMARHRGWRNPWTTIKDLKNLPQPSDSWERTRESLEARYSVSLEPGTVGQWAGYLLQRA
PGIRLNPTQQSAGRRAELSNATAFETRLRQEDVLWELRCIADVQGLPEDVVSNVIDAVFCQKRP
SVPAERIGRDPLDPSQLRASRACLEFQEYRIVAAVANLRIRDGSGSRPLSLEERNAVIEALLAQ
TERSLTWSDIALEILKLPNESDLTSVPEEDGPSSLAYSQFAPFDETSARIAEFIAKNRRKIPTF
AQWWQEQDRTSRSDLVAALADNSIAGEEEQELLVHLPDAELEALEGLALPSGRVAYSRLTLSGL
TRVMRDDGVDVHNARKTCFGVDDNWRPPLPALHEATGHPVVDRNLAILRKFLSSATMRWGPPQS
IVVELARGASESRERQAEEEAARRAHRKANDRIRAELRASGLSDPSPADLVRARLLELYDCHCM
YCGAPISWENSELDHIVPRTDGGSNRHENLAITCGACNKEKGRRPFASWAETSNRVQLRDVIDR
VQKLKYSGNMYWTRDEFSRYKKSVVARLKRRTSDPEVIQSIESTGYAAVALRDRLLSYGEKNGV
AQVAVFRGGVTAEARRWLDISIERLFSRVAIFAQSTSTKRLDRRHHAVDAVVLTTLTPGVAKTL
ADARSRRVSAEFWRRPSDVNRHSTEEPQSPAYRQWKESCSGLGDLLISTAARDSIAVAAPLRLR
PTGALHEETLRAFSEHTVGAAWKGAELRRIVEPEVYAAFLALTDPGGRFLKVSPSEDVLPADEN
RHIVLSDRVLGPRDRVKLFPDDRGSIRVRGGAAYIASFHHARVFRWGSSHSPSFALLRVSLADL
AVAGLLRDGVDVFTAELPPWTPAWRYASIALVKAVESGDAKQVGWLVPGDELDFGPEGVTTAAG
DLSMFLKYFPERHWVVTGFEDDKRINLKPAFLSAEQAEVLRTERSDRPDTLTEAGEILAQFFPR
CWRATVAKVLCHPGLTVIRRTALGQPRWRRGHLPYSWRPWSADPWSGGTP

SEQ ID NO: 386
MHNKKNITIGFDLGIASIGWAIIDSTTSKILDWGTRTFEERKTANERRAFRSTRRNIRRKAYRN
QRFINLILKYKDLFELKNISDIQRANKKDTENYEKIISFFTEIYKKCAAKHSNILEVKVKALDS
KIEKLDLIWILHDYLENRGFFYDLEEENVADKYEGIEHPSILLYDFFKKNGFFKSNSSIPKDLG
GYSFSNLQWVNEIKKLFEVQEINPEFSEKFLNLFTSVRDYAKGPGSEHSASEYGIFQKDEKGKV
FKKYDNIWDKTIGKCSFFVEENRSPVNYPSYEIFNLLNQLINLSTDLKTTNKKIWQLSSNDRNE
LLDELLKVKEKAKIISISLKKNEIKKIILKDFGFEKSDIDDQDTIEGRKIIKEEPTTKLEVTKH
LLATIYSHSSDSNWININNILEFLPYLDAICIILDREKSRGQDEVLKKLTEKNIFEVLKIDREK
QLDFVKSIFSNTKFNFKKIGNFSLKAIREFLPKMFEQNKNSEYLKWKDEEIRRKWEEQKSKLGK

-continued

```
TDKKTKYLNPRIFQDEIISPGTKNTFEQAVLVLNQIIKKYSKENIIDAIIIESPREKNDKKTIE

EIKKRNKKGKGKTLEKLFQILNLENKGYKLSDLETKPAKLLDRLRFYHQQDGIDLYTLDKINID

QLINGSQKYEIEHIIPYSMSYDNSQANKILTEKAENLKKGKLIASEYIKRNGDEFYNKYYEKAK

ELFINKYKKNKKLDSYVDLDEDSAKNRFRFLTLQDYDEFQVEFLARNLNDTRYSTKLFYHALVE

HFENNEFFTYIDENSSKHKVKISTIKGHVTKYFRAKPVQKNNGPNENLNNNKPEKIEKNRENNE

HHAVDAAIVAIIGNKNPQIANLLTLADNKTDKKFLLHDENYKENIETGELVKIPKFEVDKLAKV

EDLKKIIQEKYEEAKKHTAIKFSRKTRTILNGGLSDETLYGFKYDEKEDKYFKIIKKKLVTSKN

EELKKYFENPFGKKADGKSEYTVLMAQSHLSEFNKLKEIFEKYNGFSNKTGNAFVEYMNDLALK

EPTLKAEIESAKSVEKLLYYNFKPSDQFTYHDNINNKSFKRFYKNIRIIEYKSIPIKFKILSKH

DGGKSFKDTLFSLYSLVYKVYENGKESYKSIPVTSQMRNFGIDEFDFLDENLYNKEKLDIYKSD

FAKPIPVNCKPVFVLKKGSILKKKSLDIDDFKETKETEEGNYYFISTISKRFNRDTAYGLKPLK

LSVVKPVAEPSTNPIFKEYIPIHLDELGNEYPVKIKEHTDDEKLMCTIK
```

Nucleic Acids Encoding Cas9 Molecules

Nucleic acids encoding the Cas9 molecules or Cas9 polypeptides, e.g., an eaCas9 molecule or eaCas9 polypeptides are provided herein.

Exemplary nucleic acids encoding Cas9 molecules or Cas9 polypeptides are described in Cong et al., SCIENCE 2013, 399(6121):819-823; Wang et al., CELL 2013, 153(4):910-918; Mali et al., SCIENCE 2013, 399(6121):823-826; Jinek el al., SCIENCE 2012, 337(6096):816-821. Another exemplary nucleic acid encoding a Cas9 molecule or Cas9 polypeptide is shown in FIG. 8.

In an embodiment, a nucleic acid encoding a Cas9 molecule or Cas9 polypeptide can be a synthetic nucleic acid sequence. For example, the synthetic nucleic acid molecule can be chemically modified, e.g., as described in Section VIII. In an embodiment, the Cas9 mRNA has one or more (e.g., all of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 molecule or Cas9 polypeptide may comprise a nuclear localization sequence (NLS). Nuclear localization sequences are known in the art.

Provided below is an exemplary codon optimized nucleic acid sequence encoding a Cas9 molecule of S. pyogenes.

(SEQ ID NO: 22)
```
ATGGATAAAA AGTACAGCAT CGGGCTGGAC ATCGGTACAA ACTCAGTGGG

GTGGGCCGTG ATTACGGACG AGTACAAGGT ACCCTCCAAA AAATTTAAAG

TGCTGGGTAA CACGGACAGA CACTCTATAA AGAAAAATCT TATTGGAGCC

TTGCTGTTCG ACTCAGGCGA GACAGCCGAA GCCACAAGGT TGAAGCGGAC

CGCCAGGAGG CGGTATACCA GGAGAAAGAA CCGCATATGC TACCTGCAAG

AAATCTTCAG TAACGAGATG GCAAAGGTTG ACGATAGCTT TTTCCATCGC

CTGGAAGAAT CCTTTCTTGT TGAGGAAGAC AAGAAGCACG AACGGCACCC

CATCTTTGGC AATATTGTCG ACGAAGTGGC ATATCACGAA AAGTACCCGA

CTATCTACCA CCTCAGGAAG AAGCTGGTGG ACTCTACCGA TAAGGCGGAC

CTCAGACTTA TTTATTTGGC ACTCGCCCAC ATGATTAAAT TTAGAGGACA

TTTCTTGATC GAGGGCGACC TGAACCCGGA CAACAGTGAC GTCGATAAGC

TGTTCATCCA ACTTGTGCAG ACCTACAATC AACTGTTCGA AGAAAACCCT

ATAAATGCTT CAGGAGTCGA CGCTAAAGCA ATCCTGTCCG CGCGCCTCTC

AAAATCTAGA AGACTTGAGA ATCTGATTGC TCAGTTGCCC GGGGAAAAGA

AAAATGGATT GTTTGGCAAC CTGATCGCCC TCAGTCTCGG ACTGACCCCA

AATTTCAAAA GTAACTTCGA CCTGGCCGAA GACGCTAAGC TCCAGCTGTC

CAAGGACACA TACGATGACG ACCTCGACAA TCTGCTGGCC CAGATTGGGG
```

-continued

```
ATCAGTACGC CGATCTCTTT TTGGCAGCAA AGAACCTGTC CGACGCCATC
CTGTTGAGCG ATATCTTGAG AGTGAACACC GAAATTACTA AAGCACCCCT
TAGCGCATCT ATGATCAAGC GGTACGACGA GCATCATCAG GATCTGACCC
TGCTGAAGGC TCTTGTGAGG CAACAGCTCC CCGAAAAATA CAAGGAAATC
TTCTTTGACC AGAGCAAAAA CGGCTACGCT GGCTATATAG ATGGTGGGGC
CAGTCAGGAG GAATTCTATA AATTCATCAA GCCCATTCTC GAGAAAATGG
ACGGCACAGA GGAGTTGCTG GTCAAACTTA ACAGGGAGGA CCTGCTGCGG
AAGCAGCGGA CCTTTGACAA CGGGTCTATC CCCCACCAGA TTCATCTGGG
CGAACTGCAC GCAATCCTGA GGAGGCAGGA GGATTTTTAT CCTTTTCTTA
AAGATAACCG CGAGAAAATA GAAAAGATTC TTACATTCAG GATCCCGTAC
TACGTGGGAC CTCTCGCCCG GGGCAATTCA CGGTTTGCCT GGATGACAAG
GAAGTCAGAG GAGACTATTA CACCTTGGAA CTTCGAAGAA GTGGTGGACA
AGGGTGCATC TGCCCAGTCT TTCATCGAGC GGATGACAAA TTTTGACAAG
AACCTCCCTA ATGAGAAGGT GCTGCCCAAA CATTCTCTGC TCTACGAGTA
CTTTACCGTC TACAATGAAC TGACTAAAGT CAAGTACGTC ACCGAGGGAA
TGAGGAAGCC GGCATTCCTT AGTGGAGAAC AGAAGAAGGC GATTGTAGAC
CTGTTGTTCA AGACCAACAG GAAGGTGACT GTGAAGCAAC TTAAAGAAGA
CTACTTTAAG AAGATCGAAT GTTTTGACAG TGTGGAAATT TCAGGGGTTG
AAGACCGCTT CAATGCGTCA TTGGGGACTT ACCATGATCT TCTCAAGATC
ATAAAGGACA AAGACTTCCT GGACAACGAA GAAAATGAGG ATATTCTCGA
AGACATCGTC CTCACCCTGA CCCTGTTCGA AGACAGGGAA ATGATAGAAG
AGCGCTTGAA AACCTATGCC CACCTCTTCG ACGATAAAGT TATGAAGCAG
CTGAAGCGCA GGAGATACAC AGGATGGGGA AGATTGTCAA GGAAGCTGAT
CAATGGAATT AGGGATAAAC AGAGTGGCAA GACCATACTG GATTTCCTCA
AATCTGATGG CTTCGCCAAT AGGAACTTCA TGCAACTGAT TCACGATGAC
TCTCTTACCT TCAAGGAGGA CATTCAAAAG GCTCAGGTGA GCGGGCAGGG
AGACTCCCTT CATGAACACA TCGCGAATTT GGCAGGTTCC CCCGCTATTA
AAAAGGGCAT CCTTCAAACT GTCAAGGTGG TGGATGAATT GGTCAAGGTA
ATGGGCAGAC ATAAGCCAGA AAATATTGTG ATCGAGATGG CCCGCGAAAA
CCAGACCACA CAGAAGGGCC AGAAAAATAG TAGAGAGCGG ATGAAGAGGA
TCGAGGAGGG CATCAAAGAG CTGGGATCTC AGATTCTCAA AGAACACCCC
GTAGAAAACA CACAGCTGCA GAACGAAAAA TTGTACTTGT ACTATCTGCA
GAACGGCAGA GACATGTACG TCGACCAAGA ACTTGATATT AATAGACTGT
CCGACTATGA CGTAGACCAT ATCGTGCCCC AGTCCTTCCT GAAGGACGAC
TCCATTGATA ACAAAGTCTT GACAAGAAGC GACAAGAACA GGGGTAAAAG
TGATAATGTG CCTAGCGAGG AGGTGGTGAA AAAAATGAAG AACTACTGGC
GACAGCTGCT TAATGCAAAG CTCATTACAC AACGGAAGTT CGATAATCTG
ACGAAAGCAG AGAGAGGTGG CTTGTCTGAG TTGGACAAGG CAGGGTTTAT
TAAGCGGCAG CTGGTGGAAA CTAGGCAGAT CACAAAGCAC GTGGCGCAGA
TTTTGGACAG CCGGATGAAC ACAAAATACG ACGAAAATGA TAAACTGATA
```

```
                         -continued
CGAGAGGTCA AAGTTATCAC GCTGAAAAGC AAGCTGGTGT CCGATTTTCG

GAAAGACTTC CAGTTCTACA AAGTTCGCGA GATTAATAAC TACCATCATG

CTCACGATGC GTACCTGAAC GCTGTTGTCG GGACCGCCTT GATAAAGAAG

TACCCAAAGC TGGAATCCGA GTTCGTATAC GGGGATTACA AAGTGTACGA

TGTGAGGAAA ATGATAGCCA AGTCCGAGCA GGAGATTGGA AAGGCCACAG

CTAAGTACTT CTTTTATTCT AACATCATGA ATTTTTTAA GACGGAAATT

ACCCTGGCCA ACGGAGAGAT CAGAAAGCGG CCCCTTATAG AGACAAATGG

TGAAACAGGT GAAATCGTCT GGGATAAGGG CAGGGATTTC GCTACTGTGA

GGAAGGTGCT GAGTATGCCA CAGGTAAATA TCGTGAAAAA ACCGAAGTA

CAGACCGGAG GATTTTCCAA GGAAAGCATT TTGCCTAAAA GAAACTCAGA

CAAGCTCATC GCCCGCAAGA AAGATTGGGA CCCTAAGAAA TACGGGGGAT

TTGACTCACC CACCGTAGCC TATTCTGTGC TGGTGGTAGC TAAGGTGGAA

AAAGGAAAGT CTAAGAAGCT GAAGTCCGTG AAGGAACTCT TGGGAATCAC

TATCATGGAA AGATCATCCT TTGAAAAGAA CCCTATCGAT TTCCTGGAGG

CTAAGGGTTA CAAGGAGGTC AAGAAAGACC TCATCATTAA ACTGCCAAAA

TACTCTCTCT TCGAGCTGGA AAATGGCAGG AAGAGAATGT TGGCCAGCGC

CGGAGAGCTG CAAAAGGGAA ACGAGCTTGC TCTGCCCTCC AAATATGTTA

ATTTTCTCTA TCTCGCTTCC CACTATGAAA AGCTGAAAGG GTCTCCCGAA

GATAACGAGC AGAAGCAGCT GTTCGTCGAA CAGCACAAGC ACTATCTGGA

TGAAATAATC GAACAAATAA GCGAGTTCAG CAAAAGGGTT ATCCTGGCGG

ATGCTAATTT GGACAAAGTA CTGTCTGCTT ATAACAAGCA CCGGGATAAG

CCTATTAGGG AACAAGCCGA GAATATAATT CACCTCTTTA CACTCACGAA

TCTCGGAGCC CCCGCCGCCT TCAAATACTT TGATACGACT ATCGACCGGA

AACGGTATAC CAGTACCAAA GAGGTCCTCG ATGCCACCCT CATCCACCAG

TCAATTACTG GCCTGTACGA AACACGGATC GACCTCTCTC AACTGGGCGG

CGACTAG
```

Provided below is the corresponding amino acid sequence of a *S. pyogenes* Cas9 molecule.

```
                                          (SEQ ID NO: 23)
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

-continued
LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK
```

```
YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD*
```

Provided below is an exemplary codon optimized nucleic acid sequence encoding a Cas9 molecule of *N. meningitidis*.

```
                                         (SEQ ID NO: 24)
ATGGCCGCCTTCAAGCCCAACCCCATCAACTACATCCTGGGCCTGGACAT

CGGCATCGCCAGCGTGGGCTGGGCCATGGTGGAGATCGACGAGGACGAGA

ACCCCATCTGCCTGATCGACCTGGGTGTGCGCGTGTTCGAGCGCGCTGAG

GTGCCCAAGACTGGTGACAGTCTGGCTATGGCTCGCCGGCTTGCTCGCTC

TGTTCGGCGCCTTACTCGCCGGCGCGCTCACCGCCTTCTGCGCGCTCGCC

GCCTGCTGAAGCGCGAGGGTGTGCTGCAGGCTGCCGACTTCGACGAGAAC

GGCCTGATCAAGAGCCTGCCCAACACTCCTTGGCAGCTGCGCGCTGCCGC

TCTGGACCGCAAGCTGACTCCTCTGGAGTGGAGCGCCGTGCTGCTGCACC

TGATCAAGCACCGCGGCTACCTGAGCCAGCGCAAGAACGAGGGCGAGACC

GCCGACAAGGAGCTGGGTGCTCTGCTGAAGGGCGTGGCCGACAACGCCCA

CGCCCTGCAGACTGGTGACTTCCGCACTCCTGCTGAGCTGGCCCTGAACA

AGTTCGAGAAGGAGAGCGGCCACATCCGCAACCAGCGCGGCGACTACAGC

CACACCTTCAGCCGCAAGGACCTGCAGGCCGAGCTGATCCTGCTGTTCGA

GAAGCAGAAGGAGTTCGGCAACCCCCACGTGAGCGGCGGCCTGAAGGAGG

GCATCGAGACCCTGCTGATGACCCAGCGCCCCGCCCTGAGCGGCGACGCC

GTGCAGAAGATGCTGGGCCACTGCACCTTCGAGCCAGCCGAGCCCAAGGC

CGCCAAGAACACCTACACCGCCGAGCGCTTCATCTGGCTGACCAAGCTGA

ACAACCTGCGCATCCTGGAGCAGGGCAGCGAGCGCCCCCTGACCGACACC

GAGCGCGCCACCCTGATGGACGAGCCCTACCGCAAGAGCAAGCTGACCTA

CGCCCAGGCCCGCAAGCTGCTGGGTCTGGAGGACACCGCCTTCTTCAAGG

GCCTGCGCTACGGCAAGGACAACGCCGAGGCCAGCACCCTGATGGAGATG

AAGGCCTACCACGCCATCAGCCGCGCCCTGGAGAAGGAGGGCCTGAAGGA

CAAGGAGAGTCCTCTGAACCTGAGCCCCGAGCTGCAGGACGAGATCGGCA

CCGCCTTCAGCCTGTTCAAGACCGACGAGGACATCACCGGCCGCCTGAAG

GACCGCATCCAGCCCGAGATCCTGGAGGCCCTGCTGAAGCACATCAGCTT

CGACAAGTTCGTGCAGATCAGCCTGAAGGCCCTGCGCCGCATCGTGCCCC

TGATGGAGCAGGGCAAGCGCTACGACGAGGCCTGCGCCGAGATCTACGGC

GACCACTACGGCAAGAAGAACACCGAGGAGAAGATCTACCTGCCTCCTAT

CCCCGCCGACGAGATCCGCAACCCCGTGGTGCTGCGCGCCCTGAGCCAGG

CCCGCAAGGTGATCAACGGCGTGGTGCGCCGCTACGGCAGCCCCGCCCGC

ATCCACATCGAGACCGCCCGCGAGGTGGGCAAGAGCTTCAAGGACCGCAA

GGAGATCGAGAAGCGCCAGGAGGAGAACCGCAAGGACCGCGAGAAGGCCG

CCGCCAAGTTCCGCGAGTACTTCCCCAACTTCGTGGGCGAGCCCAAGAGC

AAGGACATCCTGAAGCTGCGCCTGTACGAGCAGCAGCACGGCAAGTGCCT

GTACAGCGGCAAGGAGATCAACCTGGGCCGCCTGAACGAGAAGGGCTACG

TGGAGATCGACCACGCCCTGCCCTTCAGCCGCACCTGGGACGACAGCTTC

AACAACAAGGTGCTGGTGCTGGGCAGCGAGAACCAGAACAAGGGCAACCA

GACCCCCTACGAGTACTTCAACGGCAAGGACAACAGCCGCGAGTGGCAGG

AGTTCAAGGCCCGCGTGGAGACCAGCCGCTTCCCCCGCAGCAAGAAGCAG

CGCATCCTGCTGCAGAAGTTCGACGAGGACGGCTTCAAGGAGCGCAACCT

GAACGACACCCGCTACGTGAACCGCTTCCTGTGCCAGTTCGTGGCCGACC

GCATGCGCCTGACCGGCAAGGGCAAGAAGCGCGTGTTCGCCAGCAACGGC

CAGATCACCAACCTGCTGCGCGGCTTCTGGGGCCTGCGCAAGGTGCGCGC

CGAGAACGACCGCCACCACGCCCTGGACGCCGTGGTGGTGGCCTGCAGCA

CCGTGGCCATGCAGCAGAAGATCACCCGCTTCGTGCGCTACAAGGAGATG

AACGCCTTCGACGGTAAAACCATCGACAAGGAGACCGGCGAGGTGCTGCA

CCAGAAGACCCACTTCCCCCAGCCCTGGGAGTTCTTCGCCCAGGAGGTGA

TGATCCGCGTGTTCGGCAAGCCCGACGGCAAGCCCGAGTTCGAGGAGGCC

GACACCCCCGAGAAGCTGCGCACCCTGCTGGCCGAGAAGCTGAGCAGCCG

CCCTGAGGCCGTGCACGAGTACGTGACTCCTCTGTTCGTGAGCCGCGCCC

CCAACCGCAAGATGAGCGGTCAGGGTCACATGGAGACCGTGAAGAGCGCC

AAGCGCCTGGACGAGGGCGTGAGCGTGCTGCGCGTGCCCCTGACCCAGCT

GAAGCTGAAGGACCTGGAGAAGATGGTGAACCGCGAGCGCGAGCCCAAGC

TGTACGAGGCCCTGAAGGCCCGCCTGGAGGCCCACAAGGACGACCCCGCC

AAGGCCTTCGCCGAGCCCTTCTACAAGTACGACAAGGCCGGCAACCGCAC

CCAGCAGGTGAAGGCCGTGCGCGTGGAGCAGGTGCAGAAGACCGGCGTGT

GGGTGCGCAACCACAACGGCATCGCCGACAACGCCACCATGGTGCGCGTG

GACGTGTTCGAGAAGGGCGACAAGTACTACCTGGTGCCCATCTACAGCTG

GCAGGTGGCCAAGGGCATCCTGCCCGACCGCGCCGTGGTGCAGGGCAAGG

ACGAGGAGGACTGGCAGCTGATCGACGACAGCTTCAACTTCAAGTTCAGC

CTGCACCCCAACGACCTGGTGGAGGTGATCACCAAGAAGGCCCGCATGTT

CGGCTACTTCGCCAGCTGCCACCGCGGCACCGGCAACATCAACATCCGCA

TCCACGACCTGGACCACAAGATCGGCAAGAACGGCATCCTGGAGGGCATC

GGCGTGAAGACCGCCCTGAGCTTCCAGAAGTACCAGATCGACGAGCTGGG

CAAGGAGATCCGCCCCTGCCGCCTGAAGAAGCGCCCTCCTGTGCGCTAA
```

Provided below is the corresponding amino acid sequence of a *N. meningitidis* Cas9 molecule.

```
                                         (SEQ ID NO: 25)
MAAFKPNPINYILGLDIGIASVGWAMVEIDEDENPICLIDLGVRVFERAE

VPKTGDSLAMARRLARSVRRLTRRRAHRLLRARRLLKREGVLQAADFDEN

GLIKSLPNTPWQLRAAALDRKLTPLEWSAVLLHLIKHRGYLSQRKNEGET

ADKELGALLKGVADNAHALQTGDFRTPAELALNKFEKESGHIRNQRGDYS

HTFSRKDLQAELILLFEKQKEFGNPHVSGGLKEGIETLLMTQRPALSGDA

VQKMLGHCTFEPAEPKAAKNTYTAERFIWLTKLNNLRILEQGSERPLTDT
```

-continued
ERATLMDEPYRKSKLTYAQARKLLGLEDTAFFKGLRYGKDNAEASTLMEM

KAYHAISRALEKEGLKDKKSPLNLSPELQDEIGTAFSLFKTDEDITGRLK

DRIQPEILEALLKHISFDKFVQISLKALRRIVPLMEQGKRYDEACAEIYG

DHYGKKNTEEKIYLPPIPADEIRNPVVLRALSQARKVINGVVRRYGSPAR

IHIETAREVGKSFKDRKEIEKRQEENRKDREKAAAKFREYFPNFVGEPKS

KDILKLRLYEQQHGKCLYSGKEINLGRLNEKGYVEIDHALPFSRTWDDSF

NNKVLVLGSENQNKGNQTPYEYFNGKDNSREWQEFKARVETSRFPRSKKQ

RILLQKFDEDGFKERNLNDTRYVNRFLCQFVADRMRLTGKGKKRVFASNG

QITNLLRGFWGLRKVRAENDRHHALDAVVVACSTVAMQQKITRFVRYKEM

NAFDGKTIDKETGEVLHQKTHFPQPWEFFAQEVMIRVFGKPDGKPEFEEA

DTPEKLRTLLAEKLSSRPEAVHEYVTPLFVSRAPNRKMSGQGHMETVKSA

KRLDEGVSVLRVPLTQLKLKDLEKMVNREREPKLYEALKARLEAHKDDPA

KAFAEPFYKYDKAGNRTQQVKAVRVEQVQKTGVWVRNHNGIADNATMVRV

DVFEKGDKYYLVPIYSWQVAKGILPDRAVVQGKDEEDWQLIDDSFNFKFS

LHPNDLVEVITKKARMFGYFASCHRGTGNINIRIHDLDHKIGKNGILEGI

GVKTALSFQKYQIDELGKEIRPCRLKKRPPVR*

Provided below is an amino acid sequence of a *S. aureus* Cas9 molecule.

(SEQ ID NO: 26)
MKRNYILGLDIGITSVGYGIIDYETRDVIDAGVRLFKEANVENNEGRRSK

RGARRLKRRRRHRIQRVKKLLFDYNLLTDHSELSGINPYEARVKGLSQKL

SEEEFSAALLHLAKRRGVHNVNEVEEDTGNELSTKEQISRNSKALEEKYV

AELQLERLKKDGEVRGSINRFKTSDYVKEAKQLLKVQKAYHQLDQSFIDT

YIDLLETRRTYYEGPGEGSPFGWKDIKEWYEMLMGHCTYFPEELRSVKYA

YNADLYNALNDLNNLVITRDENEKLEYYEKFQIIENVFKQKKKPTLKQIA

KEILVNEEDIKGYRVTSTGKPEFTNLKVYHDIKDITARKEIIENAELLDQ

IAKILTIYQSSEDIQEELTNLNSELTQEEIEQISNLKGYTGTHNLSLKAI

NLILDELWHTNDNQIAIFNRLKLVPKKVDLSQQKEIPTTLVDDFILSPVV

KRSFIQSIKVINAIIKKYGLPNDIIIELAREKNSKDAQKMINEMQKRNRQ

TNERIEEIIRTTGKENAKYLIEKIKLHDMQEGKCLYSLEAIPLEDLLNNP

FNYEVDHIIPRSVSFDNSFNNKVLVKQEENSKKGNRTPFQYLSSSDSKIS

YETFKKHILNLAKGKGRISKTKKEYLLEERDINRFSVQKDFINRNLVDTR

YATRGLMNLLRSYFRVNNLDVKVKSINGGFTSFLRRKWKFKKERNKGYKH

HAEDALIIANADFIFKEWKKLDKAKKVMENQMFEEKQAESMPEIETEQEY

KEIFITPHQIKHIKDFKDYKYSHRVDKKPNRELINDTLYSTRKDDKGNTL

IVNNLNGLYDKDNDKLKKLINKSPEKLLMYHHDPQTYQKLKLIMEQYGDE

KNPLYKYYEETGNYLTKYSKKDNGPVIKKIKYYGNKLNAHLDITDDYPNS

RNKVVKLSLKPYRFDVYLDNGVYKFVTVKNLDVIKKENYYEVNSKCYEEA

KKLKKISNQAEFIASFYNNDLIKINGELYRVIGVNNDLLNRIEVNMIDIT

YREYLENMNDKRPPRIIKTIASKTQSIKKYSTDILGNLYEVKSKKHPQII

KKG*

Provided below is an exemplary codon optimized nucleic acid sequence encoding a Cas9 molecule of *S. aureus* Cas9.

(SEQ ID NO: 39)
ATGAAAAGGAACTACATTCTGGGGCTGGACATCGGGATTACAAGCGTGGG

GTATGGGATTATTGACTATGAAACAAGGGACGTGATCGACGCAGGCGTCA

GACTGTTCAAGGAGGCCAACGTGGAAAACAATGAGGGACGGAGAAGCAAG

AGGGGAGCCAGGCGCCTGAAACGACGGAGAAGGCACAGAATCCAGAGGGT

GAAGAAACTGCTGTTCGATTACAACCTGCTGACCGACCATTCTGAGCTGA

GTGGAATTAATCCTTATGAAGCCAGGGTGAAAGGCCTGAGTCAGAAGCTG

TCAGAGGAAGAGTTTTCCGCAGCTCTGCTGCACCTGGCTAAGCGCCGAGG

AGTGCATAACGTCAATGAGGTGGAAGAGGACACCGGCAACGAGCTGTCTA

CAAAGGAACAGATCTCACGCAATAGCAAAGCTCTGGAAGAGAAGTATGTC

GCAGAGCTGCAGCTGGAACGGCTGAAGAAAGATGGCGAGGTGAGAGGGTC

AATTAATAGGTTCAAGACAAGCGACTACGTCAAAGAAGCCAAGCAGCTGC

TGAAAGTGCAGAAGGCTTACCACCAGCTGGATCAGAGCTTCATCGATACT

TATATCGACCTGCTGGAGACTCGGAGAACCTACTATGAGGGACCAGGAGA

AGGGGAGCCCCTTCGGATGGAAAGACATCAAGGAATGGTACGAGATGCTGA

TGGGACATTGCACCTATTTTCCAGAAGAGCTGAGAAGCGTCAAGTACGCT

TATAACGCAGATCTGTACAACGCCCTGAATGACCTGAACAACCTGGTCAT

CACCAGGGATGAAAACGAGAAACTGGAATACTATGAGAAGTTCCAGATCA

TCGAAAACGTGTTTAAGCAGAAGAAAAAGCCTACACTGAAACAGATTGCT

AAGGAGATCCTGGTCAACGAAGAGGACATCAAGGGCTACCGGGTGACAAG

CACTGGAAAACCAGAGTTCACCAATCTGAAAGTGTATCACGATATTAAGG

ACATCACAGCACGGAAAGAAATCATTGAGAACGCCGAACTGCTGGATCAG

ATTGCTAAGATCCTGACTATCTACCAGAGCTCCGAGGACATCCAGGAAGA

GCTGACTAACCTGAACAGCGAGCTGACCCAGGAAGAGATCGAACAGATTA

GTAATCTGAAGGGGTACACCGGAACACACAACCTGTCCCTGAAAGCTATC

AATCTGATTCTGGATGAGCTGTGGCATACAAACGACAATCAGATTGCAAT

CTTTAACCGGCTGAAGCTGGTCCCAAAAAAGGTGGACCTGAGTCAGCAGA

AAGAGATCCCAACCACACTGGTGGACGATTTCATTCTGTCACCCGTGGTC

AAGCGGAGCTTCATCCAGAGCATCAAAGTGATCAACGCCATCATCAAGAA

GTACGGCCTGCCCAATGATATCATTATCGAGCTGGCTAGGGAGAAGAACA

GCAAGGACGCACAGAAGATGATCAATGAGATGCAGAAACGAAACCGGCAG

ACCAATGAACGCATTGAAGAGATTATCCGAACTACCGGGAAAGAGAACGC

AAAGTACCTGATTGAAAAAATCAAGCTGCACGATATGCAGGAGGGAAAGT

GTCTGTATTCTCTGGAGGCCATCCCCCTGGAGGACCTGCTGAACAATCCA

TTCAACTACGAGGTCGATCATATTATCCCCAGAAGCGTGTCCTTCGACAA

TTCCTTTAACAACAAGGTGCTGGTCAAGCAGGAAGAGAACTCTAAAAAGG

GCAATAGGACTCCTTTCCAGTACCTGTCTAGTTCAGATTCCAAGATCTCT

TACGAAACCTTTAAAAAGCACATTCTGAATCTGGCCAAAGGAAAGGGCCG

CATCAGCAAGACCAAAAAGGAGTACCTGCTGGAAGAGCGGGACATCAACA

-continued

```
GATTCTCCGTCCAGAAGGATTTTATTAACCGGAATCTGGTGGACACAAGA

TACGCTACTCGCGGCCTGATGAATCTGCTGCGATCCTATTTCCGGGTGAA

CAATCTGGATGTGAAAGTCAAGTCCATCAACGGCGGGTTCACATCTTTTC

TGAGGCGCAAATGGAAGTTTAAAAAGGAGCGCAACAAAGGGTACAAGCAC

CATGCCGAAGATGCTCTGATTATCGCAAATGCCGACTTCATCTTTAAGGA

GTGGAAAAAGCTGGACAAAGCCAAGAAAGTGATGGAGAACCAGATGTTCG

AAGAGAAGCAGGCCGAATCTATGCCCGAAATCGAGACAGAACAGGAGTAC

AAGGAGATTTTCATCACTCCTCACCAGATCAAGCATATCAAGGATTTCAA

GGACTACAAGTACTCTCACCGGGTGGATAAAAAGCCCAACAGAGAGCTGA

TCAATGACACCCTGTATAGTACAAGAAAAGACGATAAGGGGAATACCCTG

ATTGTGAACAATCTGAACGGACTGTACGACAAAGATAATGACAAGCTGAA

AAAGCTGATCAACAAAAGTCCCGAGAAGCTGCTGATGTACCACCATGATC

CTCAGACATATCAGAAACTGAAGCTGATTATGGAGCAGTACGGCGACGAG

AAGAACCCACTGTATAAGTACTATGAAGAGACTGGGAACTACCTGACCAA

GTATAGCAAAAGGATAATGGCCCCGTGATCAAGAAGATCAAGTACTATG

GGAACAAGCTGAATGCCCATCTGGACATCACAGACGATTACCCTAACAGT

CGCAACAAGGTGGTCAAGCTGTCACTGAAGCCATACAGATTCGATGTCTA

TCTGGACAACGGCGTGTATAAATTTGTGACTGTCAAGAATCTGGATGTCA
```

-continued

```
TCAAAAAGGAGAACTACTATGAAGTGAATAGCAAGTGCTACGAAGAGGCT

AAAAAGCTGAAAAAGATTAGCAACCAGGCAGAGTTCATCGCCTCCTTTTA

CAACAACGACCTGATTAAGATCAATGGCGAACTGTATAGGGTCATCGGGG

TGAACAATGATCTGCTGAACCGCATTGAAGTGAATATGATTGACATCACT

TACCGAGAGTATCTGGAAAACATGAATGATAAGCGCCCCCCTCGAATTAT

CAAAACAATTGCCTCTAAGACTCAGAGTATCAAAAAGTACTCAACCGACA

TTCTGGGAAACCTGTATGAGGTGAAGAGCAAAAAGCACCCTCAGATTATC

AAAAAGGGC
```

If any of the above Cas9 sequences are fused with a peptide or polypeptide at the C-terminus, it is understood that the stop codon will be removed.

Other Cas Molecules and Cas Polypeptides

Various types of Cas molecules or Cas polypeptides can be used to practice the inventions disclosed herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) are described, e.g., in Haft et al., PLoS COMPUTATIONAL BIOLOGY 2005, 1(6): e60 and Makarova et al., NATURE REVIEW MICROBIOLOGY 2011, 9:467-477, the contents of both references are incorporated herein by reference in their entirety. Exemplary Cas molecules (and Cas systems) are also shown in Table 33.

TABLE 33

Cas Systems

| Gene name[‡] | System type or subtype | Name from Haft et al.[§] | Structure of encoded protein (PDB accessions)[¶] | Families (and superfamily) of encoded protein[#**] | Representatives |
|---|---|---|---|---|---|
| cas1 | Type I<br>Type II<br>Type III | cas1 | 3GOD, 3LFX and 2YZS | COG1518 | SERP2463, SPy1047 and ygbT |
| cas2 | Type I<br>Type II<br>Type III | cas2 | 2IVY, 2I8E and 3EXC | COG1343 and COG3512 | SERP2462, SPy1048, SPy1723 (N-terminal domain) and ygbF |
| cas3' | Type I[‡‡] | cas3 | NA | COG1203 | APE1232 and ygcB |
| cas3" | Subtype I-A<br>Subtype I-B | NA | NA | COG2254 | APEI231 and BH0336 |
| cas4 | Subtype I-A<br>Subtype I-B<br>Subtype I-C<br>Subtype I-D<br>Subtype II-B | cas4 and csa1 | NA | COG1468 | APE1239 and BH0340 |
| cas5 | Subtype I-A<br>Subtype I-B<br>Subtype I-C<br>Subtype I-E | cas5a, cas5d, cas5e, cas5h, cas5p, cas5t and cmx5 | 3KG4 | COG1688 (RAMP) | APE1234, BH0337, devS and ygcI |
| cas6 | Subtype I-A<br>Subtype I-B<br>Subtype I-D<br>Subtype III-A Subtype III-B | cas6 and cmx6 | 3I4H | COG1583 and COG5551 (RAMP) | PF1131 and slr7014 |
| cas6e | Subtype I-E | cse3 | 1WJ9 | (RAMP) | ygcH |
| cas6f | Subtype I-F | csy4 | 2XLJ | (RAMP) | y1727 |
| cas7 | Subtype I-A<br>Subtype I-B<br>Subtype I-C<br>Subtype I-E | csa2, csd2, cse4, csh2, csp1 and cst2 | NA | COG1857 and COG3649 (RAMP) | devR and ygcJ |
| cas8a1 | Subtype I-A[‡‡] | cmx1, cst1, csx8, csx13 and CXXC-CXXC | NA | BH0338-like | LA3191[§§] and PG2018[§§] |

TABLE 33-continued

Cas Systems

| Gene name‡ | System type or subtype | Name from Haft et al.§ | Structure of encoded protein (PDB accessions)¶ | Families (and superfamily) of encoded protein#** | Representatives |
|---|---|---|---|---|---|
| cas8a2 | Subtype I-A‡‡ | csa4 and csx9 | NA | PH0918 | AF0070, AF1873, MJ0385, PF0637, PH0918 and SSO1401 |
| cas8b | Subtype I-B‡‡ | csh1 and TM1802 | NA | BH0338-like | MTH1090 and TM1802 |
| cas8c | Subtype I-C‡‡ | csd1 and csp2 | NA | BH0338-like | BH0338 |
| cas9 | Type II‡‡ | csn1 and csx12 | NA | COG3513 | FTN_0757 and SPy1046 |
| cas10 | Type III‡‡ | cmr2, csm1 and csx11 | NA | COG1353 | MTH326, Rv2823c§§ and TM1794§§ |
| cas10d | Subtype I-D‡‡ | csc3 | NA | COG1353 | slr7011 |
| csy1 | Subtype I-F‡‡ | csy1 | NA | y1724-like | y1724 |
| csy2 | Subtype I-F | csy2 | NA | (RAMP) | y1725 |
| csy3 | Subtype I-F | csy3 | NA | (RAMP) | y1726 |
| cse1 | Subtype I-E‡‡ | cse1 | NA | YgcL-like | ygcL |
| cse2 | Subtype I-E | cse2 | 2ZCA | YgcK-like | ygcK |
| csc1 | Subtype I-D | csc1 | NA | alr1563-like (RAMP) | alr1563 |
| csc2 | Subtype I-D | csc1 and csc2 | NA | COG1337 (RAMP) | slr7012 |
| csa5 | Subtype I-A | csa5 | NA | AF1870 | AF1870, MJ0380, PF0643 and SSO1398 |
| csn2 | Subtype II-A | csn2 | NA | SPy1049-like | SPy1049 |
| csm2 | Subtype III-A‡‡ | csm2 | NA | COG1421 | MTH1081 and SERP2460 |
| csm3 | Subtype III-A | csc2 and csm3 | NA | COG1337 (RAMP) | MTH1080 and SERP2459 |
| csm4 | Subtype III-A | csm4 | NA | COG1567 (RAMP) | MTH1079 and SERP2458 |
| csm5 | Subtype III-A | csm5 | NA | COG1332 (RAMP) | MTH1078 and SERP2457 |
| csm6 | Subtype III-A | APE2256 and csm6 | 2WTE | COG1517 | APE2256 and SSO1445 |
| cmr1 | Subtype III-B | cmr1 | NA | COG1367 (RAMP) | PF1130 |
| cmr3 | Subtype III-B | cmr3 | NA | COG1769 (RAMP) | PF1128 |
| cmr4 | Subtype III-B | cmr4 | NA | COG1336 (RAMP) | PF1126 |
| cmr5 | Subtype III-B‡‡ | cmr5 | 2ZOP and 2OEB | COG3337 | MTH324 and PF1125 |
| cmr6 | Subtype III-B | cmr6 | NA | COG1604 (RAMP) | PF1124 |
| csb1 | Subtype I-U | GSU0053 | NA | (RAMP) | Balac_1306 and GSU0053 |
| csb2 | Subtype I-U§§ | NA | NA | (RAMP) | Balac_1305 and GSU0054 |
| csb3 | Subtype I-U | NA | NA | (RAMP) | Balac_1303§§ |
| csx17 | Subtype I-U | NA | NA | NA | Btus_2683 |
| csx14 | Subtype I-U | NA | NA | NA | GSU0052 |
| csx10 | Subtype I-U | csx10 | NA | (RAMP) | Caur_2274 |
| csx16 | Subtype III-U | VVA1548 | NA | NA | VVA1548 |
| csaX | Subtype III-U | csaX | NA | NA | SSO1438 |
| csx3 | Subtype III-U | csx3 | NA | NA | AF1864 |
| csx1 | Subtype III-U | csa3, csx1, csx2, DXTHG, NE0113 and TIGR02710 | 1XMX and 2I71 | COG1517 and COG4006 | MJ1666, NE0113, PF1127 and TM1812 |
| csx15 | Unknown | NA | NA | TTE2665 | TTE2665 |
| csf1 | Type U | csf1 | NA | NA | AFE_1038 |
| csf2 | Type U | csf2 | NA | (RAMP) | AFE_1039 |
| csf3 | Type U | csf3 | NA | (RAMP) | AFE_1040 |
| csf4 | Type U | csf4 | NA | NA | AFE_1037 |

IV. Functional Analysis of Candidate Molecules

Candidate Cas9 molecules, candidate gRNA molecules, candidate Cas9 molecule/gRNA molecule complexes, can be evaluated by art-known methods or as described herein. For example, exemplary methods for evaluating the endonuclease activity of Cas9 molecule are described, e.g., in Jinek et al., SCIENCE 2012, 337(6096):816-821.

Binding and Cleavage Assay: Testing the Endonuclease Activity of Cas9 Molecule

The ability of a Cas9 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM $MgCl_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [γ-32P]-ATP in 1× T4 polynucleotide kinase reaction buffer at 37° C. for 30 min, in a 50 μL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min, followed by slow cooling to room temperature. For cleavage assays, gRNA molecules are annealed by heating to 95° C. for 30 s, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 μl. Reactions are initiated by the addition of 1 μl target DNA (10 nM) and incubated for 1 h at 37° C. Reactions are quenched by the addition of 20 μl of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule or candidate Cas9 molecule.

Binding Assay: Testing the Binding of Cas9 Molecule to Target DNA

Exemplary methods for evaluating the binding of Cas9 molecule to target DNA are described, e.g., in Jinek et al., SCIENCE 2012; 337(6096):816-821.

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1×TBE. DNA bands are visualized by UV shadowing, excised, and eluted by soaking gel pieces in DEPC-treated $H_2O$. Eluted DNA is ethanol precipitated and dissolved in DEPC-treated $H_2O$. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column. Binding assays are performed in buffer containing 20 mM HEPES pH 7.5, 100 mM KCl, 5 mM $MgCl_2$, 1 mM DTT and 10% glycerol in a total volume of 10 μl. Cas9 protein molecule is programmed with equimolar amounts of pre-annealed gRNA molecule and titrated from 100 pM to 1 μM. Radiolabeled DNA is added to a final concentration of 20 pM. Samples are incubated for 1 h at 37° C. and resolved at 4° C. on an 8% native polyacrylamide gel containing 1×TBE and 5 mM $MgCl_2$. Gels are dried and DNA visualized by phosphorimaging.

Differential Scanning Flourimetry (DSF)

The thermostability of Cas9-gRNA ribonucleoprotein (RNP) complexes can be measured via DSF. This technique measures the thermostability of a protein, which can increase under favorable conditions such as the addition of a binding RNA molecule, e.g., a gRNA.

The assay is performed using two different protocols, one to test the best stoichiometric ratio of gRNA:Cas9 protein and another to determine the best solution conditions for RNP formation.

To determine the best solution to form RNP complexes, a 2 uM solution of Cas9 in water+10× SYPRO Orange® (Life Techonologies cat #S-6650) and dispensed into a 384 well plate. An equimolar amount of gRNA diluted in solutions with varied pH and salt is then added. After incubating at room temperature for 10' and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

The second assay consists of mixing various concentrations of gRNA with 2 uM Cas9 in optimal buffer from assay 1 above and incubating at RT for 10' in a 384 well plate. An equal volume of optimal buffer +10× SYPRO Orange® (Life Technologies cat #S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

V. Genome Editing Approaches

Mutations in the HBB gene may be corrected using one of the approaches discussed herein. In an embodiment, a mutation in the HBB gene is corrected by homology directed repair (HDR) using an exogenously provided template nucleic acid (see Section V.1). In another embodiment, a mutation in the HBB gene is corrected by homology directed repair without using an exogenously provided template nucleic acid (see Section V.1).

Also described herein are methods for targeted knockout of one or both alleles of the BCL11A gene using NHEJ (see Section V.2). In another embodiment, methods are provided for targeted knockdown of the BCL11A gene (see Section V.3).

V.1 HDR Repair and Template Nucleic Acids

As described herein, nuclease-induced homology directed repair (HDR) can be used to alter a target sequence and correct (e.g., repair or edit) a mutation in the genome. While not wishing to be bound by theory, it is believed that alteration of the target sequence occurs by homology-directed repair (HDR) with an exogenously provided donor template or template nucleic acid. For example, the donor template or the template nucleic acid provides for alteration of the target sequence. It is contemplated that a plasmid donor can be used as a template for homologous recombination. It is further contemplated that a single stranded donor template can be used as a template for alteration of the target sequence by alternate methods of homology directed repair (e.g., single strand annealing) between the target sequence and the donor template. Donor template-effected alteration of a target sequence depends on cleavage by a Cas9 molecule. Cleavage by Cas9 can comprise a double strand break or two single strand breaks. As described herein, nuclease-induced homology directed repair (HDR) can be used to alter a target sequence and correct (e.g., repair or edit) a mutation in the genome without the use of an exogenously provided donor template or template nucleic acid. While not wishing to be bound by theory, it is believed that alteration of the target sequence occurs by homology-directed repair (HDR) with endogenous genomic donor sequence. For example, the endogenous genomic donor sequence provides for alteration of the target sequence. It is contemplated that in an embodiment the endogenous genomic donor sequence is located on the same chromosome as the target sequence. It is further contemplated that in another embodiment the endogenous genomic donor sequence is located on a different chromosome from the target sequence. In an embodiment, the endogenous genomic donor sequence comprises one or more nucleotides derived from the HBD gene. Alteration of a target sequence by endogenous genomic donor sequence depends on cleavage by a Cas9 molecule. Cleavage by Cas9 can comprise a double strand break or two single strand breaks.

Mutations that can be corrected by HDR using a template nucleic acid, or using endogenous genomic donor sequence, include point mutations. In an embodiment, a point mutation can be corrected by either a single double-strand break or two single strand breaks. In an embodiment, a point mutation can be corrected by (1) a single double-strand break, (2) two single strand breaks, (3) two double stranded breaks with a break occurring on each side of the target position, (4) one double stranded break and two single strand breaks with the double strand break and two single strand breaks occurring on each side of the target position (5) four single stranded breaks with a pair of single stranded breaks occurring on each side of the target position, or (6) one single stranded break.

In an embodiment where a single-stranded template nucleic acid is used, the target position can be altered by alternative HDR.

Donor template-effected alteration of a target position depends on cleavage by a Cas9 molecule. Cleavage by Cas9 can comprise a nick, a double strand break, or two single strand breaks, e.g., one on each strand of the target nucleic acid. After introduction of the breaks on the target nucleic acid, resection occurs at the break ends resulting in single stranded overhanging DNA regions.

In canonical HDR, a double-stranded donor template is introduced, comprising homologous sequence to the target nucleic acid that will either be directly incorporated into the target nucleic acid or used as a template to correct the sequence of the target nucleic acid. After resection at the break, repair can progress by different pathways, e.g., by the double Holliday junction model (or double strand break repair, DSBR, pathway) or the synthesis-dependent strand annealing (SDSA) pathway. In the double Holliday junction model, strand invasion by the two single stranded overhangs of the target nucleic acid to the homologous sequences in the donor template occurs, resulting in the formation of an intermediate with two Holliday junctions. The junctions migrate as new DNA is synthesized from the ends of the invading strand to fill the gap resulting from the resection. The end of the newly synthesized DNA is ligated to the resected end, and the junctions are resolved, resulting in the correction of the target nucleic acid, e.g., incorporation of the correct sequence of the donor template at the corresponding target position. Crossover with the donor template may occur upon resolution of the junctions. In the SDSA pathway, only one single stranded overhang invades the donor template and new DNA is synthesized from the end of the invading strand to fill the gap resulting from resection. The newly synthesized DNA then anneals to the remaining single stranded overhang, new DNA is synthesized to fill in the gap, and the strands are ligated to produce the corrected DNA duplex.

In alternative HDR, a single strand donor template, e.g., template nucleic acid, is introduced. A nick, single strand break, or double strand break at the target nucleic acid, for altering a desired target position, is mediated by a Cas9 molecule, e.g., described herein, and resection at the break occurs to reveal single stranded overhangs. Incorporation of the sequence of the template nucleic acid to correct or alter the target position of the target nucleic acid typically occurs by the SDSA pathway, as described above.

Methods of promoting HDR pathways, e.g., canonical HDR or alt-HDR, are described herein in Section VI.

Additional details on template nucleic acids are provided in Section IV entitled "Template nucleic acids" in International Application PCT/US2014/057905.

Mutations in the HBB gene that can be corrected (e.g., altered) by HDR with a template nucleic acid or with endogenous genomic donor sequence include, e.g., point mutation at E6, e.g., E6V.

Double Strand Break Mediated Correction

In an embodiment, double strand cleavage is effected by a Cas9 molecule having cleavage activity associated with an HNH-like domain and cleavage activity associated with a RuvC-like domain, e.g., an N-terminal RuvC-like domain, e.g., a wild type Cas9. Such embodiments require only a single gRNA.

Single Strand Break Mediated Correction

In some embodiments, one single strand break, or nick, is effected by a Cas9 molecule having nickase activity, e.g., a Cas9 nickase as described herein. A nicked target nucleic acid can be a substrate for alt-HDR.

In other embodiments, two single strand breaks, or nicks, are effected by a Cas9 molecule having nickase activity, e.g., cleavage activity associated with an HNH-like domain or cleavage activity associated with an N-terminal RuvC-like domain. Such embodiments usually require two gRNAs, one for placement of each single strand break. In an embodiment, the Cas9 molecule having nickase activity cleaves the strand to which the gRNA hybridizes, but not the strand that is complementary to the strand to which the gRNA hybridizes. In an embodiment, the Cas9 molecule having nickase activity does not cleave the strand to which the gRNA hybridizes, but rather cleaves the strand that is complementary to the strand to which the gRNA hybridizes.

In an embodiment, the nickase has HNH activity, e.g., a Cas9 molecule having the RuvC activity inactivated, e.g., a Cas9 molecule having a mutation at D10, e.g., the D10A mutation. D10A inactivates RuvC; therefore, the Cas9 nickase has (only) HNH activity and will cut on the strand to which the gRNA hybridizes (e.g., the complementary strand, which does not have the NGG PAM on it). In other embodiments, a Cas9 molecule having an H840, e.g., an H840A, mutation can be used as a nickase. H840A inactivates HNH; therefore, the Cas9 nickase has (only) RuvC activity and cuts on the non-complementary strand (e.g., the strand that has the NGG PAM and whose sequence is identical to the gRNA). In other embodiments, a Cas9 molecule having an N863 mutation, e.g., the N863A mutation, mutation can be used as a nickase. N863A inactivates HNH therefore the Cas9 nickase has (only) RuvC activity and cuts on the non-complementary strand (the strand that has the NGG PAM and whose sequence is identical to the gRNA).

In an embodiment, in which a nickase and two gRNAs are used to position two single strand nicks, one nick is on the +strand and one nick is on the −strand of the target nucleic acid. The PAMs can be outwardly facing. The gRNAs can be selected such that the gRNAs are separated by, from about 0-50, 0-100, or 0-200 nucleotides. In an embodiment, there is no overlap between the target sequences that are complementary to the targeting domains of the two gRNAs. In an embodiment, the gRNAs do not overlap and are separated by as much as 50, 100, or 200 nucleotides. In an embodiment, the use of two gRNAs can increase specificity, e.g., by decreasing off-target binding (Ran et al., Cell 2013; 154(6): 1380-1389).

In an embodiment, a single nick can be used to induce HDR, e.g., alt-HDR. It is contemplated herein that a single nick can be used to increase the ratio of HR to NHEJ at a given cleavage site. In an embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

Placement of Double Strand or Single Strand Breaks Relative to the Target Position The double strand break or single strand break in one of the strands should be sufficiently close to target position such that an alteration is produced in the desired region, e.g., correction of a mutation occurs. In an embodiment, the distance is not more than 50, 100, 200, 300, 350 or 400 nucleotides. While not wishing to be bound by theory, in some embodiments, it is believed that the break should be sufficiently close to target position such that the target position is within the region that is subject to exonuclease-mediated removal during end resection. If the distance between the target position and a break is too great, the mutation or other sequence desired to be altered may not be included in the end resection and, therefore, may not be corrected, as donor sequence, either exogenously provided donor sequence or endogenous genomic donor sequence, in some embodiments is only used to correct sequence within the end resection region.

In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150 or 200 nucleotides of the region desired to be altered, e.g., a mutation. The break, e.g., a double strand or single strand break, can be positioned upstream or downstream of the region desired to be altered, e.g., a mutation. In some embodiments, a break is positioned within the region desired to be altered, e.g., within a region defined by at least two mutant nucleotides. In some embodiments, a break is positioned immediately adjacent to the region desired to be altered, e.g., immediately upstream or downstream of a mutation. In an embodiment, a single strand break is accompanied by an additional single strand break, positioned by a second gRNA molecule, as discussed below. For example, the targeting domains bind configured such that a cleavage event, e.g., the two single strand breaks, are positioned within 1, 2, 3, 4, 5, 10, 15, 20, 25, 30, 35, 40, 45, 50, 60, 70, 80, 90, 100, 150 or 200 nucleotides of a target position. In an embodiment, the first and second gRNA molecules are configured such, that when guiding a Cas9 nickase, a single strand break will be accompanied by an additional single strand break, positioned by a second gRNA, sufficiently close to one another to result in alteration of the desired region. In an embodiment, the first and second gRNA molecules are configured such that a single strand break positioned by said second gRNA is within 10, 20, 30, 40, or 50 nucleotides of the break positioned by said first gRNA molecule, e.g., when the Cas9 is a nickase. In an embodiment, the two gRNA molecules are configured to position cuts at the same position, or within a few nucleotides of one another, on different strands, e.g., essentially mimicking a double strand break.

In an embodiment, in which a gRNA (unimolecular (or chimeric) or modular gRNA) and Cas9 nuclease induce a double strand break for the purpose of inducing HDR-mediated correction, the cleavage site is between 0-200 bp (e.g., 0-175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position. In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In embodiments, one can promote HDR by using nickases to generate a break with overhangs. While not wishing to be bound by theory, the single stranded nature of the overhangs can enhance the cell's likelihood of repairing the break by HDR as opposed to, e.g., NHEJ. Specifically, in some embodiments, HDR is promoted by selecting a first gRNA that targets a first nickase to a first target sequence, and a second gRNA that targets a second nickase to a second target sequence which is on the opposite DNA strand from the first target sequence and offset from the first nick.

In an embodiment, the targeting domain of a gRNA molecule is configured to position a cleavage event sufficiently far from a preselected nucleotide, e.g., the nucleotide of a coding region, such that the nucleotide is not altered. In an embodiment, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

Placement of a First Break and a Second Break Relative to Each Other

In an embodiment, a double strand break can be accompanied by an additional double strand break, positioned by a second gRNA molecule, as is discussed below.

In an embodiment, a double strand break can be accompanied by two additional single strand breaks, positioned by a second gRNA molecule and a third gRNA molecule.

In an embodiment, a first and second single strand breaks can be accompanied by two additional single strand breaks positioned by a third gRNA molecule and a fourth gRNA molecule.

When two or more gRNAs are used to position two or more cleavage events, e.g., double strand or single strand breaks, in a target nucleic acid, it is contemplated that the two or more cleavage events may be made by the same or different Cas9 proteins. For example, when two gRNAs are used to position two double stranded breaks, a single Cas9 nuclease may be used to create both double stranded breaks. When two or more gRNAs are used to position two or more single stranded breaks (nicks), a single Cas9 nickase may be used to create the two or more nicks. When two or more gRNAs are used to position at least one double stranded break and at least one single stranded break, two Cas9 proteins may be used, e.g., one Cas9 nuclease and one Cas9 nickase. It is contemplated that when two or more Cas9 proteins are used that the two or more Cas9 proteins may be delivered sequentially to control specificity of a double stranded versus a single stranded break at the desired position in the target nucleic acid.

In some embodiments, the targeting domain of the first gRNA molecule and the targeting domain of the second gRNA molecules are complementary to opposite strands of the target nucleic acid molecule. In some embodiments, the gRNA molecule and the second gRNA molecule are configured such that the PAMs are oriented outward.

In certain embodiments, two gRNA are selected to direct Cas9-mediated cleavage at two positions that are a preselected distance from each other. In embodiments, the two points of cleavage are on opposite strands of the target nucleic acid. In some embodiments, the two cleavage points form a blunt ended break, and in other embodiments, they are offset so that the DNA ends comprise one or two overhangs (e.g., one or more 5' overhangs and/or one or more 3' overhangs). In some embodiments, each cleavage event is a nick. In embodiments, the nicks are close enough together that they form a break that is recognized by the double stranded break machinery (as opposed to being recognized by, e.g., the SSBr machinery). In embodiments, the nicks are far enough apart that they create an overhang that is a substrate for HDR, i.e., the placement of the breaks mimics a DNA substrate that has experienced some resection. For instance, in some embodiments the nicks are spaced to create an overhang that is a substrate for processive resection. In some embodiments, the two breaks are spaced within 25-65 nucleotides of each other. The two breaks may be, e.g., about 25, 30, 35, 40, 45, 50, 55, 60 or 65 nucleotides of each other. The two breaks may be, e.g., at least about 25, 30, 35, 40, 45, 50, 55, 60 or 65 nucleotides of each other. The two breaks may be, e.g., at most about 30, 35, 40, 45, 50, 55, 60 or 65 nucleotides of each other. In embodiments, the two breaks are about 25-30, 30-35, 35-40. 40-45, 45-50, 50-55, 55-60, or 60-65 nucleotides of each other.

In some embodiments, the break that mimics a resected break comprises a 3' overhang (e.g., generated by a DSB and a nick, where the nick leaves a 3' overhang), a 5' overhang (e.g., generated by a DSB and a nick, where the nick leaves a 5' overhang), a 3' and a 5' overhang (e.g., generated by three cuts), two 3' overhangs (e.g., generated by two nicks that are offset from each other), or two 5' overhangs (e.g., generated by two nicks that are offset from each other).

In an embodiment, in which two gRNAs (independently, unimolecular (or chimeric) or modular gRNA) complexing with Cas9 nickases induce two single strand breaks for the purpose of inducing HDR-mediated correction, the closer nick is between 0-200 bp (e.g., 0-175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position and the two nicks will ideally be within 25-65 bp of each other (e.g., 25 to 50, 25 to 45, 25 to 40, 25 to 35, 25 to 30, 30 to 55, 30 to 50, 30 to 45, 30 to 40, 30 to 35, 35 to 55, 35 to 50, 35 to 45, 35 to 40, 40 to 55, 40 to 50, 40 to 45 bp, 45 to 50 bp, 50 to 55 bp, 55 to 60 bp, 60 to 65 bp) and no more than 100 bp away from each other (e.g., no more than 90, 80, 70, 60, 50, 40, 30, 20, 10 or 5 bp away from each other). In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a cas9 nuclease) and two single strand breaks or paired single stranded breaks (i.e., two gRNAs complex with Cas9 nickases) on either side of the target position. In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are, in embodiments, within 25-65 bp of each other (e.g., between 25 to 55, 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, 40 to 45 bp, 45 to 50 bp, 50 to 55 bp, 55 to 60 bp, or 60 to 65 bp) and no more than 100 bp away from each other (e.g., no more than 90, 80, 70, 60, 50, 40, 30, 20 or 10 bp).

When two gRNAs are used to target Cas9 molecules to breaks, different combinations of Cas9 molecules are envisioned. In some embodiments, a first gRNA is used to target a first Cas9 molecule to a first target position, and a second gRNA is used to target a second Cas9 molecule to a second target position. In some embodiments, the first Cas9 molecule creates a nick on the first strand of the target nucleic acid, and the second Cas9 molecule creates a nick on the opposite strand, resulting in a double stranded break (e.g., a blunt ended cut or a cut with overhangs).

Different combinations of nickases can be chosen to target one single stranded break to one strand and a second single stranded break to the opposite strand. When choosing a combination, one can take into account that there are nickases having one active RuvC-like domain, and nickases having one active HNH domain. In an embodiment, a RuvC-like domain cleaves the non-complementary strand of the target nucleic acid molecule. In an embodiment, an HNH-like domain cleaves a single stranded complementary domain, e.g., a complementary strand of a double stranded nucleic acid molecule. Generally, if both Cas9 molecules have the same active domain (e.g., both have an active RuvC domain or both have an active HNH domain), one will choose two gRNAs that bind to opposite strands of the target. In more detail, in some embodiments, a first gRNA is complementary with a first strand of the target nucleic acid and binds a nickase having an active RuvC-like domain and causes that nickase to cleave the strand that is non-complementary to that first gRNA, i.e., a second strand of the target nucleic acid; and a second gRNA is complementary with a second strand of the target nucleic acid and binds a nickase having an active RuvC-like domain and causes that nickase to cleave the strand that is non-complementary to that second gRNA, i.e., the first strand of the target nucleic acid. Conversely, in some embodiments, a first gRNA is complementary with a first strand of the target nucleic acid and binds a nickase having an active HNH domain and causes that nickase to cleave the strand that is complementary to that first gRNA, i.e., a first strand of the target nucleic acid; and a second gRNA is complementary with a second strand of the target nucleic acid and binds a nickase having an active HNH domain and causes that nickase to cleave the strand that is complementary to that second gRNA, i.e., the second strand of the target nucleic acid. In another arrangement, if one Cas9 molecule has an active RuvC-like domain and the other Cas9 molecule has an active HNH domain, the gRNAs for both Cas9 molecules can be complementary to the same strand of the target nucleic acid, so that the Cas9 molecule with the active RuvC-like domain will cleave the non-complementary strand and the Cas9 molecule with the HNH domain will cleave the complementary strand, resulting in a double stranded break.

Length of the Homology Arms of the Donor Template

The homology arm should extend at least as far as the region in which end resection may occur, e.g., in order to allow the resected single stranded overhang to find a complementary region within the donor template. The overall length could be limited by parameters such as plasmid size or viral packaging limits. In an embodiment, a homology arm does not extend into repeated elements, e.g., Alu repeats or LINE repeats.

Exemplary homology arm lengths include at least 50, 100, 250, 500, 750, 1000, 2000, 3000, 4000, or 5000 nucleotides. In some embodiments, the homology arm length is 50-100, 100-250, 250-500, 500-750, 750-1000, 1000-2000, 2000-3000, 3000-4000, or 4000-5000 nucleotides.

Target position, as used herein, refers to a site on a target nucleic acid (e.g., the chromosome) that is modified by a Cas9 molecule-dependent process. For example, the target position can be a modified Cas9 molecule cleavage of the target nucleic acid and template nucleic acid directed modification, e.g., correction, of the target position. In an embodiment, a target position can be a site between two nucleotides, e.g., adjacent nucleotides, on the target nucleic acid into which one or more nucleotides is added. The target position may comprise one or more nucleotides that are altered, e.g., corrected, by a template nucleic acid. In an embodiment, the target position is within a target sequence (e.g., the sequence to which the gRNA binds). In an embodiment, a target position is upstream or downstream of a target sequence (e.g., the sequence to which the gRNA binds).

A template nucleic acid, as that term is used herein, refers to a nucleic acid sequence which can be used in conjunction with a Cas9 molecule and a gRNA molecule to alter the structure of a target position. In an embodiment, the target nucleic acid is modified to have the some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA. In an embodiment, the template nucleic acid is encoded on the same vector backbone, e.g. AAV genome, plasmid DNA, as the Cas9 and gRNA. In an embodiment, the template nucleic acid is excised from a vector backbone in vivo, e.g., it is flanked by gRNA recognition sequences. In an embodiment, the template nucleic acid comprises endogenous genomic sequence In an embodiment, the template nucleic acid alters the structure of the target position by participating in a homology directed repair event. In an embodiment, the template nucleic acid alters the sequence of the target position. In an embodiment, the template nucleic acid results in the incorporation of a modified, or non-naturally occurring base into the target nucleic acid.

Typically, the template sequence undergoes a breakage mediated or catalyzed recombination with the target sequence. In an embodiment, the template nucleic acid includes sequence that corresponds to a site on the target sequence that is cleaved by an eaCas9 mediated cleavage event. In an embodiment, the template nucleic acid includes sequence that corresponds to both, a first site on the target sequence that is cleaved in a first Cas9 mediated event, and a second site on the target sequence that is cleaved in a second Cas9 mediated event.

In an embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation.

In other embodiments, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in the HBB gene can be used to alter the structure of a target sequence. The template sequence can be used to alter an unwanted structure, e.g., an unwanted or mutant nucleotide.

A template nucleic acid typically comprises the following components:

[5' homology arm]-[replacement sequence]-[3' homology arm].

The homology arms provide for recombination into the chromosome, thus replacing the undesired element, e.g., a mutation or signature, with the replacement sequence. In an embodiment, the homology arms flank the most distal cleavage sites.

In an embodiment, the 3' end of the 5' homology arm is the position next to the 5' end of the replacement sequence. In an embodiment, the 5' homology arm can extend at least 10, 20, 30, 40, 50, 100, 200, 300, 400, 500, 600, 700, 800, 900, 1000, 1500, 2000, 3000, 4000, or 5000 nucleotides 5' from the 5' end of the replacement sequence.

In an embodiment, the 5' end of the 3' homology arm is the position next to the 3' end of the replacement sequence. In an embodiment, the 3' homology arm can extend at least 10, 20, 30, 40, 50, 100, 200, 300, 400, 500, 600, 700, 800, 900, 1000, 1500, 2000, 3000, 4000, or 5000 nucleotides 3' from the 3' end of the replacement sequence.

In an embodiment, to correct a mutation, the homology arms, e.g., the 5' and 3' homology arms, may each comprise about 1000 base pairs (bp) of sequence flanking the most distal gRNAs (e.g., 1000 bp of sequence on either side of the mutation).

It is contemplated herein that one or both homology arms may be shortened to avoid including certain sequence repeat elements, e.g., Alu repeats or LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

It is contemplated herein that template nucleic acids for correcting a mutation may be designed for use as a single-stranded oligonucleotide, e.g., a single-stranded oligodeoxynucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made. In some embodiments, a longer homology arm is made by a method other than chemical synthesis, e.g., by denaturing a long double stranded nucleic acid and purifying one of the strands, e.g., by affinity for a strand-specific sequence anchored to a solid substrate.

While not wishing to be bound by theory, in some embodiments alt-HDR proceeds more efficiently when the template nucleic acid has extended homology 5' to the nick (i.e., in the 5' direction of the nicked strand). Accordingly, in some embodiments, the template nucleic acid has a longer homology arm and a shorter homology arm, wherein the longer homology arm can anneal 5' of the nick. In some embodiments, the arm that can anneal 5' to the nick is at least 25, 50, 75, 100, 125, 150, 175, or 200, 300, 400, 500, 600, 700, 800, 900, 1000, 1500, 2000, 3000, 4000, or 5000 nucleotides from the nick or the 5' or 3' end of the replacement sequence. In some embodiments, the arm that can anneal 5' to the nick is at least 10%, 20%, 30%, 40%, or 50% longer than the arm that can anneal 3' to the nick. In some embodiments, the arm that can anneal 5' to the nick is at least 2×, 3×, 4×, or 5× longer than the arm that can anneal 3' to the nick. Depending on whether a ssDNA template can anneal to the intact strand or the nicked strand, the homology arm that anneals 5' to the nick may be at the 5' end of the ssDNA template or the 3' end of the ssDNA template, respectively.

Similarly, in some embodiments, the template nucleic acid has a 5' homology arm, a replacement sequence, and a 3' homology arm, such that the template nucleic acid has extended homology to the 5' of the nick. For example, the 5' homology arm and 3' homology arm may be substantially the same length, but the replacement sequence may extend farther 5' of the nick than 3' of the nick. In some embodiments, the replacement sequence extends at least 10%, 20%, 30%, 40%, 50%, 2×, 3×, 4×, or 5× further to the 5' end of the nick than the 3' end of the nick. While not wishing to be bound by theory, in some embodiments alt-HDR proceeds more efficiently when the template nucleic acid is centered on the nick. Accordingly, in some embodiments, the template nucleic acid has two homology arms that are essentially the same size. For instance, the first homology arm of a template nucleic acid may have a length that is within 10%, 9%, 8%, 7%, 6%, 5%, 4%, 3%, 2%, or 1% of the second homology arm of the template nucleic acid.

Similarly, in some embodiments, the template nucleic acid has a 5' homology arm, a replacement sequence, and a 3' homology arm, such that the template nucleic acid extends substantially the same distance on either side of the nick. For example, the homology arms may have different lengths, but the replacement sequence may be selected to compensate for this. For example, the replacement sequence may extend further 5' from the nick than it does 3' of the nick, but the homology arm 5' of the nick is shorter than the homology arm 3' of the nick, to compensate. The converse is also possible, e.g., that the replacement sequence may extend further 3' from the nick than it does 5' of the nick, but the homology arm 3' of the nick is shorter than the homology arm 5' of the nick, to compensate.

Exemplary Arrangements of Linear Nucleic Acid Template Systems

In an embodiment, the nucleic acid template system is double stranded. In an embodiment, the nucleic acid template system is single stranded. In an embodiment, the nucleic acid template system comprises a single stranded portion and a double stranded portion. In an embodiment, the template nucleic acid comprises about 50 to 100, e.g., 55 to 95, 60 to 90, 65 to 85, or 70 to 80, base pairs, homology on either side of the nick and/or replacement sequence. In an embodiment, the template nucleic acid comprises about 50, 55, 60, 65, 70, 75, 80, 85, 90, 95, or 100 base pairs homology 5' of the nick or replacement sequence, 3' of the nick or replacement sequence, or both 5' and 3' of the nick or replacement sequences.

In an embodiment, the template nucleic acid comprises about 150 to 200, e.g., 155 to 195, 160 to 190, 165 to 185, or 170 to 180, base pairs homology 3' of the nick and/or replacement sequence. In an embodiment, the template nucleic acid comprises about 150, 155, 160, 165, 170, 175, 180, 185, 190, 195, or 200 base pairs homology 3' of the nick or replacement sequence. In an embodiment, the template nucleic acid comprises less than about 100, 90, 80, 70, 60, 50, 40, 30, 20, 15, or 10 base pairs homology 5' of the nick or replacement sequence.

In an embodiment, the template nucleic acid comprises about 150 to 200, e.g., 155 to 195, 160 to 190, 165 to 185, or 170 to 180, base pairs homology 5' of the nick and/or replacement sequence. In an embodiment, the template nucleic acid comprises about 150, 155, 160, 165, 170, 175, 180, 185, 190, 195, or 200 base pairs homology 5' of the nick or replacement sequence. In an embodiment, the template nucleic acid comprises less than about 100, 90, 80, 70, 60, 50, 40, 30, 20, 15, or 10 base pairs homology 3' of the nick or replacement sequence.

Exemplary Template Nucleic Acids

In an embodiment, the template nucleic acid is a single stranded nucleic acid. In another embodiment, the template nucleic acid is a double stranded nucleic acid. In some embodiments, the template nucleic acid comprises a nucleotide sequence, e.g., of one or more nucleotides, that will be added to or will template a change in the target nucleic acid. In other embodiments, the template nucleic acid comprises a nucleotide sequence that may be used to modify the target position. In other embodiments, the template nucleic acid comprises a nucleotide sequence, e.g., of one or more nucleotides, that corresponds to wild type sequence of the target nucleic acid, e.g., of the target position.

The template nucleic acid may comprise a replacement sequence. In some embodiments, the template nucleic acid comprises a 5' homology arm. In other embodiments, the template nucleic acid comprises a 3' homology arm.

In embodiments, the template nucleic acid is linear double stranded DNA. The length may be, e.g., about 150-200 base pairs, e.g., about 150, 160, 170, 180, 190, or 200 base pairs. The length may be, e.g., at least 150, 160, 170, 180, 190, or 200 base pairs. In some embodiments, the length is no greater than 150, 160, 170, 180, 190, or 200 base pairs. In some embodiments, a double stranded template nucleic acid has a length of about 160 base pairs, e.g., about 155-165, 150-170, 140-180, 130-190, 120-200, 110-210, 100-220, 90-230, or 80-240 base pairs.

The template nucleic acid can be linear single stranded DNA. In embodiments, the template nucleic acid is (i) linear single stranded DNA that can anneal to the nicked strand of the target nucleic acid, (ii) linear single stranded DNA that can anneal to the intact strand of the target nucleic acid, (iii) linear single stranded DNA that can anneal to the transcribed strand of the target nucleic acid, (iv) linear single stranded DNA that can anneal to the non-transcribed strand of the target nucleic acid, or more than one of the preceding. The length may be, e.g., about 150-200 nucleotides, e.g., about 150, 160, 170, 180, 190, or 200 nucleotides. The length may be, e.g., at least 150, 160, 170, 180, 190, or 200 nucleotides. In some embodiments, the length is no greater than 150, 160, 170, 180, 190, or 200 nucleotides. In some embodiments, a single stranded template nucleic acid has a length of about 160 nucleotides, e.g., about 155-165, 150-170, 140-180, 130-190, 120-200, 110-210, 100-220, 90-230, or 80-240 nucleotides.

In some embodiments, the template nucleic acid is circular double stranded DNA, e.g., a plasmid. In some embodiments, the template nucleic acid comprises about 500 to 1000 base pairs of homology on either side of the replacement sequence and/or the nick. In some embodiments, the template nucleic acid comprises about 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In some embodiments, the template nucleic acid comprises at least 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In some embodiments, the template nucleic acid comprises no more than 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence.

In some embodiments, the template nucleic acid is an adenovirus vector, e.g., an AAV vector, e.g., a ssDNA molecule of a length and sequence that allows it to be packaged in an AAV capsid. The vector may be, e.g., less than 5 kb and may contain an ITR sequence that promotes packaging into the capsid. The vector may be integration-deficient; In some embodiments, the template nucleic acid comprises about 150 to 1000 nucleotides of homology on either side of the replacement sequence and/or the nick. In some embodiments, the template nucleic acid comprises about 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In some embodiments, the template nucleic acid comprises at least 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In some embodiments, the template nucleic acid comprises at most 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence.

In some embodiments, the template nucleic acid is a lentiviral vector, e.g., an IDLV (integration deficiency lentivirus). In some embodiments, the template nucleic acid comprises about 500 to 1000 base pairs of homology on either side of the replacement sequence and/or the nick. In some embodiments, the template nucleic acid comprises about 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In some embodiments, the template nucleic acid comprises at least 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In some embodiments, the template nucleic acid comprises no more than 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence.

In many embodiments, the template nucleic acid comprises one or more mutations, e.g., silent mutations, that prevent Cas9 from recognizing and cleaving the template nucleic acid. The template nucleic acid may comprise, e.g., at least 1, 2, 3, 4, 5, 10, 20, or 30 silent mutations relative to the corresponding sequence in the genome of the cell to be altered. In embodiments, the template nucleic acid comprises at most 2, 3, 4, 5, 10, 20, 30, or 50 silent mutations relative to the corresponding sequence in the genome of the cell to be altered.

In an embodiment, the template nucleic acid alters the structure of the target position by participating in a homology directed repair event. In an embodiment, the template nucleic acid alters the sequence of the target position. In an embodiment, the template nucleic acid results in the incorporation of a modified, or non-naturally occurring base into the target nucleic acid.

Typically, the template sequence undergoes a breakage mediated or catalyzed recombination with the target sequence. In an embodiment, the template nucleic acid includes sequence that corresponds to a site on the target sequence that is cleaved by an eaCas9 mediated cleavage event. In an embodiment, the template nucleic acid includes sequence that corresponds to both, a first site on the target sequence that is cleaved in a first Cas9 mediated event, and a second site on the target sequence that is cleaved in a second Cas9 mediated event.

In an embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation.

In other embodiments, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position can be used to alter the structure of a target sequence. The template sequence can be used to alter an unwanted structure, e.g., an unwanted or mutant nucleotide.

Exemplary template nucleic acids (also referred to herein as donor constructs) to correction a mutation, e.g., at E6, e.g., E6V, in the HBB gene, are provided.

Suitable sequence for the 5' homology arm can be selected from (e.g., includes a portion of) or include the following sequence:

```
                               SEQ ID NO: 16257
ATAGGAACTTGAATCAAGGAAATGATTTTAAAACGCAGTATTCTTAGTGG
ACTAGAGGAAAAAAATAATCTGAGCCAAGTAGAAGACCTTTTCCCCTCCT
ACCCCTACTTTCTAAGTCACAGAGGCTTTTTGTTCCCCCAGACACTCTTG
CAGATTAGTCCAGGCAGAAACAGTTAGATGTCCCCAGTTAACCTCCTATT
TGACACCACTGATTACCCCATTGATAGTCACACTTTGGGTTGTAAGTGAC
TTTTTATTTATTTGTATTTTTGACTGCATTAAGAGGTCTCTAGTTTTTTA
TCTCTTGTTTCCCAAAACCTAATAAGTAACTAATGCACAGAGCACATTGA
TTTGTATTTATTCTATTTTTAGACATAATTTATTAGCATGCATGAGCAAA
TTAAGAAAAACAACAACAAATGAATGCATATATATGTATATGTATGTGTG
TATATATACACACATATATATATATATTTTTTCTTTTCTTACCAGAAGGT
TTTAATCCAAATAAGGAGAAGATATGCTTAGAACCGAGGTAGAGTTTTCA
TCCATTCTGTCCTGTAAGTATTTTGCATATTCTGGAGACGCAGGAAGAGA
TCCATCTACATATCCCAAAGCTGAATTATGGTAGACAAAACTCTTCCACT
TTTAGTGCATCAACTTCTTATTTGTGTAATAAGAAAATTGGGAAAACGAT
CTTCAATATGCTTACCAAGCTGTGATTCCAAATATTACGTAAATACACTT
GCAAAGGAGGATGTTTTTAGTAGCAATTTGTACTGATGGTATGGGCCAA
GAGATATATCTTAGAGGGAGGGCTGAGGGTTTGAAGTCCAACTCCTAAGC
CAGTGCCAGAAGAGCCAAGGACAGGTACGGCTGTCATCACTTAGACCTCA
CCCTGTGGAGCCACACCCTAGGGTTGGCCAATCTACTCCCAGGAGCAGGG
AGGGCAGGAGCCAGGGCTGGGCATAAAAGTCAGGGCAGAGCCATCTATTG
CTTACATTTGCTTCTGACACAACTGTGTTCACTAGCAACCTCAAACAGAC
ACCATGGTGCATCTGACTCCTG (5'H arm)
```

Suitable sequence for the 3' homology arm can be selected from (e.g., includes a portion of) or include the following sequence:

```
                               SEQ ID NO: 16258
GGAGAAGTCTGCCGTTACTGCCCTGTGGGGCAAGGTGAACGTGGATGAAG
TTGGTGGTGAGGCCCTGGGCAGGTTGGTATCAAGGTTACAAGACAGGTTT
AAGGAGACCAATAGAAACTGGGCATGTGGAGACAGAGAAGACTCTTGGGT
TTCTGATAGGCACTGACTCTCTCTGCCTATTGGTCTATTTTCCCACCCTT
AGGCTGCTGGTGGTCTACCCTTGGACCCAGAGGTTCTTTGAGTCCTTTGG
GGATCTGTCCACTCCTGATGCTGTTATGGGCAACCCTAAGGTGAAGGCTC
ATGGCAAGAAAGTGCTCGGTGCCTTTAGTGATGGCCTGGCTCACCTGGAC
AACCTCAAGGGCACCTTTGCCACACTGAGTGAGCTGCACTGTGACAAGCT
GCACGTGGATCCTGAGAACTTCAGGGTGAGTCTATGGGACGCTTGATGTT
TTCTTTCCCCTTCTTTTCTATGGTTAAGTTCATGTCATAGGAAGGGGATA
AGTAACAGGGTACAGTTTAGAATGGGAAACAGACGAATGATTGCATCAGT
GTGGAAGTCTCAGGATCGTTTTAGTTTCTTTTATTTGCTGTTCATAACAA
TTGTTTTCTTTTGTTTAATTCTTGCTTTCTTTTTTTTCTTCTCCGCAAT
TTTTACTATTATACTTAATGCCTTAACATTGTGTATAACAAAAGGAAATA
TCTCTGAGATACATTAAGTAACTTAAAAAAAAACTTTACACAGTCTGCCT
AGTACATTACTATTTGGAATATATGTGTGCTTATTTGCATATTCATAATC
TCCCTACTTTATTTTCTTTTATTTTTAATTGATACATAATCATTATACAT
ATTTATGGGTTAAAGTGTAATGTTTTAATATGTGTACACATATTGACCAA
ATCAGGGTAATTTTGCATTTGTAATTTTAAAAAATGCTTTCTTCTTTTAA
TATACTTTTTTGTTTATCTTATTTCTAATACTTTCCCTAATCTCTTTCTT
TCAGGGCAATAATGATACAATGTATCATGCCTCTTTGCACCATTCTAAAG
AATAACAGTGATAATTTCTGGGTTAAGGCAATAGCAATATCTCTGCATAT
AAATATTTCTGCATATAAATTGTAACTG (3'H arm)
```

In an embodiment, the replacement sequence comprises or consists of an adenine (A) residue to correct the amino acid sequence to a glutamic acid (E) residue.

In an embodiment, to correct a mutation, e.g., at E6, e.g., E6V, in the HBB gene, the homology arms, e.g., the 5' and 3' homology arms, may each comprise about 1000 base pairs (bp) of sequence flanking the most distal gRNAs (e.g., 1100 bp of sequence on either side of the mutation). The 5' homology arm is shown as bold sequence, codon 6 is shown as underlined sequence, the inserted base to correct the mutation at E6, e.g., E6V, is shown as boxed sequence, and the 3' homology arm is shown as no emphasis sequence.

```
                               (Template Construct 1; SEQ ID NO: 16259)
ATAGGAACTTGAATCAAGGAAATGATTTTAAAACGCAGTATTCTTAGTGGACTA

GAG GAAAAAATAATCTGAGCCAAGTAGAAGACCTTTTCCCCTCCTACCCCTAC

TTTCTAAGTCACAGAGGCTTTTTGTTCCCCCAGACACTCTTGCAGATTAGTCCA

GGCAGAAACAGTTAGATGTCCCCAGTTAACCTCCTATTTGACACCACTGATTAC

CCCATTGATAGTCACACTTTGGGTTGTAAGTGACTTTTTATTTATTTGTATTTTT

GACTGCATTAAGAGGTCTCTAGTTTTTTATCTCTTGTTTCCCAAAACCTAATAA

GTAACTAATGCACAGAGCACATTGATTTGTATTTATTCTATTTTTAGACATAATT

TATTAGCATGCATGAGCAAATTAAGAAAAACAACAACAAATGAATGCATATATA
```

-continued

```
TGTATATGTATGTGTATATATACACACATATATATATATATTTTTCTTTTCT

TACCAGAAGGTTTTAATCCAAATAAGGAGAAGATATGCTTAGAACCGAGGTAG

AGTTTTCATCCATTCTGTCCTGTAAGTATTTTGCATATTCTGGAGACGCAGGAA

GAGATCCATCTACATATCCCAAAGCTGAATTATGGTAGACAAAACTCTTCCACT

TTTAGTGCATCAACTTCTTATTTGTGTAATAAGAAAATTGGGAAAACGATCTTC

AATATGCTTACCAAGCTGTGATTCCAAATATTACGTAAATACACTTGCAAAGGA

GGATGTTTTTAGTAGCAATTTGTACTGATGGTATGGGGCCAAGAGATATATCTT

AGAGGGAGGGCTGAGGGTTTGAAGTCCAACTCCTAAGCCAGTGCCAGAAGAGC

CAAGGACAGGTACGGCTGTCATCACTTAGACCTCACCCTGTGGAGCCACACCC

TAGGGTTGGCCAATCTACTCCCAGGAGCAGGGAGGGCAGGAGCCAGGGCTGG

GCATAAAAGTCAGGGCAGAGCCATCTATTGCTTACATTTGCTTCTGACACAACT

GTGTTCACTAGCAACCTCAAACAGACACCATGGTGCATCTGACTCCTG[A]GGAGA

AGTCTGCCGTTACTGCCCTGTGGGGCAAGGTAACGTGGATGAAGTTGGTGGTGAG

GCCCTGGGCAGGTTGGTATCAAGGTTACAAGACAGGTTTAAGGAGACCAATAGAAA

CTGGGCATGTGGAGACAGAGAAGACTCTTGGGTTTCTGATAGGCACTGACTCTCTCT

GCCTATTGGTCTATTTTCCCACCCTTAGGCTGCTGGTGGTCTACCCTTGGACCCAGAG

GTTCTTTGAGTCCTTTGGGGATCTGTCCACTCCTGATGCTGTTATGGGCAACCCTAAG

GTGAAGGCTCATGGCAAGAAAGTGCTCGGTGCCTTTAGTGATGGCCTGGCTCACCTG

GACAACCTCAAGGGCACCTTTGCCACACTGAGTGAGCTGCACTGTGACAAGCTGCA

CGTGGATCCTGAGAACTTCAGGGTGAGTCTATGGGACGCTTGATGTTTTCTTTCCCCT

TCTTTTCTATGGTTAAGTTCATGTCATAGGAAGGGGATAAGTAACAGGGTACAGTTT

AGAATGGGAAACAGACGAATGATTGCATCAGTGTGGAAGTCTCAGGATCGTTTTAG

TTTCTTTTATTTGCTGTTCATAACAATTGTTTTCTTTTGTTTAATTCTTGCTTTCTTTTT

TTTTCTTCTCCGCAATTTTTACTATTATACTTAATGCCTTAACATTGTGTATAACAAA

AGGAAATATCTCTGAGATACATTAAGTAACTTAAAAAAAAACTTTACACAGTCTGCC

TAGTACATTACTATTTGGAATATATGTGTGCTTATTTGCATATTCATAATCTCCCTAC

TTTATTTTCTTTTATTTTTAATTGATACATAATCATTATACATATTTATGGGTTAAAGT

GTAATGTTTTAATATGTGTACACATATTGACCAAATCAGGGTAATTTTGCATTTGTAA

TTTTAAAAAATGCTTTCTTCTTTTAATATACTTTTTTGTTTATCTTATTTCTAATACTTT

CCCTAATCTCTTTCTTTCAGGGCAATAATGATACAATGTATCATGCCTCTTTGCACCA

TTCTAAAGAATAACAGTGATAATTTCTGGGTTAAGGCAATAGCAATATCTCTGCATA

TAAATATTTCTGCATATAAATTGTAACTG
```

As described below in Table 27, shorter homology arms, e.g., 5' and/or 3' homology arms may be used.

It is contemplated herein that one or both homology arms may be shortened to avoid including certain sequence repeat elements, e.g., Alu repeats, LINE elements. For example, a 5' homology arm may be shortened to avoid a sequence repeat element. In another embodiment, a 3' homology arm may be shortened to avoid a sequence repeat element. In an embodiment, both the 5' and the 3' homology arms may be shortened to avoid including certain sequence repeat elements.

It is contemplated herein that template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In an embodiment, an ssODN may be used to correct a mutation, e.g., E6V in the HBB gene. For example, the ssODN may include 50 bp 5' and 3' homology arms as shown below. The 5' homology arm is shown as bold sequence, codon 6 is shown as underlined sequence, the inserted base to correct the E6V mutation is shown as boxed sequence, and the 3' homology arm is shown as no emphasis sequence.

(Template Construct 2; SEQ ID NO: 16260)
ACTGTGTTCACTAGCAACCTCAAACAGACACCATGGTGCATCTGACTCCT

GGGAGAAGTCTGCCGTTACTGCCCTGTGGGCAAGGTGAACGTGGATGA

AGT

Silent Mutations in Donor Construct

It is contemplated herein that Cas9 could potentially cleave donor constructs either prior to or following homology directed repair (e.g., homologous recombination), resulting in a possible non-homologous-end-joining event and further DNA sequence mutation at the chromosomal locus of interest. Therefore, to avoid cleavage of the donor sequence before and/or after Cas9-mediated homology directed repair, alternate versions of the donor sequence may be used where silent mutations are introduced. These silent mutations may disrupt Cas9 binding and cleavage, but not disrupt the amino acid sequence of the repaired gene. For example, mutations may include those made to a donor sequence to repair the HBB gene, the mutant form of which can cause Sickle Cell Disease. If gRNA HBB-6 with the 20-base target sequence CGUUACUGCCCUGUGGGGCA is used to insert a donor sequence including (SEQ ID NO: 16297)
CTCCTGAGGAGAAGTCTGCCGTTACTGCCCTGTGGGGCAAGgGTGAACGT

GGATGAAGT, where the italic A is the base being corrected and the bracketed bases are those that match the guide RNA, the donor sequence may be changed to (SEQ ID NO:16298),
CTCCTGAGGAGAAGTCTGCCGTTACTGCCCTGTGGGGCAAGaTGAACGTGGAT
GAAGT where the lowercase a has been changed from a G (lower case g in sequence ID xxx) at that position so that codon 15 still codes for the amino acid Arginine but the PAM sequence AGG has been modified to AGA to reduce or eliminate Cas9 cleavage at that locus.

Table 27 below provides exemplary template nucleic acids. In an embodiment, the template nucleic acid includes the 5' homology arm and the 3' homology arm of a row from Table 27. In another embodiment, a 5' homology arm from the first column can be combined with a 3' homology arm from Table 27. In each embodiment, a combination of the 5' and 3' homology arms include a replacement sequence, e.g., an adenine (A) residue.

TABLE 27

| 5' homology arm (the number of nucleotides from SEQ ID NO: 5'H, beginning at the 3' end of SEQ ID NO: 5'H) | Replacement Sequence = A | 3' homology arm (the number of nucleotides from SEQ ID NO: 3'H, beginning at the 5' end of SEQ ID NO: 3'H) |
| --- | --- | --- |
| 10 or more | | 10 or more |
| 20 or more | | 20 or more |
| 50 or more | | 50 or more |
| 100 or more | | 100 or more |

TABLE 27-continued

| 5' homology arm (the number of nucleotides from SEQ ID NO: 5'H, beginning at the 3' end of SEQ ID NO: 5'H) | Replacement Sequence = A | 3' homology arm (the number of nucleotides from SEQ ID NO: 3'H, beginning at the 5' end of SEQ ID NO: 3'H) |
| --- | --- | --- |
| 150 or more | | 150 or more |
| 200 or more | | 200 or more |
| 250 or more | | 250 or more |
| 300 or more | | 300 or more |
| 350 or more | | 350 or more |
| 400 or more | | 400 or more |
| 450 or more | | 450 or more |
| 500 or more | | 500 or more |
| 550 or more | | 550 or more |
| 600 or more | | 600 or more |
| 650 or more | | 650 or more |
| 700 or more | | 700 or more |
| 750 or more | | 750 or more |
| 800 or more | | 800 or more |
| 850 or more | | 850 or more |
| 900 or more | | 900 or more |
| 1000 or more | | 1000 or more |
| 1100 or more | | 1100 or more |
| 1200 or more | | 1200 or more |
| 1300 or more | | 1300 or more |
| 1400 or more | | 1400 or more |
| 1500 or more | | 1500 or more |
| 1600 or more | | 1600 or more |
| 1700 or more | | 1700 or more |
| 1800 or more | | 1800 or more |
| 1900 or more | | 1900 or more |
| 1200 or more | | 1200 or more |
| At least 50 but not long enough to include a repeated element. | | At least 50 but not long enough to include a repeated element. |

TABLE 27-continued

| 5' homology arm (the number of nucleotides from SEQ ID NO: 5'H, beginning at the 3' end of SEQ ID NO: 5'H) | Replacement Sequence = A | 3' homology arm (the number of nucleotides from SEQ ID NO: 3'H, beginning at the 5' end of SEQ ID NO: 3'H) |
| --- | --- | --- |
| At least 100 but not long enough to include a repeated element. | | At least 100 but not long enough to include a repeated element. |
| At least 150 but not long enough to include a repeated element. | | At least 150 but not long enough to include a repeated element. |
| 5 to 100 nucleotides | | 5 to 100 nucleotides |
| 10 to 150 nucleotides | | 10 to 150 nucleotides |
| 20 to 150 nucleotides | | 20 to 150 nucleotides |

Template Construct No. 1
Template Construct No. 2

V.2 NHEJ Approaches for Gene Targeting

As described herein, nuclease-induced non-homologous end-joining (NHEJ) can be used to target gene-specific knockouts. Nuclease-induced NHEJ can also be used to remove (e.g., delete) sequences in a gene of interest.

While not wishing to be bound by theory, it is believed that, in an embodiment, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein.

The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs (e.g., motifs less than or equal to 50 nucleotides in length) as long as the generation of a specific final sequence is not required. If a double-strand break is targeted near to a target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. In this way, DNA segments as large as several hundred kilobases can be deleted. Both of these approaches can be used to delete specific DNA sequences; however, the error-prone nature of NHEJ may still produce indel mutations at the site of repair.

Both double strand cleaving eaCas9 molecules and single strand, or nickase, eaCas9 molecules can be used in the methods and compositions described herein to generate NHEJ-mediated indels. NHEJ-mediated indels targeted to the the gene, e.g., a coding region, e.g., an early coding region of a gene, of interest can be used to knockout (i.e., eliminate expression of) a gene of interest. For example, early coding region of a gene of interest includes sequence immediately following a start codon, within a first exon of the coding sequence, or within 500 bp of the start codon (e.g., less than 500, 450, 400, 350, 300, 250, 200, 150, 100 or 50 bp).

Placement of Double Strand or Single Strand Breaks Relative to the Target Position In an embodiment, in which a gRNA and Cas9 nuclease generate a double strand break for the purpose of inducing NHEJ-mediated indels, a gRNA, e.g., a unimolecular (or chimeric) or modular gRNA molecule, is configured to position one double-strand break in close proximity to a nucleotide of the target position. In an embodiment, the cleavage site is between 0-30 bp away from the target position (e.g., less than 30, 25, 20, 15, 10, 9, 8, 7, 6, 5, 4, 3, 2 or 1 bp from the target position).

In an embodiment, in which two gRNAs complexing with Cas9 nickases induce two single strand breaks for the purpose of inducing NHEJ-mediated indels, two gRNAs, e.g., independently, unimolecular (or chimeric) or modular e.g., RNA, are configured to position two single-strand breaks to provide for NHEJ repair a nucleotide of the target position. In an embodiment, the gRNAs are configured to position cuts at the same position, or within a few nucleotides of one another, on different strands, essentially mimicking a double strand break. In an embodiment, the closer nick is between 0-30 bp away from the target position (e.g., less than 30, 25, 20, 15, 10, 9, 8, 7, 6, 5, 4, 3, 2 or 1 bp from the target position), and the two nicks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In an embodiment, the gRNAs are configured to place a single strand break on either side of a nucleotide of the target position.

Both double strand cleaving eaCas9 molecules and single strand, or nickase, eaCas9 molecules can be used in the methods and compositions described herein to generate breaks both sides of a target position. Double strand or paired single strand breaks may be generated on both sides of a target position to remove the nucleic acid sequence between the two cuts (e.g., the region between the two breaks in deleted). In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a cas9 nuclease) and two single strand breaks or paired single strand breaks (i.e., two gRNAs complex with Cas9 nickases) on either side of the target position. In another embodiment, four gRNAs, e.g., independently, unimolecular (or chimeric) or modular gRNA, are configured to generate two pairs of single strand breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp).

V.3 Targeted Knockdown

Unlike CRISPR/Cas-mediated gene knockout, which permanently eliminates expression by mutating the gene at the DNA level, CRISPR/Cas knockdown allows for temporary reduction of gene expression through the use of artificial transcription factors. Mutating key residues in both DNA cleavage domains of the Cas9 protein (e.g. the D10A and H840A mutations) results in the generation of a catalytically inactive Cas9 (eiCas9 which is also known as dead Cas9 or dCas9) molecule. A catalytically inactive Cas9 complexes with a gRNA and localizes to the DNA sequence specified by that gRNA's targeting domain, however, it does not cleave the target DNA. Fusion of the dCas9 to an effector domain, e.g., a transcription repression domain, enables recruitment of the effector to any DNA site specified by the gRNA. Although an enzymatically inactive (eiCas9) Cas9 molecule itself can block transcription when recruited to early regions in the coding sequence, more robust repression can be achieved by fusing a transcriptional repression domain (for example KRAB, SID or ERD) to the Cas9 and recruiting it to the target knockdown position, e.g., within 1000 bp of sequence 3' of the start codon or within 500 bp of a promoter region 5' of the start codon of a gene. It is likely that targeting DNAseI hypersensitive sites (DHSs) of the promoter may yield more efficient gene repression or activation because these regions are more likely to be accessible to the Cas9 protein and are also more likely to harbor sites for endogenous transcription factors. Especially for gene repression, it is contemplated herein that blocking the binding site of an endogenous transcription factor would aid in downregulating gene expression. In an embodiment, one or more eiCas9 molecules may be used to block binding of one or more endogenous transcription factors. In another embodiment, an eiCas9 molecule can be fused to a chromatin modifying protein. Altering chromatin status can result in decreased expression of the target gene. One or more eiCas9 molecules fused to one or more chromatin modifying proteins may be used to alter chromatin status.

In an embodiment, a gRNA molecule can be targeted to a known transcription response elements (e.g., promoters, enhancers, etc.), a known upstream activating sequences (UAS), and/or sequences of unknown or known function that are suspected of being able to control expression of the target DNA.

CRISPR/Cas-mediated gene knockdown can be used to reduce expression of an unwanted allele or transcript. Contemplated herein are scenarios wherein permanent destruction of the gene is not ideal. In these scenarios, site-specific repression may be used to temporarily reduce or eliminate expression. It is also contemplated herein that the off-target effects of a Cas-repressor may be less severe than those of a Cas-nuclease as a nuclease can cleave any DNA sequence and cause mutations whereas a Cas-repressor may only have an effect if it targets the promoter region of an actively transcribed gene. However, while nuclease-mediated knockout is permanent, repression may only persist as long as the Cas-repressor is present in the cells. Once the repressor is no longer present, it is likely that endogenous transcription factors and gene regulatory elements would restore expression to its natural state.

V.4 Single-Strand Annealing

Single strand annealing (SSA) is another DNA repair process that repairs a double-strand break between two repeat sequences present in a target nucleic acid. Repeat sequences utilized by the SSA pathway are generally greater than 30 nucleotides in length. Resection at the break ends occurs to reveal repeat sequences on both strands of the target nucleic acid. After resection, single strand overhangs containing the repeat sequences are coated with RPA protein to prevent the repeats sequences from inappropriate annealing, e.g., to themselves. RAD52 binds to and each of the repeat sequences on the overhangs and aligns the sequences to enable the annealing of the complementary repeat sequences. After annealing, the single-strand flaps of the overhangs are cleaved. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

In contrast to HDR pathways, SSA does not require a template nucleic acid to alter or correct a target nucleic acid sequence. Instead, the complementary repeat sequence is utilized.

V.5 Other DNA Repair Pathways

SSBR (Single Strand Break Repair)

Single-stranded breaks (SSB) in the genome are repaired by the SSBR pathway, which is a distinct mechanism from the DSB repair mechanisms discussed above. The SSBR pathway has four major stages: SSB detection, DNA end processing, DNA gap filling, and DNA ligation. A more detailed explanation is given in Caldecott, Nature Reviews Genetics 9, 619-631 (August 2008), and a summary is given here.

In the first stage, when a SSB forms, PARP1 and/or PARP2 recognize the break and recruit repair machinery. The binding and activity of PARP1 at DNA breaks is transient and it seems to accelerate SSBr by promoting the focal accumulation or stability of SSBr protein complexes at the lesion. Arguably the most important of these SSBr proteins is XRCC1, which functions as a molecular scaffold that interacts with, stabilizes, and stimulates multiple enzymatic components of the SSBr process including the protein responsible for cleaning the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF exhibits endonuclease and 3' to 5' exonuclease activities. APTX has endonuclease and 3' to 5' exonuclease activity.

This end processing is an important stage of SSBR since the 3'- and/or 5'-termini of most, if not all, SSBs are 'damaged'. End processing generally involves restoring a damaged 3'-end to a hydroxylated state and and/or a damaged 5' end to a phosphate moiety, so that the ends become ligation-competent. Enzymes that can process damaged 3' termini include PNKP, APE1, and TDP1. Enzymes that can process damaged 5' termini include PNKP, DNA polymerase beta, and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endonculease 1), DNA polymerase delta/epsilon, PCNA, and LIG1. There are two ways of gap filling, the short patch repair and the long patch repair. Short patch repair involves the insertion of a single nucleotide that is missing. At some SSBs, "gap filling" might continue displacing two or more nucleotides (displacement of up to 12 bases have been reported). FEN1 is an endonuclease that removes the displaced 5'-residues. Multiple DNA polymerases, including Pol β, are involved in the repair of SSBs, with the choice of DNA polymerase influenced by the source and type of SSB.

In the fourth stage, a DNA ligase such as LIG1 (Ligase I) or LIG3 (Ligase III) catalyzes joining of the ends. Short patch repair uses Ligase III and long patch repair uses Ligase I.

Sometimes, SSBR is replication-coupled. This pathway can involve one or more of CtIP, MRN, ERCC1, and FEN1. Additional factors that may promote SSBR include: aPARP, PARP1, PARP2, PARG, XRCC1, DNA polymerase b, DNA polymerase d, DNA polymerase e, PCNA, LIG1, PNK, PNKP, APE1, APTX, APLF, TDP1, LIG3, FEN1, CtIP, MRN, and ERCC1.

MMR (Mismatch Repair)

Cells contain three excision repair pathways: MMR, BER, and NER. The excision repair pathways have a common feature in that they typically recognize a lesion on one strand of the DNA, then exo/endonucleaseases remove the lesion and leave a 1-30 nucleotide gap that is sub-sequentially filled in by DNA polymerase and finally sealed with ligase. A more complete picture is given in Li, Cell Research (2008) 18:85-98, and a summary is provided here.

Mismatch repair (MMR) operates on mispaired DNA bases.

The MSH2/6 or MSH2/3 complexes both have ATPases activity that plays an important role in mismatch recognition and the initiation of repair. MSH2/6 preferentially recognizes base-base mismatches and identifies mispairs of 1 or 2 nucleotides, while MSH2/3 preferentially recognizes larger ID mispairs.

hMLH1 heterodimerizes with hPMS2 to form hMutL α which possesses an ATPase activity and is important for multiple steps of MMR. It possesses a PCNA/replication factor C (RFC)-dependent endonuclease activity which plays an important role in 3' nick-directed MMR involving EXO1. (EXO1 is a participant in both HR and MMR.) It regulates termination of mismatch-provoked excision. Ligase I is the relevant ligase for this pathway. Additional factors that may promote MMR include: EXO1, MSH2, MSH3, MSH6, MLH1, PMS2, MLH3, DNA Pol d, RPA, HMGB1, RFC, and DNA ligase I.

Base Excision Repair (BER)

The base excision repair (BER) pathway is active throughout the cell cycle; it is responsible primarily for removing small, non-helix-distorting base lesions from the genome. In contrast, the related Nucleotide Excision Repair pathway (discussed in the next section) repairs bulky helix-distorting lesions. A more detailed explanation is given in Caldecott, Nature Reviews Genetics 9, 619-631 (August 2008), and a summary is given here.

Upon DNA base damage, base excision repair (BER) is initiated and the process can be simplified into five major steps: (a) removal of the damaged DNA base; (b) incision of the subsequent a basic site; (c) clean-up of the DNA ends; (d) insertion of the correct nucleotide into the repair gap; and (e) ligation of the remaining nick in the DNA backbone. These last steps are similar to the SSBR.

In the first step, a damage-specific DNA glycosylase excises the damaged base through cleavage of the N-glycosidic bond linking the base to the sugar phosphate backbone. Then AP endonuclease-1 (APE1) or bifunctional DNA glycosylases with an associated lyase activity incised the phosphodiester backbone to create a DNA single strand break (SSB). The third step of BER involves cleaning-up of the DNA ends. The fourth step in BER is conducted by Pol β that adds a new complementary nucleotide into the repair gap and in the final step XRCC1/Ligase III seals the remaining nick in the DNA backbone. This completes the short-patch BER pathway in which the majority (~80%) of damaged DNA bases are repaired. However, if the 5'-ends in step 3 are resistant to end processing activity, following one nucleotide insertion by Pol β there is then a polymerase switch to the replicative DNA polymerases, Pol δ/ε, which then add ~2-8 more nucleotides into the DNA repair gap. This creates a 5'-flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER. Additional factors that may promote the BER pathway include: DNA glycosylase, APE1, Polb, Pold, Pole, XRCC1, Ligase III, FEN-1, PCNA, RECQL4, WRN, MYH, PNKP, and APTX.

Nucleotide Excision Repair (NER)

Nucleotide excision repair (NER) is an important excision mechanism that removes bulky helix-distorting lesions from DNA. Additional details about NER are given in Marteijn et al., Nature Reviews Molecular Cell Biology 15,465-481 (2014), and a summary is given here. NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCC5) remove the lesion by cutting the damaged strand on either side of the lesion, resulting in a single-strand gap of 22-30 nucleotides. Next, the cell performs DNA gap filling synthesis and ligation. Involved in this process are: PCNA, RFC, DNA Pol δ, DNA Pol ε or DNA Pol κ, and DNA ligase I or XRCC1/Ligase III. Replicating cells tend to use DNA pol ε and DNA ligase I, while non-replicating cells tend to use DNA Pol δ, DNA Pol κ, and the XRCC1/Ligase III complex to perform the ligation step.

NER can involve the following factors: XPA-G, POLH, XPF, ERCC1, XPA-G, and LIG1. Transcription-coupled NER (TC-NER) can involve the following factors: CSA, CSB, XPB, XPD, XPG, ERCC1, and TTDA. Additional factors that may promote the NER repair pathway include XPA-G, POLH, XPF, ERCC1, XPA-G, LIG1, CSA, CSB, XPA, XPB, XPC, XPD, XPF, XPG, TTDA, UVSSA, USP7, CETN2, RAD23B, UV-DDB, CAK subcomplex, RPA, and PCNA.

Interstrand Crosslink (ICL)

A dedicated pathway called the ICL repair pathway repairs interstrand crosslinks. Interstrand crosslinks, or covalent crosslinks between bases in different DNA strand, can occur during replication or transcription. ICL repair involves the coordination of multiple repair processes, in particular, nucleolytic activity, translesion synthesis (TLS), and HDR. Nucleases are recruited to excise the ICL on either side of the crosslinked bases, while TLS and HDR are coordinated to repair the cut strands. ICL repair can involve the following factors: endonucleases, e.g., XPF and RAD51C, endonucleases such as RAD51, translesion polymerases, e.g., DNA polymerase zeta and Rev1), and the Fanconi anemia (FA) proteins, e.g., FancJ.

Other Pathways

Several other DNA repair pathways exist in mammals.

Translesion synthesis (TLS) is a pathway for repairing a single stranded break left after a defective replication event and involves translesion polymerases, e.g., DNA pol☐ and Rev1.

Error-free postreplication repair (PRR) is another pathway for repairing a single stranded break left after a defective replication event.

V.6 Examples of gRNAs in Genome Editing Methods gRNA molecules as described herein can be used with Cas9 molecules that generate a double strand break or a single strand break to alter the sequence of a target nucleic acid, e.g., a target position or target genetic signature. gRNA molecules useful in these methods are described below.

In an embodiment, the gRNA, e.g., a chimeric gRNA, is configured such that it comprises one or more of the following properties;

a) it can position, e.g., when targeting a Cas9 molecule that makes double strand breaks, a double strand break (i) within 50, 100, 150, 200, 250, 300, 350, 400, 450, or 500 nucleotides of a target position, or (ii) sufficiently close that the target position is within the region of end resection;

b) it has a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides; and c)
  (i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus,* or *N. meningitidis* tail and proximal domain, or a sequence that differs by no more than 1, 2, 3, 4, 5; 6, 7, 8, 9 or 10 nucleotides therefrom;
  (ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus,* or *N. meningitidis* gRNA, or a sequence that differs by no more than 1, 2, 3, 4, 5; 6, 7, 8, 9 or 10 nucleotides therefrom;
  (iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus,* or *N. meningitidis* gRNA, or a sequence that differs by no more than 1, 2, 3, 4, 5; 6, 7, 8, 9 or 10 nucleotides therefrom;
  (iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus,* or *N. meningitidis* tail domain, or a sequence that differs by no more than 1, 2, 3, 4, 5; 6, 7, 8, 9 or 10 nucleotides therefrom; or
  (v) the tail domain comprises 15, 20, 25, 30, 35, 40 nucleotides or all of the corresponding portions of a naturally occurring tail domain, e.g., a naturally occurring *S. pyogenes, S. thermophilus, S. aureus,* or *N. meningitidis* tail domain.

In an embodiment, the gRNA is configured such that it comprises properties: a and b(i).
In an embodiment, the gRNA is configured such that it comprises properties: a and b(ii).
In an embodiment, the gRNA is configured such that it comprises properties: a and b(iii).
In an embodiment, the gRNA is configured such that it comprises properties: a and b(iv).
In an embodiment, the gRNA is configured such that it comprises properties: a and b(v).
In an embodiment, the gRNA is configured such that it comprises properties: a and b(vi).
In an embodiment, the gRNA is configured such that it comprises properties: a and b(vii).
In an embodiment, the gRNA is configured such that it comprises properties: a and b(viii).
In an embodiment, the gRNA is configured such that it comprises properties: a and b(ix).
In an embodiment, the gRNA is configured such that it comprises properties: a and b(x).
In an embodiment, the gRNA is configured such that it comprises properties: a and b(xi).
In an embodiment, the gRNA is configured such that it comprises properties: a and c.
In an embodiment, the gRNA is configured such that in comprises properties: a, b, and c.
In an embodiment, the gRNA is configured such that in comprises properties: a(i), b(i), and c(i).
In an embodiment, the gRNA is configured such that in comprises properties: a(i), b(i), and c(ii).
In an embodiment, the gRNA is configured such that in comprises properties: a(i), b(ii), and c(i).
In an embodiment, the gRNA is configured such that in comprises properties: a(i), b(ii), and c(ii).
In an embodiment, the gRNA is configured such that in comprises properties: a(i), b(iii), and c(i).
In an embodiment, the gRNA is configured such that in comprises properties: a(i), b(iii), and c(ii).
In an embodiment, the gRNA is configured such that in comprises properties: a(i), b(iv), and c(i).
In an embodiment, the gRNA is configured such that in comprises properties: a(i), b(iv), and c(ii).
In an embodiment, the gRNA is configured such that in comprises properties: a(i), b(v), and c(i).
In an embodiment, the gRNA is configured such that in comprises properties: a(i), b(v), and c(ii).
In an embodiment, the gRNA is configured such that in comprises properties: a(i), b(vi), and c(i).
In an embodiment, the gRNA is configured such that in comprises properties: a(i), b(vi), and c(ii).
In an embodiment, the gRNA is configured such that in comprises properties: a(i), b(vii), and c(i).
In an embodiment, the gRNA is configured such that in comprises properties: a(i), b(vii), and c(ii).
In an embodiment, the gRNA is configured such that in comprises properties: a(i), b(viii), and c(i).
In an embodiment, the gRNA is configured such that in comprises properties: a(i), b(viii), and c(ii).
In an embodiment, the gRNA is configured such that in comprises properties: a(i), b(ix), and c(i).
In an embodiment, the gRNA is configured such that in comprises properties: a(i), b(ix), and c(ii).
In an embodiment, the gRNA is configured such that in comprises properties: a(i), b(x), and c(i).
In an embodiment, the gRNA is configured such that in comprises properties: a(i), b(x), and c(ii).
In an embodiment, the gRNA is configured such that in comprises properties: a(i), b(xi), and c(i).
In an embodiment, the gRNA is configured such that in comprises properties: a(i), b(xi), and c(ii).

In an embodiment, the gRNA, e.g., a chimeric gRNA, is configured such that it comprises one or more of the following properties;

a) one or both of the gRNAs can position, e.g., when targeting a Cas9 molecule that makes single strand breaks, a single strand break within (i) 50, 100, 150, 200, 250, 300, 350, 400, 450, or 500 nucleotides of a target position, or (ii) sufficiently close that the target position is within the region of end resection;

b) one or both have a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides; and c)
(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus,* or *N. meningitidis* tail and proximal domain, or a sequence that differs by no more than 1, 2, 3, 4, 5; 6, 7, 8, 9 or 10 nucleotides therefrom;
(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus,* or *N. meningitidis* gRNA, or a sequence that differs by no more than 1, 2, 3, 4, 5; 6, 7, 8, 9 or 10 nucleotides therefrom;
(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus,* or *N. meningitidis* gRNA, or a sequence that differs by no more than 1, 2, 3, 4, 5; 6, 7, 8, 9 or 10 nucleotides therefrom;
(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus,* or *N. meningitidis* tail domain, or a sequence that differs by no more than 1, 2, 3, 4, 5; 6, 7, 8, 9 or 10 nucleotides therefrom; or
(v) the tail domain comprises 15, 20, 25, 30, 35, 40 nucleotides or all of the corresponding portions of a naturally occurring tail domain, e.g., a naturally occurring *S. pyogenes, S. thermophilus, S. aureus,* or *N. meningitidis* tail domain.

In an embodiment, the gRNA is configured such that it comprises properties: a and b(i).
In an embodiment, the gRNA is configured such that it comprises properties: a and b(ii).
In an embodiment, the gRNA is configured such that it comprises properties: a and b(iii).
In an embodiment, the gRNA is configured such that it comprises properties: a and b(iv).
In an embodiment, the gRNA is configured such that it comprises properties: a and b(v).
In an embodiment, the gRNA is configured such that it comprises properties: a and b(vi).
In an embodiment, the gRNA is configured such that it comprises properties: a and b(vii).
In an embodiment, the gRNA is configured such that it comprises properties: a and b(viii).
In an embodiment, the gRNA is configured such that it comprises properties: a and b(ix).
In an embodiment, the gRNA is configured such that it comprises properties: a and b(x).
In an embodiment, the gRNA is configured such that it comprises properties: a and b(xi).
In an embodiment, the gRNA is configured such that it comprises properties: a and c.
In an embodiment, the gRNA is configured such that in comprises properties: a, b, and c.
In an embodiment, the gRNA is configured such that in comprises properties: a(i), b(i), and c(i).
In an embodiment, the gRNA is configured such that in comprises properties: a(i), b(i), and c(ii).
In an embodiment, the gRNA is configured such that in comprises properties: a(i), b(ii), and c(i).
In an embodiment, the gRNA is configured such that in comprises properties: a(i), b(ii), and c(ii).
In an embodiment, the gRNA is configured such that in comprises properties: a(i), b(iii), and c(i).
In an embodiment, the gRNA is configured such that in comprises properties: a(i), b(iii), and c(ii).
In an embodiment, the gRNA is configured such that in comprises properties: a(i), b(iv), and c(i).
In an embodiment, the gRNA is configured such that in comprises properties: a(i), b(iv), and c(ii).
In an embodiment, the gRNA is configured such that in comprises properties: a(i), b(v), and c(i).
In an embodiment, the gRNA is configured such that in comprises properties: a(i), b(v), and c(ii).
In an embodiment, the gRNA is configured such that in comprises properties: a(i), b(vi), and c(i).
In an embodiment, the gRNA is configured such that in comprises properties: a(i), b(vi), and c(ii).
In an embodiment, the gRNA is configured such that in comprises properties: a(i), b(vii), and c(i).
In an embodiment, the gRNA is configured such that in comprises properties: a(i), b(vii), and c(ii).
In an embodiment, the gRNA is configured such that in comprises properties: a(i), b(viii), and c(i).
In an embodiment, the gRNA is configured such that in comprises properties: a(i), b(viii), and c(ii).
In an embodiment, the gRNA is configured such that in comprises properties: a(i), b(ix), and c(i).
In an embodiment, the gRNA is configured such that in comprises properties: a(i), b(ix), and c(ii).
In an embodiment, the gRNA is configured such that in comprises properties: a(i), b(x), and c(i).
In an embodiment, the gRNA is configured such that in comprises properties: a(i), b(x), and c(ii).
In an embodiment, the gRNA is configured such that in comprises properties: a(i), b(xi), and c(i).
In an embodiment, the gRNA is configured such that in comprises properties: a(i), b(xi), and c(ii).

In an embodiment, the gRNA is used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNA is used with a Cas9 nickase molecule having RuvC activity, e.g., a Cas9 molecule having the HNH activity inactivated, e.g., a Cas9 molecule having a mutation at 840, e.g., the H840A.

In an embodiment, the gRNAs are used with a Cas9 nickase molecule having RuvC activity, e.g., a Cas9 molecule having the HNH activity inactivated, e.g., a Cas9 molecule having a mutation at N863, e.g., the N863A mutation.

In an embodiment, a pair of gRNAs, e.g., a pair of chimeric gRNAs, comprising a first and a second gRNA, is configured such that they comprises one or more of the following properties;

a) one or both of the gRNAs can position, e.g., when targeting a Cas9 molecule that makes single strand breaks, a single strand break within (i) 50, 100, 150, 200, 250, 300, 350, 400, 450, or 500 nucleotides of a target position, or (ii) sufficiently close that the target position is within the region of end resection;

b) one or both have a targeting domain of at least 16 nucleotides, e.g., a targeting domain of (i) 16, (ii), 17, (iii) 18, (iv) 19, (v) 20, (vi) 21, (vii) 22, (viii) 23. (ix) 24, (x) 25, or (xi) 26 nucleotides;

c) for one or both:
(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus*, or *N. meningitidis* tail and proximal domain, or a sequence that differs by no more than 1, 2, 3, 4, 5; 6, 7, 8, 9 or 10 nucleotides therefrom;
(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;
(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;
(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus*, or *N. meningitidis* tail domain; or, or a sequence that differs by no more than 1, 2, 3, 4, 5; 6, 7, 8, 9 or 10 nucleotides therefrom; or
(v) the tail domain comprises 15, 20, 25, 30, 35, 40 nucleotides or all of the corresponding portions of a naturally occurring tail domain, e.g., a naturally occurring *S. pyogenes, S. thermophilus, S. aureus*, or *N. meningitidis* tail domain;

d) the gRNAs are configured such that, when hybridized to target nucleic acid, they are separated by 0-50, 0-100, 0-200, at least 10, at least 20, at least 30 or at least 50 nucleotides;

e) the breaks made by the first gRNA and second gRNA are on different strands; and f) the PAMs are facing outwards.

In an embodiment, one or both of the gRNAs is configured such that it comprises properties: a and b(i).

In an embodiment, one or both of the gRNAs is configured such that it comprises properties: a and b(ii).

In an embodiment, one or both of the gRNAs is configured such that it comprises properties: a and b(iii).

In an embodiment, one or both of the gRNAs is configured such that it comprises properties: a and b(iv).

In an embodiment, one or both of the gRNAs is configured such that it comprises properties: a and b(v).

In an embodiment, one or both of the gRNAs is configured such that it comprises properties: a and b(vi).

In an embodiment, one or both of the gRNAs is configured such that it comprises properties: a and b(vii).

In an embodiment, one or both of the gRNAs is configured such that it comprises properties: a and b(viii).

In an embodiment, one or both of the gRNAs is configured such that it comprises properties: a and b(ix).

In an embodiment, one or both of the gRNAs is configured such that it comprises properties: a and b(x).

In an embodiment, one or both of the gRNAs is configured such that it comprises properties: a and b(xi).

In an embodiment, one or both of the gRNAs configured such that it comprises properties: a and c.

In an embodiment, one or both of the gRNAs is configured such that it comprises properties: a, b, and c.

In an embodiment, one or both of the gRNAs is configured such that it comprises properties: a(i), b(i), and c(i).

In an embodiment, one or both of the gRNAs is configured such that it comprises properties: a(i), b(i), and c(ii).

In an embodiment, one or both of the gRNAs is configured such that it comprises properties: a(i), b(i), c, and d.

In an embodiment, one or both of the gRNAs is configured such that it comprises properties: a(i), b(i), c, and e.

In an embodiment, one or both of the gRNAs is configured such that it comprises properties: a(i), b(i), c, d, and e.

In an embodiment, one or both of the gRNAs is configured such that it comprises properties: a(i), b(ii), and c(i).

In an embodiment, one or both of the gRNAs is configured such that it comprises properties: a(i), b(ii), and c(ii).

In an embodiment, one or both of the gRNAs is configured such that it comprises properties: a(i), b(ii), c, and d.

In an embodiment, one or both of the gRNAs is configured such that it comprises properties: a(i), b(ii), c, and e.

In an embodiment, one or both of the gRNAs is configured such that it comprises properties: a(i), b(ii), c, d, and e.

In an embodiment, one or both of the gRNAs is configured such that it comprises properties: a(i), b(iii), and c(i).

In an embodiment, one or both of the gRNAs is configured such that it comprises properties: a(i), b(iii), and c(ii).

In an embodiment, one or both of the gRNAs is configured such that it comprises properties: a(i), b(iii), c, and d.

In an embodiment, one or both of the gRNAs is configured such that it comprises properties: a(i), b(iii), c, and e.

In an embodiment, one or both of the gRNAs is configured such that it comprises properties: a(i), b(iii), c, d, and e.

In an embodiment, one or both of the gRNAs is configured such that it comprises properties: a(i), b(iv), and c(i).

In an embodiment, one or both of the gRNAs is configured such that it comprises properties: a(i), b(iv), and c(ii).

In an embodiment, one or both of the gRNAs is configured such that it comprises properties: a(i), b(iv), c, and d.

In an embodiment, one or both of the gRNAs is configured such that it comprises properties: a(i), b(iv), c, and e.

In an embodiment, one or both of the gRNAs is configured such that it comprises properties: a(i), b(iv), c, d, and e.

In an embodiment, one or both of the gRNAs is configured such that it comprises properties: a(i), b(v), and c(i).

In an embodiment, one or both of the gRNAs is configured such that it comprises properties: a(i), b(v), and c(ii).

In an embodiment, one or both of the gRNAs is configured such that it comprises properties: a(i), b(v), c, and d.

In an embodiment, one or both of the gRNAs is configured such that it comprises properties: a(i), b(v), c, and e.

In an embodiment, one or both of the gRNAs is configured such that it comprises properties: a(i), b(v), c, d, and e.

In an embodiment, one or both of the gRNAs is configured such that it comprises properties: a(i), b(vi), and c(i).

In an embodiment, one or both of the gRNAs is configured such that it comprises properties: a(i), b(vi), and c(ii).

In an embodiment, one or both of the gRNAs is configured such that it comprises properties: a(i), b(vi), c, and d.

In an embodiment, one or both of the gRNAs is configured such that it comprises properties: a(i), b(vi), c, and e.

In an embodiment, one or both of the gRNAs is configured such that it comprises properties: a(i), b(vi), c, d, and e.

In an embodiment, one or both of the gRNAs is configured such that it comprises properties: a(i), b(vii), and c(i).

In an embodiment, one or both of the gRNAs is configured such that it comprises properties: a(i), b(vii), and c(ii).

In an embodiment, one or both of the gRNAs is configured such that it comprises properties: a(i), b(vii), c, and d.

In an embodiment, one or both of the gRNAs is configured such that it comprises properties: a(i), b(vii), c, and e.

In an embodiment, one or both of the gRNAs is configured such that it comprises properties: a(i), b(vii), c, d, and e.

In an embodiment, one or both of the gRNAs is configured such that it comprises properties: a(i), b(viii), and c(i).

In an embodiment, one or both of the gRNAs is configured such that it comprises properties: a(i), b(viii), and c(ii).

In an embodiment, one or both of the gRNAs is configured such that it comprises properties: a(i), b(viii), c, and d.

In an embodiment, one or both of the gRNAs is configured such that it comprises properties: a(i), b(viii), c, and e.

In an embodiment, one or both of the gRNAs is configured such that it comprises properties: a(i), b(viii), c, d, and e.

In an embodiment, one or both of the gRNAs is configured such that it comprises properties: a(i), b(ix), and c(i).

In an embodiment, one or both of the gRNAs is configured such that it comprises properties: a(i), b(ix), and c(ii).

In an embodiment, one or both of the gRNAs is configured such that it comprises properties: a(i), b(ix), c, and d.

In an embodiment, one or both of the gRNAs is configured such that it comprises properties: a(i), b(ix), c, and e.

In an embodiment, one or both of the gRNAs is configured such that it comprises properties: a(i), b(ix), c, d, and e.

In an embodiment, one or both of the gRNAs is configured such that it comprises properties: a(i), b(x), and c(i).

In an embodiment, one or both of the gRNAs is configured such that it comprises properties: a(i), b(x), and c(ii).

In an embodiment, one or both of the gRNAs is configured such that it comprises properties: a(i), b(x), c, and d.

In an embodiment, one or both of the gRNAs is configured such that it comprises properties: a(i), b(x), c, and e.

In an embodiment, one or both of the gRNAs is configured such that it comprises properties: a(i), b(x), c, d, and e.

In an embodiment, one or both of the gRNAs is configured such that it comprises properties: a(i), b(xi), and c(i).

In an embodiment, one or both of the gRNAs is configured such that it comprises properties: a(i), b(xi), and c(ii).

In an embodiment, one or both of the gRNAs is configured such that it comprises properties: a(i), b(xi), c, and d.

In an embodiment, one or both of the gRNAs is configured such that it comprises properties: a(i), b(xi), c, and e.

In an embodiment, one or both of the gRNAs is configured such that it comprises properties: a(i), b(xi), c, d, and e.

In an embodiment, the gRNAs are used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNAs are used with a Cas9 nickase molecule having RuvC activity, e.g., a Cas9 molecule having the HNH activity inactivated, e.g., a Cas9 molecule having a mutation at H840, e.g., the H840A mutation.

In an embodiment, the gRNAs are used with a Cas9 nickase molecule having RuvC activity. e.g., a Cas9 molecule having the HNH activity inactivated, e.g., a Cas9 molecule having a mutation at N863, e.g., the N863A mutation.

VI. Target Cells

Cas9 molecules and gRNA molecules, e.g., a Cas9 molecule/gRNA molecule complex, can be used to manipulate a cell, e.g., to edit a target nucleic acid, in a wide variety of cells.

In an embodiment, a cell is manipulated by editing (e.g., inducing a mutation in) the HBB and/or BCL11A target genes, e.g., as described herein. In an embodiment, the expression of the HBB and/or BCL11A target genes is modulated, e.g., in vivo. In another embodiment, the expression of the HBB and/or BCL11A target genes is modulated, e.g., ex vivo.

The Cas9 and gRNA molecules described herein can be delivered to a target cell. In an embodiment, the target cell is a circulating blood cell. e.g., a reticulocyte, a myeloid progenitor cell, or a hematopoietic stem cell. In an embodiment, the target cell is a bone marrow cell (e.g., a myeloid progenitor cell, an erythroid progenitor cell, a hematopoietic stem cell, or a mesenchymal stem cell). In an embodiment, the target cell is a myeloid progenitor cell (e.g. a common myeloid progenitor (CMP) cell). In an embodiment, the target cell is an erythroid progenitor cell (e.g. a megakaryocyte erythroid progenitor (MEP) cell). In an embodiment, the target cell is a hematopoietic stem cell (e.g. a long term hematopoietic stem cell (LT-HSC), a short term hematopoietic stem cell (ST-HSC), a multipotent progenitor (MPP) cell, a lineage restricted progenitor (LRP) cell).

In an embodiment, the target cell is manipulated ex vivo by editing (e.g., inducing a mutation in) the HBB and/or BCL11A target genes and/or modulating the expression of the HBB and/or BCL11A target genes, and administered to the subject. Sources of target cells for ex vivo manipulation may include, by way of example, the subject's blood, the subject's cord blood, or the subject's bone marrow. Sources of target cells for ex vivo manipulation may also include, by way of example, heterologous donor blood, cord blood, or bone marrow.

In an embodiment, a myeloid progenitor cell is removed from the subject, manipulated ex vivo as described above, and the myeloid progenitor cell is returned to the subject. In an embodiment, an erythroid progenitor cell is removed from the subject, manipulated ex vivo as described above, and the erythroid progenitor cell is returned to the subject. In an embodiment, a hematopoietic stem cell is removed from the subject, manipulated ex vivo as described above, and the hematopoietic stem cell is returned to the subject. In an embodiment, a CD34+ hematopoietic stem cell is removed from the subject, manipulated ex vivo as described above, and the CD34+ hematopoietic stem cell is returned to the subject.

A suitable cell can also include a stem cell such as, by way of example, an embryonic stem cell, an induced pluripotent stem cell, a hematopoietic stem cell, a neuronal stem cell and a mesenchymal stem cell. In an embodiment, the cell is an induced pluripotent stem (iPS) cell or a cell derived from an iPS cell, e.g., an iPS cell generated from the subject, modified to induce a mutation and differentiated into a clinically relevant cell such as a myeloid progenitor cell, an erythroid progenitor cell or a hematopoietic stem cell. In an embodiment, AAV is used to transduce the target cells, e.g., the target cells described herein.

Cells produced by the methods described herein may be used immediately. Alternatively, the cells may be frozen (e.g., in liquid nitrogen) and stored for later use. The cells will usually be frozen in 10% dimethylsulfoxide (DMSO), 50% serum, 40% buffered medium, or some other such solution as is commonly used in the art to preserve cells at such freezing temperature and thawed in such a manner as commonly known in the art for thawing frozen cultured cells.

VII. Delivery, Formulations and Routes of Administration

The components, e.g., a Cas9 molecule and gRNA molecule (e.g., a Cas9 molecule/gRNA molecule complex), and a donor template nucleic acid, can be delivered or formulated in a variety of forms, see, e.g., Tables 34-35. In an embodiment, one Cas9 molecule and two or more (e.g., 2, 3, 4, or more) different gRNA molecules are delivered, e.g., by an AAV vector. In an embodiment, the sequence encoding the Cas9 molecule and the sequence(s) encoding the two or more (e.g., 2, 3, 4, or more) different gRNA molecules are present on the same nucleic acid molecule, e.g., an AAV vector. When a Cas9 or gRNA component is encoded as DNA for delivery, the DNA will typically but not necessarily include a control region, e.g., comprising a promoter, to effect expression. Useful promoters for Cas9 molecule sequences include CMV, EFS, EF-1a, MSCV, PGK, CAG promoters. In an embodiment, the promoter is a constitutive promoter. In another embodiment, the promoter is a tissue specific promoter. Useful promoters for gRNAs include H1, 7SK, tRNA, and U6 promoters. Promoters with similar or dissimilar strengths can be selected to tune the expression of components. Sequences encoding a Cas9 molecule can comprise a nuclear localization signal (NLS), e.g., an SV40 NLS. In an embodiment, the sequence encoding a Cas9 molecule comprises at least two nuclear localization signals. In an embodiment a promoter for a Cas9 molecule or a gRNA molecule can be, independently, inducible, tissue specific, or cell specific.

Table 34 provides examples of how the components can be formulated, delivered, or administered.

TABLE 34

| Cas9 Molecule(s) | gRNA Molecule(s) | Donor Template Nucleic Acid | Comments |
|---|---|---|---|
| DNA | DNA | DNA | In this embodiment, a Cas9 molecule, typically an eaCas9 molecule, and a gRNA are transcribed from DNA. In this embodiment, they are encoded on separate molecules. In this embodiment, the donor template is provided as a separate DNA molecule. |
| DNA | DNA | | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the gRNA. |
| | DNA | DNA | In this embodiment, a Cas9 molecule, typically an eaCas9 molecule, and a gRNA are transcribed from DNA, here from a single molecule. In this embodiment, the donor template is provided as a separate DNA molecule. |
| DNA | DNA | DNA | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the Cas9. |
| DNA | RNA | DNA | In this embodiment, a Cas9 molecule, typically an eaCas9 molecule, is transcribed from DNA, and a gRNA is provided as in vitro transcribed or synthesized RNA. In this embodiment, the donor template is provided as a separate DNA molecule. |
| DNA | RNA | DNA | In this embodiment, a Cas9 Molecule, typically an eaCas9 molecule, is transcribed from DNA, and a gRNA is provided as in vitro transcribed or synthesized RNA. In this embodiment, the donor template is provided on the same DNA molecule that encodes the Cas9. |
| mRNA | RNA | DNA | In this embodiment, a Cas9 molecule, typically an eaCas9 molecule, is translated from in vitro transcribed mRNA, and a gRNA is provided as in vitro transcribed or synthesized RNA. In this embodiment, the donor template is provided as a DNA molecule. |
| mRNA | DNA | DNA | In this embodiment, a Cas9 molecule, typically an eaCas9 molecule, is translated from in vitro transcribed mRNA, and a gRNA is transcribed from DNA. In this embodiment, the donor template is provided as a separate DNA molecule. |
| mRNA | | DNA | In this embodiment, a Cas9 molecule, typically an eaCas9 molecule, is translated from in vitro |

TABLE 34-continued

| Elements | | | |
|---|---|---|---|
| Cas9 Molecule(s) | gRNA Molecule(s) | Donor Template Nucleic Acid | Comments |
| | | | transcribed mRNA, and a gRNA is transcribed from DNA. In this embodiment, the donor template is provided on the same DNA molecule that encodes the gRNA. |
| Protein | DNA | DNA | In this embodiment, a Cas9 molecule, typically an eaCas9 molecule, is provided as a protein, and a gRNA is transcribed from DNA. In this embodiment, the donor template is provided as a separate DNA molecule. |
| Protein | DNA | | In this embodiment, a Cas9 molecule, typically an eaCas9 molecule, is provided as a protein, and a gRNA is transcribed from DNA. In this embodiment, the donor template is provided on the same DNA molecule that encodes the gRNA. |
| Protein | RNA | DNA | In this embodiment, an eaCas9 molecule is provided as a protein, and a gRNA is provided as transcribed or synthesized RNA. In this embodiment, the donor template is provided as a DNA molecule. |

Table 35 summarizes various delivery methods for the components of a Cas system, e.g., the Cas9 molecule component and the gRNA molecule component, as described herein.

TABLE 35

| | Delivery Vector/Mode | Delivery into Non-Dividing Cells | Duration of Expression | Genome Integration | Type of Molecule Delivered |
|---|---|---|---|---|---|
| | Physical (eg, electroporation, particle gun, Calcium Phosphate transfection) | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

DNA-Based Delivery of a Cas9 Molecule and/or One or More gRNA Molecule and/or a Donor Template Nucleic acids (e.g., DNA) encoding a Cas9 molecule (e.g., an eaCas9 molecule), a gRNA molecule, a donor template nucleic acid, or any combination (e.g., two or all) thereof, can be administered to subjects or delivered into cells by art-known methods or as described herein. For example, Cas9-encoding and/or gRNA-encoding DNA, as well as donor template nucleic acids, can be delivered, e.g., by vectors (e.g., viral or non-viral vectors), non-vector based methods (e.g., using naked DNA or DNA complexes), or a combination thereof. Donor template molecules can be administered to subjects or delivered into cells by art-known methods or as described herein. For example, donor template molecules can be delivered, e.g., by vectors (e.g., viral or non-viral vectors), non-vector based methods (e.g., using naked DNA or DNA complexes), or a combination thereof.

Nucleic acids (e.g., DNA) encoding Cas9 molecules (e.g., eaCas9 molecules) and/or gRNA molecules can be conjugated to molecules to promote uptake by the target cells (e.g., the target cells describe herein). Donor template molecules can be conjugated to molecules to promote uptake by the target cells (e.g., the target cells describe herein).

In an embodiment, the Cas9- and/or gRNA-encoding DNA is delivered by a vector (e.g., viral vector/virus or plasmid).

A vector can comprise a sequence that encodes a Cas9 molecule and/or a gRNA molecule. A vector can also comprise a sequence encoding a signal peptide (e.g., for nuclear localization, nucleolar localization, mitochondrial localization), fused, e.g., to a Cas9 molecule sequence. For example, a vector can comprise a nuclear localization sequence (e.g., from SV40) fused to the sequence encoding the Cas9 molecule.

One or more regulatory/control elements, e.g., a promoter, an enhancer, an intron, a polyadenylation signal, a Kozak consensus sequence, internal ribosome entry sites (IRES), a 2A sequence, and splice acceptor or donor can be included in the vectors. In an embodiment, the promoter is recognized by RNA polymerase II (e.g., a CMV promoter). In another embodiment, the promoter is recognized by RNA polymerase III (e.g., a U6 promoter). In an embodiment, the promoter is a regulated promoter (e.g., inducible promoter). In another embodiment, the promoter is a constitutive promoter. In an embodiment, the promoter is a tissue specific promoter. In an embodiment, the promoter is a viral promoter. In another embodiment, the promoter is a non-viral promoter.

In an embodiment, the vector or delivery vehicle is a viral vector (e.g., for generation of recombinant viruses). In an embodiment, the virus is a DNA virus (e.g., dsDNA or ssDNA virus). In another embodiment, the virus is an RNA virus (e.g., an ssRNA virus). Exemplary viral vectors/viruses include, e.g., retroviruses, lentiviruses, adenovirus, adeno-associated virus (AAV), vaccinia viruses, poxviruses, and herpes simplex viruses.

In an embodiment, the virus infects dividing cells. In another embodiment, the virus infects non-dividing cells. In an embodiment, the virus infects both dividing and non-dividing cells. In an embodiment, the virus can integrate into the host genome. In an embodiment, the virus is engineered to have reduced immunity, e.g., in human. In an embodiment, the virus is replication-competent. In another embodiment, the virus is replication-defective, e.g., having one or more coding regions for the genes necessary for additional rounds of virion replication and/or packaging replaced with other genes or deleted. In an embodiment, the virus causes transient expression of the Cas9 molecule and/or the gRNA molecule. In another embodiment, the virus causes long-lasting, e.g., at least 1 week, 2 weeks, 1 month, 2 months, 3 months, 6 months, 9 months, 1 year, 2 years, or permanent expression, of the Cas9 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In an embodiment, the viral vector recognizes a specific cell type or tissue. For example, the viral vector can be pseudotyped with a different/alternative viral envelope glycoprotein; engineered with a cell type-specific receptor (e.g., genetic modification(s) of one or more viral envelope glycoproteins to incorporate a targeting ligand such as a peptide ligand, a single chain antibody, or a growth factor); and/or engineered to have a molecular bridge with dual specificities with one end recognizing a viral glycoprotein and the other end recognizing a moiety of the target cell surface (e.g., a ligand-receptor, monoclonal antibody, avidin-biotin and chemical conjugation).

Exemplary viral vectors/viruses include, e.g., retroviruses, lentiviruses, adenovirus, adeno-associated virus (AAV), vaccinia viruses, poxviruses, and herpes simplex viruses.

In an embodiment, the Cas9- and/or gRNA-encoding nucleic acid sequence is delivered by a recombinant retrovirus. In an embodiment, the donor template nucleic acid is delivered by a recombinant retrovirus. In an embodiment, the retrovirus (e.g., Moloney murine leukemia virus) comprises a reverse transcriptase, e.g., that allows integration into the host genome. In an embodiment, the retrovirus is replication-competent. In another embodiment, the retrovirus is replication-defective, e.g., having one of more coding regions for the genes necessary for additional rounds of virion replication and packaging replaced with other genes, or deleted.

In an embodiment, the Cas9- and/or gRNA-encoding nucleic acid sequence is delivered by a recombinant lentivirus. In an embodiment, the donor template nucleic acid is delivered by a recombinant lentivirus. For example, the lentivirus is replication-defective, e.g., does not comprise one or more genes required for viral replication.

In an embodiment, the Cas9- and/or gRNA-encoding DNA is delivered by a recombinant adenovirus. In an embodiment, the donor template nucleic acid is delivered by a recombinant adenovirus. In an embodiment, the adenovirus is engineered to have reduced immunity in human.

In an embodiment, the Cas9- and/or gRNA-encoding DNA is delivered by a recombinant AAV. In an embodiment, the donor template nucleic acid is delivered by a recombinant AAV. In some embodiments, the AAV does not incorporate its genome into that of a host cell, e.g., a target cell as describe herein. In an embodiment, the AAV can incorporate its genome into that of a host cell, e.g., a target cell as described herein. In an embodiment, the AAV is a self-complementary adeno-associated virus (scAAV), e.g., a scAAV that packages both strands which anneal together to form double stranded DNA. AAV serotypes that may be used in the disclosed methods, include AAV1, AAV2, modified AAV2 (e.g., modifications at Y444F, Y500F, Y730F and/or S662V), AAV3, modified AAV3 (e.g., modifications at Y705F, Y731F and/or T492V), AAV4, AAV5, AAV6, modified AAV6 (e.g., modifications at S663V and/or T492V), AAV8, AAV 8.2, AAV9, AAV rh 10, and pseudotyped AAV, such as AAV2/8, AAV2/5 and AAV2/6 can also be used in the disclosed methods.

In an embodiment, an AAV capsid that can be used in the methods described herein is a capsid sequence from serotype AAV1, AAV2, AAV3, AAV4, AAV5, AAV6, AAV7, AAV8, AAV9, AAV.rh8, AAV.rh10, AAV.rh32/33, AAV.rh43, AAV.rh64R1, or AAV7m8.

In an embodiment, the Cas9- and/or gRNA-encoding DNA is delivered in a re-engineered AAV capsid, e.g., with 50% or greater, e.g., 60% or greater. 70% or greater, 80% or greater, 90% or greater, or 95% or greater, sequence homology with a capsid sequence from serotypes AAV1, AAV2, AAV3, AAV4, AAV5, AAV6, AAV7, AAV8, AAV9, AAV.rh8, AAV.rh 10, AAV.rh32/33, AAV.rh43, or AAV.rh64R1.

In an embodiment, the Cas9- and/or gRNA-encoding DNA is delivered by a chimeric AAV capsid. In an embodiment, the donor template nucleic acid is delivered by a chimeric AAV capsid. Exemplary chimeric AAV capsids include, but are not limited to, AAV9i1, AAV2i8, AAV-DJ, AAV2G9, AAV2i8G9, or AAV8G9.

In an embodiment, the AAV is a self-complementary adeno-associated virus (scAAV), e.g., a scAAV that packages both strands which anneal together to form double stranded DNA.

In an embodiment, the Cas9- and/or gRNA-encoding DNA is delivered by a hybrid virus, e.g., a hybrid of one or more of the viruses described herein. In an embodiment, the hybrid virus is hybrid of an AAV (e.g., of any AAV serotype), with a Bocavirus, B19 virus, porcine AAV, goose AAV, feline AAV, canine AAV, or MVM.

A Packaging cell is used to form a virus particle that is capable of infecting a target cell. Such a cell includes a 293 cell, which can package adenovirus, and a ψ2 cell or a PA317 cell, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed, eg. Cas9. For example, an AAV vector used in gene therapy typically only possesses inverted terminal repeat (ITR) sequences from the AAV genome which are required for packaging and gene expression in the host or target cell. The missing viral functions can be supplied in trans by the packaging cell line and/or plasmid containing E2A, E4, and VA genes from adenovirus, and plasmid encoding Rep and Cap genes from AAV, as described in "Triple Transfection Protocol." Henceforth, the viral DNA is packaged in a cell line, which contains a helper plasmid encoding the other AAV genes, namely rep and cap, but lacking ITR sequences. In embodiment, the viral DNA is packaged in a producer cell line, which contains E1A and/or E1B genes from adenovirus. The cell line is also infected with adenovirus as a helper. The helper virus (e.g., adenovirus or HSV) or helper plasmid promotes replication of the AAV vector and expression of AAV genes from the helper plasmid with ITRs. The helper plasmid is not packaged in significant amounts due to a lack of ITR sequences. Contamination with adenovirus can be reduced by, e.g., heat treatment to which adenovirus is more sensitive than AAV.

In an embodiment, the viral vector has the ability of cell type and/or tissue type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as a peptide ligand, a single chain antibodie, a growth factor); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In an embodiment, the viral vector achieves cell type specific expression. For example, a tissue-specific promoter can be constructed to restrict expression of the transgene (Cas 9 and gRNA) in only the target cell. The specificity of the vector can also be mediated by microRNA-dependent control of transgene expression. In an embodiment, the viral vector has increased efficiency of fusion of the viral vector and a target cell membrane. For example, a fusion protein such as fusion-competent hemagglutin (HA) can be incorporated to increase viral uptake into cells. In an embodiment, the viral vector has the ability of nuclear localization. For example, a virus that requires the breakdown of the nuclear envelope (during cell division) and therefore will not infect a non-diving cell can be altered to incorporate a nuclear localization peptide in the matrix protein of the virus thereby enabling the transduction of non-proliferating cells.

In some embodiments, the Cas9- and/or gRNA-encoding DNA is delivered by a non-vector based method (e.g., using naked DNA or DNA complexes). For example, the DNA can be delivered, e.g., by organically modified silica or silicate (Ormosil), electroporation, transient cell compression or squeezing (e.g., as described in Lee, et al., Nano Lett 12: 6322-27), gene gun, sonoporation, magnetofection, lipid-mediated transfection, dendrimers, inorganic nanoparticles, calcium phosphates, or a combination thereof.

In an embodiment, delivery via electroporation comprises mixing the cells with the Cas9- and/or gRNA-encoding DNA in a cartridge, chamber or cuvette and applying one or more electrical impulses of defined duration and amplitude. In an embodiment, delivery via electroporation is performed using a system in which cells are mixed with the Cas9- and/or gRNA-encoding DNA in a vessel connected to a device (eg, a pump) which feeds the mixture into a cartridge, chamber or cuvette wherein one or more electrical impulses of defined duration and amplitude are applied, after which the cells are delivered to a second vessel.

In an embodiment, the Cas9- and/or gRNA-encoding DNA is delivered by a combination of a vector and a non-vector based method. In an embodiment, the donor template nucleic acid is delivered by a combination of a vector and a non-vector based method. For example, a virosome comprises a liposome combined with an inactivated virus (e.g., HIV or influenza virus), which can result in more efficient gene transfer, e.g., in a respiratory epithelial cell than either a viral or a liposomal method alone.

In an embodiment, the delivery vehicle is a non-viral vector. In an embodiment, the non-viral vector is an inorganic nanoparticle. Exemplary inorganic nanoparticles include, e.g., magnetic nanoparticles (e.g., $Fe_3MnO_2$) or silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids for gene transfer are shown below in Table 36.

TABLE 36

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2.3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |

Exemplary polymers for gene transfer are shown below in Table 37.

TABLE 37

Polymers Used for Gene Transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine) biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amido ethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In an embodiment, the vehicle has targeting modifications to increase target cell update of nanoparticles and liposomes, e.g., cell specific antigens, monoclonal antibodies, single chain antibodies, aptamers, polymers, sugars, and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimuli-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle. In an embodiment, the vehicle is an attenuated bacterium (e.g., naturally or artificially engineered to be invasive but attenuated to prevent pathogenesis and expressing the transgene (e.g., *Listeria monocytogenes*, certain *Salmonella* strains, *Bifidobacterium longum*, and modified *Escherichia coli*), bacteria having nutritional and tissue-specific tropism to target specific tissues, bacteria having modified surface proteins to alter target tissue specificity). In an embodiment, the vehicle is a genetically modified bacteriophage (e.g., engineered phages having large packaging capacity, less immunogenic, containing mammalian plasmid maintenance sequences and having incorporated targeting ligands). In an embodiment, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In an embodiment, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes—subject (i.e., patient) derived membrane-bound nanovescicle (30-100 nm) of endocytic origin (e.g., can be produced from various cell types and can therefore be taken up by cells without the need of for targeting ligands).

In an embodiment, one or more nucleic acid molecules (e.g., DNA molecules) other than the components of a Cas system, e.g., the Cas9 molecule component and/or the gRNA molecule component described herein, are delivered. In an embodiment, the nucleic acid molecule is delivered at the same time as one or more of the components of the Cas system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In an embodiment, the nucleic acid molecule is delivered by a different means than one or more of the components of the Cas system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In an embodiment, the nucleic acid molecule encodes a therapeutic protein, e.g., a protein described herein. In an embodiment, the nucleic acid molecule encodes an RNA molecule, e.g., an RNA molecule described herein.

Delivery of RNA Encoding a Cas9 Molecule

RNA encoding Cas9 molecules (e.g., eaCas9 molecules or eiCas9 molecules) and/or gRNA molecules, can be delivered into cells, e.g., target cells described herein, by art-known methods or as described herein. For example, Cas9-encoding and/or gRNA-encoding RNA can be delivered, e.g., by microinjection, electroporation, transient cell compression or squeezing (eg, as described in Lee, et al., 2012, *Nano Lett* 12: 6322-27), lipid-mediated transfection, peptide-mediated delivery, or a combination thereof. Cas9-encoding and/or gRNA-encoding RNA can be conjugated to molecules) promoting uptake by the target cells (e.g., target cells described herein).

In an embodiment, delivery via electroporation comprises mixing the cells with the RNA encoding Cas9 molecules (e.g., eaCas9 molecules, eiCas9 molecules or eiCas9 fusion proteins) and/or gRNA molecules, with or without donor template nucleic acid molecules, in a cartridge, chamber or cuvette and applying one or more electrical impulses of defined duration and amplitude. In an embodiment, delivery via electroporation is performed using a system in which cells are mixed with the RNA encoding Cas9 molecules (e.g., eaCas9 molecules, eiCas9 molecules or eiCas9 fusion proteins) and/or gRNA molecules, with or without donor template nucleic acid molecules in a vessel connected to a device (eg, a pump) which feeds the mixture into a cartridge, chamber or cuvette wherein one or more electrical impulses of defined duration and amplitude are applied, after which the cells are delivered to a second vessel. Cas9-encoding and/or gRNA-encoding RNA can be conjugated to molecules to promote uptake by the target cells (e.g., target cells described herein).

Delivery Cas9 Molecule Protein

Cas9 molecules (e.g., eaCas9 molecules or eiCas9 molecules) can be delivered into cells by art-known methods or as described herein. For example, Cas9 protein molecules can be delivered, e.g., by microinjection, electroporation, transient cell compression or squeezing (eg, as described in Lee, et al [2012] *Nano Lett* 12: 6322-27), lipid-mediated transfection, peptide-mediated delivery, or a combination thereof. Delivery can be accompanied by DNA encoding a gRNA or by a gRNA. Cas9 protein can be conjugated to molecules promoting uptake by the target cells (e.g., target cells described herein).

In an embodiment, delivery via electroporation comprises mixing the cells with the Cas9 molecules (e.g., eaCas9 molecules, eiCas9 molecules or eiCas9 fusion proteins) and/or gRNA molecules, with or without donor nucleic acid, in a cartridge, chamber or cuvette and applying one or more electrical impulses of defined duration and amplitude. In an embodiment, delivery via electroporation is performed using a system in which cells are mixed with the Cas9 molecules (e.g., eaCas9 molecules, eiCas9 molecules or eiCas9 fusion proteins) and/or gRNA molecules, with or without donor nucleic acid in a vessel connected to a device (eg, a pump) which feeds the mixture into a cartridge, chamber or cuvette wherein one or more electrical impulses of defined duration and amplitude are applied, after which the cells are delivered to a second vessel. Cas9-encoding and/or gRNA-encoding RNA can be conjugated to molecules to promote uptake by the target cells (e.g., target cells described herein).

Route of Administration

Systemic modes of administration include oral and parenteral routes. Parenteral routes include, by way of example, intravenous, intrarterial, intraosseous, intramuscular, intradermal, subcutaneous, intranasal and intraperitoneal routes. Components administered systemically may be modified or formulated to target the components to cells of the blood and bone marrow.

Local modes of administration include, by way of example, intra-bone marrow, intrathecal, and intra-cerebroventricular routes. In an embodiment, significantly smaller amounts of the components (compared with systemic approaches) may exert an effect when administered locally (for example, intra-bone marrow) compared to when administered systemically (for example, intravenously). Local modes of administration can reduce or eliminate the incidence of potentially toxic side effects that may occur when therapeutically effective amounts of a component are administered systemically.

In an embodiment, components described herein are delivered by intra-bone marrow injection. Injections may be made directly into the bone marrow compartment of one or more than one bone. In an embodiment, nanoparticle or viral, e.g., AAV vector, delivery is via intra-bone marrow injection.

Administration may be provided as a periodic bolus or as continuous infusion from an internal reservoir or from an external reservoir (for example, from an intravenous bag). Components may be administered locally, for example, by continuous release from a sustained release drug delivery device In addition, components may be formulated to permit release over a prolonged period of time. A release system can include a matrix of a biodegradable material or a material which releases the incorporated components by diffusion. The components can be homogeneously or heterogeneously distributed within the release system. A variety of release systems may be useful, however, the choice of the appropriate system will depend upon rate of release required by a particular application. Both non-degradable and degradable release systems can be used. Suitable release systems include polymers and polymeric matrices, non-polymeric matrices, or inorganic and organic excipients and diluents such as, but not limited to, calcium carbonate and sugar (for example, trehalose). Release systems may be natural or synthetic. However, synthetic release systems are preferred because generally they are more reliable, more reproducible and produce more defined release profiles. The release system material can be selected so that components having different molecular weights are released by diffusion through or degradation of the material.

Representative synthetic, biodegradable polymers include, for example: polyamides such as poly(amino acids) and poly(peptides); polyesters such as poly(lactic acid), poly(glycolic acid), poly(lactic-co-glycolic acid), and poly(caprolactone); poly(anhydrides); polyorthoesters; polycarbonates; and chemical derivatives thereof (substitutions, additions of chemical groups, for example, alkyl, alkylene, hydroxylations, oxidations, and other modifications routinely made by those skilled in the art), copolymers and mixtures thereof. Representative synthetic, non-degradable polymers include, for example: polyethers such as poly(ethylene oxide), poly(ethylene glycol), and poly(tetramethylene oxide); vinyl polymers-polyacrylates and polymethacrylates such as methyl, ethyl, other alkyl, hydroxyethyl methacrylate, acrylic and methacrylic acids, and others such as poly(vinyl alcohol), poly(vinyl pyrolidone), and poly(vinyl acetate); poly(urethanes); cellulose and its derivatives such as alkyl, hydroxyalkyl, ethers, esters, nitrocellulose, and various cellulose acetates; polysiloxanes; and any chemical derivatives thereof (substitutions, additions of chemical groups, for example, alkyl, alkylene, hydroxylations, oxidations, and other modifications routinely made by those skilled in the art), copolymers and mixtures thereof.

Poly(lactide-co-glycolide) microsphere can also be used for injection. Typically the microspheres are composed of a polymer of lactic acid and glycolic acid, which are structured to form hollow spheres. The spheres can be approximately 15-30 microns in diameter and can be loaded with components described herein.

Bi-Modal or Differential Delivery of Components

Separate delivery of the components of a Cas system, e.g., the Cas9 molecule component and the gRNA molecule component, and more particularly, delivery of the components by differing modes, can enhance performance, e.g., by improving tissue specificity and safety.

In an embodiment, the Cas9 molecule and the gRNA molecule are delivered by different modes, or as sometimes referred to herein as differential modes. Different or differential modes, as used herein, refer modes of delivery that confer different pharmacodynamic or pharmacokinetic properties on the subject component molecule, e.g., a Cas9 molecule, gRNA molecule, or template nucleic acid. For example, the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno-associated virus or lentivirus, delivery.

By way of example, the components, e.g., a Cas9 molecule and a gRNA molecule, can be delivered by modes that differ in terms of resulting half-life or persistent of the delivered component the body, or in a particular compartment, tissue or organ. In an embodiment, a gRNA molecule can be delivered by such modes. The Cas9 molecule component can be delivered by a mode which results in less persistence or less exposure to the body or a particular compartment or tissue or organ.

More generally, in an embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In an embodiment, the first pharmacodynamic or pharmacokinetic property, e.g., distribution, persistence or exposure, is more limited than the second pharmacodynamic or pharmacokinetic property.

In an embodiment, the first mode of delivery is selected to optimize, e.g., minimize, a pharmacodynamic or pharmacokinetic property, e.g., distribution, persistence or exposure.

In an embodiment, the second mode of delivery is selected to optimize, e.g., maximize, a pharmacodynamic or pharmcokinetic property, e.g., distribution, persistence or exposure.

In an embodiment, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In an embodiment, the second mode of delivery comprises a relatively transient element, e.g., an RNA or protein.

In an embodiment, the first component comprises gRNA, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gRNAs are incapable of acting in isolation. The second component, a Cas9 molecule, is delivered in a transient manner, for example as mRNA or as protein, ensuring that the full Cas9 molecule/gRNA molecule complex is only present and active for a short period of time.

Furthermore, the components can be delivered in different molecular form or with different delivery vectors that complement one another to enhance safety and tissue specificity.

Use of differential delivery modes can enhance performance, safety and efficacy. E.g., the likelihood of an eventual off-target modification can be reduced. Delivery of immunogenic components, e.g., Cas9 molecules, by less persistent modes can reduce immunogenicity, as peptides from the bacterially-derived Cas enzyme are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, in an embodiment, a first component, e.g., a gRNA molecule is delivered by a first delivery mode that results in a first spatial, e.g., tissue, distribution. A second component, e.g., a Cas9 molecule is delivered by a second delivery mode that results in a second spatial, e.g., tissue, distribution. In an embodiment, the first mode comprises a first element selected from a liposome, nanoparticle, e.g., polymeric nanoparticle, and a nucleic acid, e.g., viral vector. The second mode comprises a second element selected from the group. In an embodiment, the first mode of delivery comprises a first targeting element, e.g., a cell specific receptor or an antibody, and the second mode of delivery does not include that element. In embodiment, the second mode of delivery comprises a second targeting element, e.g., a second cell specific receptor or second antibody.

When the Cas9 molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 molecule are packaged in separated delivery vehicles with distinct but overlapping tissue tropism, the fully functional complex is only be formed in the tissue that is targeted by both vectors.

Ex Vivo Delivery

In an embodiment, components described in Table 34 are introduced into cells which are then introduced into the subject, e.g., cells are removed from a subject, manipulated ex vivo and then introduced into the subject. Methods of introducing the components can include, e.g., any of the delivery methods described in Table 35.

VIII. Modified Nucleosides, Nucleotides, and Nucleic Acids

Modified nucleosides and modified nucleotides can be present in nucleic acids, e.g., particularly gRNA, but also other forms of RNA, e.g., mRNA, RNAi, or siRNA. As described herein, "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:

(i) alteration, e.g., replacement, of one or both of the non-linking phosphate oxygens and/or of one or more of the linking phosphate oxygens in the phosphodiester backbone linkage;

(ii) alteration, e.g., replacement, of a constituent of the ribose sugar. e.g., of the 2' hydroxyl on the ribose sugar;

(iii) wholesale replacement of the phosphate moiety with "dephospho" linkers;

(iv) modification or replacement of a naturally occurring nucleobase;

(v) replacement or modification of the ribose-phosphate backbone;

(vi) modification of the 3' end or 5' end of the oligonucleotide, e.g., removal, modification or replacement of a terminal phosphate group or conjugation of a moiety; and (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In an embodiment, every base of a gRNA is modified, e.g., all bases have a modified phosphate group, e.g., all are phosphorothioate groups. In an embodiment, all, or substantially all, of the phosphate groups of a unimolecular or modular gRNA molecule are replaced with phosphorothioate groups.

In an embodiment, modified nucleotides, e.g., nucleotides having modifications as described herein, can be incorporated into a nucleic acid, e.g., a "modified nucleic acid." In an embodiment, the modified nucleic acids comprise one, two, three or more modified nucleotides. In an embodiment, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In an embodiment, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In an embodiment, the modified nucleosides, modified nucleotides, and modified nucleic acids described herein can disrupt binding of a major groove interacting partner with the nucleic acid. In an embodiment, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In an embodiment, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications

The Phosphate Group

In an embodiment, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In an embodiment, the modification of the phosphate backbone can include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. In an embodiment, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide diastereomers. In an embodiment, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In an embodiment, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In an embodiment, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In an embodiment, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O)_nCH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In an embodiment, the "oxy"-2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In an embodiment, the "oxy"-2' hydroxyl group modification can include the methoxyethyl group (MOE), ($OCH_2CH_2OCH_3$, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH_2CH_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleosides. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g. L-nucleosides.

Generally, RNA includes the sugar group ribose, which is a 5-membered ring having an oxygen. Exemplary modified nucleosides and modified nucleotides can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In an embodiment, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with α-L-threofuranosyl-(3'→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In an embodiment, the nucleobase can include, for example, naturally-occurring and synthetic derivatives of a base.

Uracil

In an embodiment, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine (ho$^5$U), 5-aminoallyl-uridine, 5-halo-uridine (e.g., 5-iodo-uridine or 5-bromo-uridine), 3-methyl-uridine (m$^3$U), 5-methoxy-uridine (mo$^5$U), uridine 5-oxyacetic acid (cmo$^5$U), uridine 5-oxyacetic acid methyl ester (mcmo$^5$U), 5-carboxymethyl-uridine (cm$^5$U), 1-carboxymethyl-pseudouridine, 5-carboxyhydroxymethyl-uridine (chm$^5$U), 5-carboxyhydroxymethyl-uridine methyl ester (mchm$^5$U), 5-methoxycarbonylmethyl-uridine (mcm$^5$U), 5-methoxycarbonylmethyl-2-thio-uridine (mcm$^5$s2U), 5-aminomethyl-2-thio-uridine (nm$^5$s2U), 5-methylaminomethyl-uridine (mnm$^5$U), 5-methylaminomethyl-2-thio-uridine (mnm$^5$s2U), 5-methylaminomethyl-2-seleno-uridine (mnm$^5$se2U), 5-carbamoylmethyl-uridine (ncm$^5$U), 5-carboxymethylaminomethyl-uridine (cmnm$^5$U), 5-carboxymethylaminomethyl-2-thio-uridine (cmnm$^5$s2U), 5-propynyl-uridine, 1-propynyl-pseudouridine, 5-taurinomethyl-uridine (τcm$^5$U), 1-taurinomethyl-pseudouridine, 5-taurinomethyl-2-thio-uridine(τm$^5$s2U), 1-taurinomethyl-4-thio-pseudouridine, 5-methyl-uridine (m$^5$U, i.e., having the nucleobase deoxythymine), 1-methyl-pseudouridine (m$^1$ψ), 5-methyl-2-thio-uridine (m$^5$s2U), 1-methyl-4-thio-pseudouridine (m$^1$s$^4$ψ), 4-thio-1-methyl-pseudouridine, 3-methyl-pseudouridine (m$^3$ψ), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m$^5$D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl)uridine (acp$^3$U), 1-methyl-3-(3-amino-3-carboxypropyl)pseudouridine (acp$^3$ψ), 5-(isopentenylaminomethyl)uridine (inm$^5$U), 5-(isopentenylaminomethyl)-2-thio-uridine (inm$^5$s2U), α-thio-uridine, 2'-O-methyl-uridine (Um), 5,2'-O-dimethyl-uridine (m$^5$Um), 2'-O-methyl-pseudouridine (ψm), 2-thio-2'-O-methyl-uridine (s2Um), 5-methoxycarbonylmethyl-2'-O-methyl-uridine (mcm$^5$Um), 5-carbamoylmethyl-2'-O-methyl-uridine (ncm$^5$Um), 5-carboxymethylaminomethyl-2'-O-methyl-uridine (cmnm$^5$Um), 3,2'-O-dimethyl-uridine (m$^3$Um), 5-(isopentenylaminomethyl)-2'-O-methyl-uridine (inm$^5$Um), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

Cytosine

In an embodiment, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m$^3$C), N4-acetyl-cytidine (act), 5-formyl-cytidine (f$^5$C), N4-methyl-cytidine (m$^4$C), 5-methyl-cytidine (m$^5$C), 5-halo-cytidine (e.g., 5-iodo-cytidine), 5-hydroxymethyl-cytidine (hm$^5$C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k$^2$C), α-thio-cytidine, 2'-O-methyl-cytidine (Cm), 5,2'-O-dimethyl-cytidine (m$^5$Cm), N4-acetyl-2'-O-methyl-cytidine (ac⁴Cm), N4,2'-O-dimethyl-cytidine (m⁴Cm), 5-formyl-2'-O-methyl-cytidine (f⁵Cm), N4,N4,2'-O-trimethyl-cytidine (m⁴₂Cm), 1-thio-cytidine, 2'-F-ara-cytidine, 2'-F-cytidine, and 2'-OH-ara-cytidine.

Adenine

In an embodiment, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenosine, 7-deaza-8-aza-adenosine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m¹A), 2-methyl-adenosine (m²A), N6-methyl-adenosine (m⁶A), 2-methylthio-N6-methyl-adenosine (ms2m⁶A), N6-isopentenyl-adenosine (i⁶A), 2-methylthio-N6-isopentenyl-adenosine (ms²i⁶A), N6-(cis-hydroxyisopentenyl)adenosine (io⁶A), 2-methylthio-N6-(cis-hydroxyisopentenyl)adenosine (ms2io⁶A), N6-glycinylcarbamoyl-adenosine (g⁶A), N6-threonylcarbamoyl-adenosine (t⁶A), N6-methyl-N6-threonylcarbamoyl-adenosine (m⁶t⁶A), 2-methylthio-N6-threonylcarbamoyl-adenosine (ms²g⁶A), N6,N6-dimethyl-adenosine (m⁶₂A), N6-hydroxynorvalylcarbamoyl-adenosine (hn⁶A), 2-methylthio-N6-hydroxynorvalylcarbamoyl-adenosine (ms2hn⁶A), N6-acetyl-adenosine (ac⁶A), 7-methyl-adenosine, 2-methylthio-adenosine, 2-methoxy-adenosine, α-thio-adenosine, 2'-O-methyl-adenosine (Am), N⁶,2'-O-dimethyl-adenosine (m⁶Am), N⁶-Methyl-2'-deoxyadenosine, N6,N6,2'-O-trimethyl-adenosine (m⁶₂Am), 1,2'-O-dimethyl-adenosine (m¹Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In an embodiment, the modified nucleobase is a modified guanine. Exemplary nucleobases and nucleosides having a modified guanine include without limitation inosine (I), 1-methyl-inosine (m¹I), wyosine (imG), methylwyosine (mimG), 4-demethyl-wyosine (imG-14), isowyosine (imG2), wybutosine (yW), peroxywybutosine (o₂yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQ₀), 7-aminomethyl-7-deaza-guanosine (preQ₁), archaeosine (G⁺), 7-deaza-8-aza-guanosine, 6-thio-guanosine, 6-thio-7-deaza-guanosine, 6-thio-7-deaza-8-aza-guanosine, 7-methyl-guanosine (m⁷G), 6-thio-7-methyl-guanosine, 7-methyl-inosine, 6-methoxy-guanosine, 1-methyl-guanosine (m'G), N2-methyl-guanosine (m²G), N2,N2-dimethyl-guanosine (m²₂G), N2,7-dimethyl-guanosine (m²,7G), N2,N2,7-dimethyl-guanosine (m²,2,7G), 8-oxo-guanosine, 7-methyl-8-oxo-guanosine, 1-methyl-6-thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m²Gm), N2,N2-dimethyl-2'-O-methyl-guanosine (m²₂Gm), 1-methyl-2'-O-methyl-guanosine (m'Gm), N2,7-dimethyl-2'-O-methyl-guanosine (m²,7Gm), 2'-O-methyl-inosine (Im), 1,2'-O-dimethyl-inosine (m'Im), O⁶-phenyl-2'-deoxyinosine, 2'-O-ribosylguanosine (phosphate) (Gr(p)), 1-thio-guanosine, O⁶-methyl-guanosine, O⁶-Methyl-2'-deoxyguanosine, 2'-F-ara-guanosine, and 2'-F-guanosine.

Exemplary Modified gRNAs

In some embodiments, the modified nucleic acids can be modified gRNAs. It is to be understood that any of the gRNAs described herein can be modified in accordance with this section, including any gRNA that comprises a targeting domain from Tables 1A-1D, 2A-2F, 3A-3C, 4A-4E, 5A-5E, 6A-6B, 7A-7D, 8A-8D, 9, 10A-10D, 11A-11D, 12, 13A-13D, 14A-14C, 15A-15D, 16A-16E, 17A-17B, 18A-18C, 19A-19E, 20A-20C, 21A-21E, 22A-22E, 23A-23C, 24A-24D, 25A-25B, 26, or 31.

As discussed above, transiently expressed or delivered nucleic acids can be prone to degradation by, e.g., cellular nucleases. Accordingly, in one aspect the modified gRNAs described herein can contain one or more modified nucleosides or nucleotides which introduce stability toward nucleases. While not wishing to be bound by theory it is also believed that certain modified gRNAs described herein can exhibit a reduced innate immune response when introduced into a population of cells, particularly the cells of the present invention. As noted above, the term "innate immune response" includes a cellular response to exogenous nucleic acids, including single stranded nucleic acids, generally of viral or bacterial origin, which involves the induction of cytokine expression and release, particularly the interferons, and cell death.

While some of the exemplary modification discussed in this section may be included at any position within the gRNA sequence, in some embodiments, a gRNA comprises a modification at or near its 5' end (e.g., within 1-10, 1-5, or 1-2 nucleotides of its 5' end). In some embodiments, a gRNA comprises a modification at or near its 3' end (e.g., within 1-10, 1-5, or 1-2 nucleotides of its 3' end). In some embodiments, a gRNA comprises both a modification at or near its 5' end and a modification at or near its 3' end.

In an embodiment, the 5' end of a gRNA is modified by the inclusion of a eukaryotic mRNA cap structure or cap analog (e.g., a G(5')ppp(5')G cap analog, a m7G(5')ppp(5')G cap analog, or a 3'-O-Me-m7G(5')ppp(5')G anti reverse cap analog (ARCA)). The cap or cap analog can be included during either chemical synthesis or in vitro transcription of the gRNA.

In an embodiment, an in vitro transcribed gRNA is modified by treatment with a phosphatase (e.g., calf intestinal alkaline phosphatase) to remove the 5' triphosphate group.

In an embodiment, the 3' end of a gRNA is modified by the addition of one or more (e.g., 25-200) adenine (A) residues. The polyA tract can be contained in the nucleic acid (e.g., plasmid, PCR product, viral genome) encoding the gRNA, or can be added to the gRNA during chemical synthesis, or following in vitro transcription using a polyadenosine polymerase (e.g., *E. coli* Poly(A)Polymerase).

In an embodiment, in vitro transcribed gRNA contains both a 5' cap structure or cap analog and a 3' polyA tract. In an embodiment, an in vitro transcribed gRNA is modified by treatment with a phosphatase (e.g., calf intestinal alkaline phosphatase) to remove the 5' triphosphate group and comprises a 3' polyA tract.

In some embodiments, gRNAs can be modified at a 3' terminal U ribose. For example, the two terminal hydroxyl groups of the U ribose can be oxidized to aldehyde groups and a concomitant opening of the ribose ring to afford a modified nucleoside as shown below:

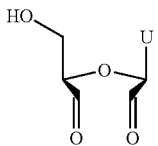

wherein "U" can be an unmodified or modified uridine.

In another embodiment, the 3' terminal U can be modified with a 2'3' cyclic phosphate as shown below:

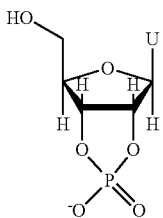

wherein "U" can be an unmodified or modified uridine.

In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein.

In some embodiments, sugar-modified ribonucleotides can be incorporated into the gRNA, e.g., wherein the 2' OH-group is replaced by a group selected from H, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., NH$_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, one or more of the nucleotides of the gRNA can each independently be a modified or unmodified nucleotide including, but not limited to 2'-sugar modified, such as, 2'-O-methyl, 2'-O-methoxyethyl, or 2'-Fluoro modified including, e.g., 2'-F or 2'-O-methyl, adenosine (A), 2'-F or 2'-O-methyl, cytidine (C), 2'-F or 2'-O-methyl, uridine (U), 2'-F or 2'-O-methyl, thymidine (T), 2'-F or 2'-O-methyl, guanosine (G), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In some embodiments, a gRNA can include "locked" nucleic acids (LNA) in which the 2' OH-group can be connected, e.g., by a C1-6 alkylene or C1-6 heteroalkylene bridge, to the 4' carbon of the same ribose sugar, where exemplary bridges can include methylene, propylene, ether, or amino bridges; O-amino (wherein amino can be, e.g., NH$_2$; alkylamino, dialkylamino, heterocyclyl, arylamino, diarylamino, heteroarylamino, or diheteroarylamino, ethylenediamine, or polyamino) and aminoalkoxy or O(CH$_2$)$_n$-amino (wherein amino can be, e.g., NH$_2$; alkylamino, dialkylamino, heterocyclyl, arylamino, diarylamino, heteroarylamino, or diheteroarylamino, ethylenediamine, or polyamino).

In some embodiments, a gRNA can include a modified nucleotide which is multicyclic (e.g., tricyclo; and "unlocked" forms, such as glycol nucleic acid (GNA) (e.g., R-GNA or S-GNA, where ribose is replaced by glycol units attached to phosphodiester bonds), or threose nucleic acid (TNA, where ribose is replaced with α-L-threofuranosyl-(3'→2')).

Generally, gRNA molecules include the sugar group ribose, which is a 5-membered ring having an oxygen. Exemplary modified gRNAs can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). Although the majority of sugar analog alterations are localized to the 2' position, other sites are amenable to modification, including the 4' position. In an embodiment, a gRNA comprises a 4'-S, 4'-Se or a 4'-C-aminomethyl-2'-O-Me modification.

In some embodiments, deaza nucleotides, e.g., 7-deaza-adenosine, can be incorporated into the gRNA. In some embodiments, O- and N-alkylated nucleotides, e.g., N6-methyl adenosine, can be incorporated into the gRNA. In some embodiments, one or more or all of the nucleotides in a gRNA molecule are deoxynucleotides.

miRNA Binding Sites microRNAs (or miRNAs) are naturally occurring cellular 19-25 nucleotide long noncoding RNAs. They bind to nucleic acid molecules having an appropriate miRNA binding site, e.g., in the 3' UTR of an mRNA, and down-regulate gene expression. While not wishing to be bound by theory it is believed that the down regulation is either by reducing nucleic acid molecule stability or by inhibiting translation. An RNA species disclosed herein, e.g., an mRNA encoding Cas9 can comprise an miRNA binding site, e.g., in its 3'UTR. The miRNA binding site can be selected to promote down regulation of expression is a selected cell type. By way of example, the incorporation of a binding site for miR-122, a microRNA abundant in liver, can inhibit the expression of the gene of interest in the liver.

EXAMPLES

The following Examples are merely illustrative and are not intended to limit the scope or content of the invention in any way.

Example 1

Cloning and Initial Screening of gRNAs

The suitability of candidate gRNAs can be evaluated as described in this example. Although described for a chimeric gRNA, the approach can also be used to evaluate modular gRNAs.

Cloning gRNAs into Vectors

For each gRNA, a pair of overlapping oligonucleotides is designed and obtained. Oligonucleotides are annealed and ligated into a digested vector backbone containing an upstream U6 promoter and the remaining sequence of a long chimeric gRNA. Plasmid is sequence-verified and prepped to generate sufficient amounts of transfection-quality DNA. Alternate promoters maybe used to drive in vivo transcription (e.g. H1 promoter) or for in vitro transcription (e.g., a T7 promoter).

Cloning gRNAs in Linear dsDNA Molecule (STITCHR)

For each gRNA, a single oligonucleotide is designed and obtained. The U6 promoter and the gRNA scaffold (e.g. including everything except the targeting domain, e.g., including sequences derived from the crRNA and tracrRNA, e.g., including a first complementarity domain; a linking domain; a second complementarity domain; a proximal domain; and a tail domain) are separately PCR amplified and purified as dsDNA molecules. The gRNA-specific oligonucleotide is used in a PCR reaction to stitch together the U6 and the gRNA scaffold, linked by the targeting domain specified in the oligonucleotide. Resulting dsDNA molecule (STITCHR product) is purified for transfection. Alternate promoters may be used to drive in vivo transcription (e.g., H1 promoter) or for in vitro transcription (e.g., T7 promoter). Any gRNA scaffold may be used to create gRNAs compatible with Cas9s from any bacterial species.

Initial gRNA Screen

Each gRNA to be tested is transfected, along with a plasmid expressing Cas9 and a small amount of a GFP-expressing plasmid into human cells. In preliminary experiments, these cells can be immortalized human cell lines such as 293T, K562 or U2OS. Alternatively, primary human cells may be used. In this case, cells may be relevant to the eventual therapeutic cell target (for example, an erythroid cell). The use of primary cells similar to the potential therapeutic target cell population may provide important information on gene targeting rates in the context of endogenous chromatin and gene expression.

Transfection may be performed using lipid transfection (such as Lipofectamine or Fugene) or by electroporation (such as Lonza Nucleofection). Following transfection, GFP expression can be determined either by fluorescence microscopy or by flow cytometry to confirm consistent and high levels of transfection. These preliminary transfections can comprise different gRNAs and different targeting approaches (17-mers, 20-mers, nuclease, dual-nickase, etc.) to determine which gRNAs/combinations of gRNAs give the greatest activity.

Efficiency of cleavage with each gRNA may be assessed by measuring NHEJ-induced indel formation at the target locus by a T7E1-type assay or by sequencing. Alternatively, other mismatch-sensitive enzymes, such as Cell/Surveyor nuclease, may also be used.

For the T7E1 assay, PCR amplicons are approximately 500-700 bp with the intended cut site placed asymmetrically in the amplicon. Following amplification, purification and size-verification of PCR products, DNA is denatured and re-hybridized by heating to 95° C. and then slowly cooling. Hybridized PCR products are then digested with T7 Endonuclease I (or other mismatch-sensitive enzyme) which recognizes and cleaves non-perfectly matched DNA. If indels are present in the original template DNA, when the amplicons are denatured and re-annealed, this results in the hybridization of DNA strands harboring different indels and therefore lead to double-stranded DNA that is not perfectly matched. Digestion products may be visualized by gel electrophoresis or by capillary electrophoresis. The fraction of DNA that is cleaved (density of cleavage products divided by the density of cleaved and uncleaved) may be used to estimate a percent NHEJ using the following equation: % NHEJ=$(1-(1-\text{fraction cleaved})^{1/2})$. The T7E1 assay is sensitive down to about 2-5% NHEJ.

Sequencing may be used instead of, or in addition to, the T7E1 assay. For Sanger sequencing, purified PCR amplicons are cloned into a plasmid backbone, transformed, miniprepped and sequenced with a single primer. Sanger sequencing may be used for determining the exact nature of indels after determining the NHEJ rate by T7E1.

Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low NHEJ rates.

Example 2

Assessment of Gene Targeting by NHEJ

The gRNAs that induce the greatest levels of NHEJ in initial tests can be selected for further evaluation of gene targeting efficiency. In this case, cells are derived from disease subjects and, therefore, harbor the relevant mutation.

Following transfection (usually 2-3 days post-transfection) genomic DNA may be isolated from a bulk population of transfected cells and PCR may be used to amplify the target region. Following PCR, gene targeting efficiency to generate the desired mutations (either knockout of a target gene or removal of a target sequence motif) may be determined by sequencing. For Sanger sequencing, PCR amplicons may be 500-700 bp long. For next generation sequencing, PCR amplicons may be 300-500 bp long. If the goal is to knockout gene function, sequencing may be used to assess what percent of alleles have undergone NHEJ-induced indels that result in a frameshift or large deletion or insertion that would be expected to destroy gene function. If the goal is to remove a specific sequence motif, sequencing may be used to assess what percent of alleles have undergone NHEJ-induced deletions that span this sequence.

Example 3

Assessment of Gene Targeting by HDR

The gRNAs that induce the greatest levels of NHEJ in initial tests can be selected for further evaluation of gene targeting efficiency. In this case, cells are derived from disease subjects and, therefore, harbor the relevant mutation.

Following transfection (usually 2-3 days post-transfection) genomic DNA may be isolated from a bulk population of transfected cells and PCR may be used to amplify the target region. Following PCR, gene targeting efficiency can be determined by several methods.

Determination of gene targeting frequency involves measuring the percentage of alleles that have undergone homologous directed repair (HDR) with the exogenously provided donor template or endogenous genomic donor sequence and which therefore have incorporated the desired correction. If the desired HDR event creates or destroys a restriction enzyme site, the frequency of gene targeting may be determined by a RFLP assay. If no restriction site is created or destroyed, sequencing may be used to determine gene targeting frequency. If a RFLP assay is used, sequencing may still be used to verify the desired HDR event and ensure that no other mutations are present. If an exogenously provided donor template is employed, at least one of the primers is placed in the endogenous gene sequence outside of the region included in the homology arms, which prevents amplification of donor template still present in the cells. Therefore, the length of the homology arms present in the donor template may affect the length of the PCR amplicon. PCR amplicons can either span the entire donor region (both primers placed outside the homology arms) or they can span only part of the donor region and a single junction between donor and endogenous DNA (one internal and one external primer). If the amplicons span less than the entire donor region, two different PCRs should be used to amplify and sequence both the 5' and the 3' junction.

If the PCR amplicon is short (less than 600 bp) it is possible to use next generation sequencing. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low gene targeting rates.

If the PCR amplicon is too long for next generation sequencing, Sanger sequencing can be performed. For Sanger sequencing, purified PCR amplicons will be cloned into a plasmid backbone (for example, TOPO cloned using the LifeTech Zero Blunt® TOPO® cloning kit), transformed, miniprepped and sequenced.

The same or similar assays described above can be used to measure the percentage of alleles that have undergone HDR with endogenous genomic donor sequence and which therefore have incorporated the desired correction.

Example 4

Screening of gRNAs for Targeting BCL11A

In order to identify gRNAs with the highest on target NHEJ efficiency, thirty exemplary *S. pyogenes* gRNAs were selected for testing (Table 31). The gRNAs tested target three different regions of the BCL11A locus—5' of a red blood cell enhancer, 3' of a red blood cell enhancer and downstream of the ATG start codon in exon 2 (specified in Table 31).

TABLE 31

| gRNA Name | Targeting Sequence | Size | Gene Region | SEQ ID NO |
|---|---|---|---|---|
| BCL11A-2981W | GUGCUACUUAUACAAUUCAC | 20 | 3' of enhancer | 16261 |
| BCL11A-2982W | GAAAAUACUUACUGUACUGC | 20 | 3' of enhancer | 16262 |
| BCL11A-2983W | GGCUGUUUUGGAAUGUAGAG | 20 | 5' of enhancer | 16263 |
| BCL11A-2984W | AUUCACUGGAAACCCUGUUA | 20 | 3' of enhancer | 16264 |
| BCL11A-2985W | UACUGUACUGCAGGGGAAUU | 20 | 3' of enhancer | 16265 |
| BCL11A-2986W | AAACUAUUUACAGCCAUAAC | 20 | 3' of enhancer | 16266 |
| BCL11A-2987W | AAAUACUUACUGUACUGCAG | 20 | 3' of enhancer | 16267 |
| BCL11A-2988W | CUAUUUACAGCCAUAAC | 17 | 3' of enhancer | 16268 |
| BCL11A-2989W | CUACUUAUACAAUUCAC | 17 | 3' of enhancer | 16269 |
| BCL11A-2990W | CACUGGAAACCCUGUUA | 17 | 3' of enhancer | 16270 |
| BCL11A-2991W | UACUUACUGUACUGCAG | 17 | 3' of enhancer | 16271 |
| BCL11A-2992W | UGUACUGCAGGGGAAUU | 17 | 3' of enhancer | 16272 |
| BCL11A-2993W | AAUACUUACUGUACUGC | 17 | 3' of enhancer | 16273 |
| BCL11A-2994W | AUACUUACUGUACUGCA | 17 | 3' of enhancer | 16274 |
| BCL11A-2995W | GAAUGUAGAGAGGCAGA | 17 | 5' of enhancer | 16275 |
| BCL11A-2996W | GGAAUGUAGAGAGGCAG | 17 | 5' of enhancer | 16276 |
| BCL11A-2997W | GUAAGUAUUUUCUUUCAUUG | 20 | 3' of enhancer | 16277 |
| BCL11A-2998W | GUAAUUAAGAAAGCAGUGUA | 20 | 5' of enhancer | 16278 |
| BCL11A-2999W | GUAUUUUCUUUCAUUGG | 17 | 3' of enhancer | 16279 |
| BCL11A-32W | UGGCAUCCAGGUCACGCCAG | 20 | Exon 2 | 16280 |
| BCL11A-40W | GAUGCUUUUUUCAUCUCGAU | 20 | Exon 2 | 16281 |
| BCL11A-30W | GCAUCCAAUCCCGUGGAGGU | 20 | Exon 2 | 16282 |
| BCL11A-42W | UUUUCAUCUCGAUUGGUGAA | 20 | Exon 2 | 16283 |
| BCL11A-24W | CCAGAUGAACUUCCCAUUGG | 20 | Exon 2 | 16284 |
| BCL11A-53W | AGGAGGUCAUGAUCCCCUUC | 20 | Exon 2 | 16285 |

TABLE 31-continued

| gRNA Name | Targeting Sequence | Size | Gene Region | SEQ ID NO |
|---|---|---|---|---|
| BCL11A-79W | CAUCCAGGUCACGCCAG | 17 | Exon 2 | 16286 |
| BCL11A-90W | GCUUUUUUCAUCUCGAU | 17 | Exon 2 | 16287 |
| BCL11A-77W | UCCAAUCCCGUGGAGGU | 17 | Exon 2 | 16288 |
| BCL11A-92W | UCAUCUCGAUUGGUGAA | 17 | Exon 2 | 16289 |
| BCL11A-71W | GAUGAACUUCCCAUUGG | 17 | Exon 2 | 16290 |

A DNA template comprised of an exemplary gRNA (including the target region and the *S. pyogenes* TRACR sequence) under the control of a U6 promoter was generated by a PCR StitchR reaction. This DNA template was subsequently transfected into 293 cells using Lipofectamine 3000 along with a DNA plasmid encoding the *S. pyogenes* Cas9 downstream of a CMV promoter. Genomic DNA was isolated from the cells 48-72 hours post transfection. To determine the rate of modification at the BCL11A locus, the target region was amplified using a locus PCR with the primers listed in Table 32.

TABLE 32

| Primer Sequence | Exon |
|---|---|
| TGCCTACATCTGATTCAGTGA GG (SEQ ID NO: 16291) | BCL11A exon 2 5' primer |
| TGCCTCATTGACAAATTTGC TC (SEQ ID NO: 16292) | BCL11A exon 2 3' primer |
| AGACCGTCTCTTTGGTGCAG (SEQ ID NO: 16293) | BCL11A 5' enhancer 5' primer |
| GCAGTGGCTTTAGGCTGTTT (SEQ ID NO: 16294) | BCL11A 5' enhancer 3' primer |
| GTGTGATCTCGGCTCACCAC (SEQ ID NO: 16295) | BCL11A 3' enhancer 5' primer |
| CCCTGACTTTGGAGCTCAGC (SEQ ID NO: 16296) | BCL11A 3' enhancer 3' primer |

Figure 11:
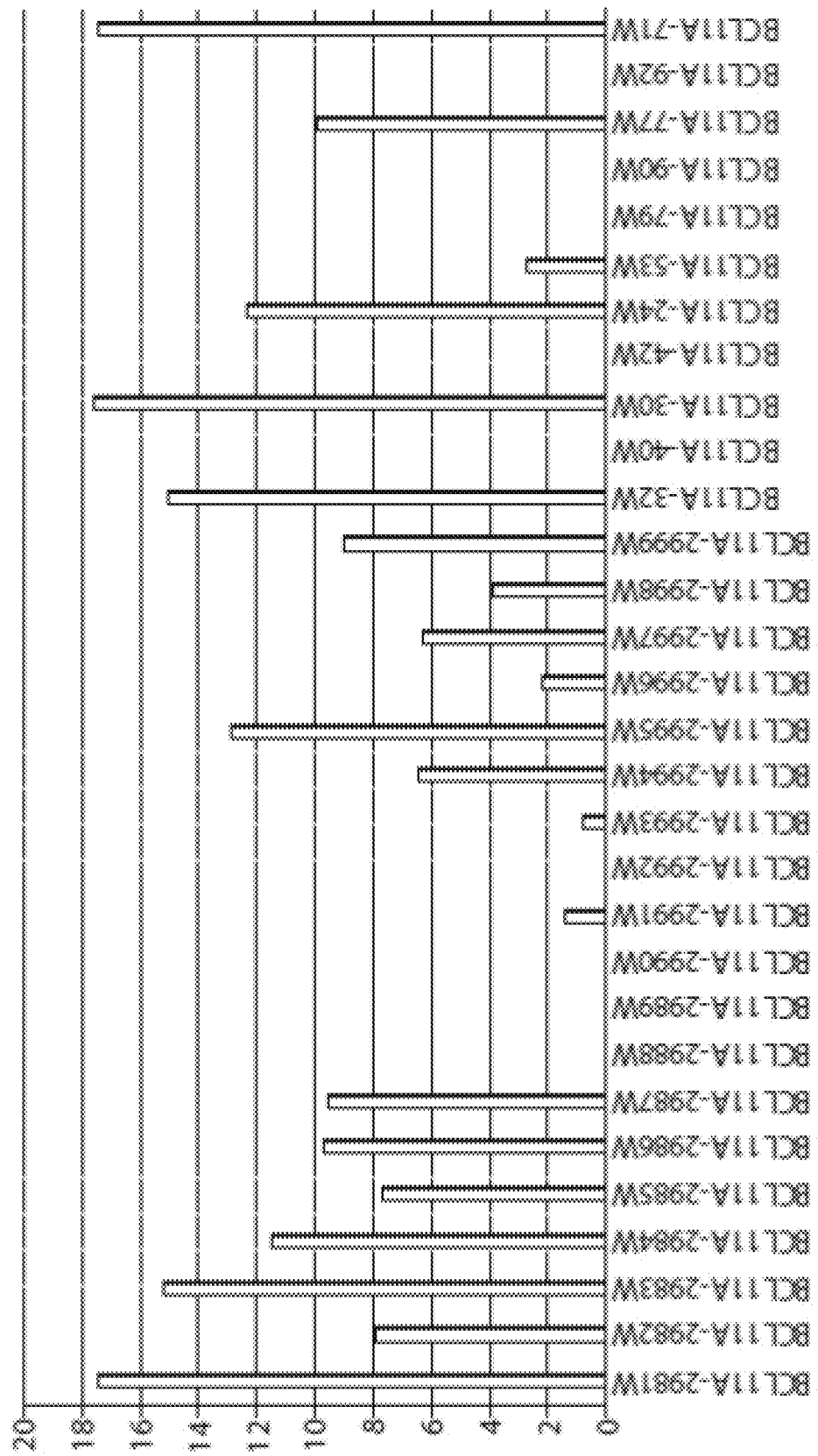
FIG. 11 depicts the efficiency of NHEJ mediated by a Cas9 molecule and exemplary gRNA molecules targeting three different regions of the BCL11A locus.
Figure 12A:
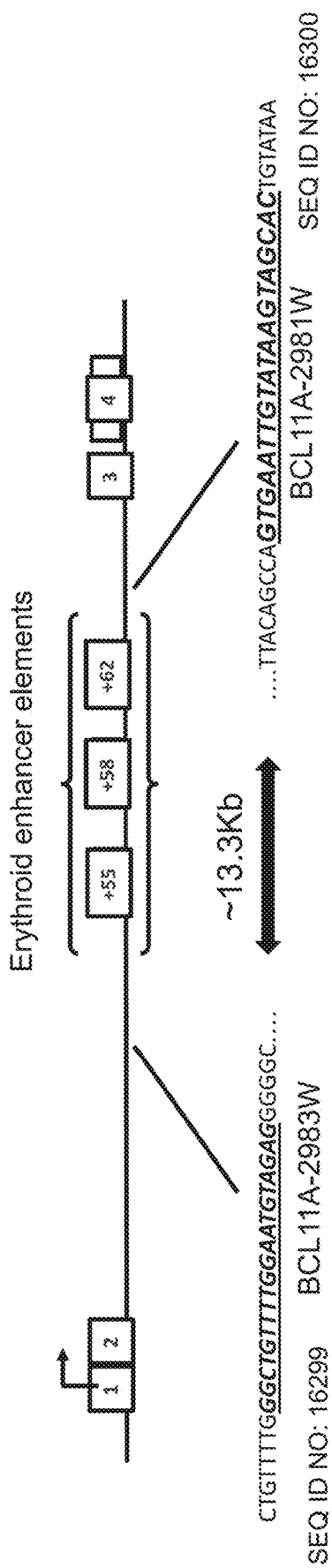
Figure 13A:
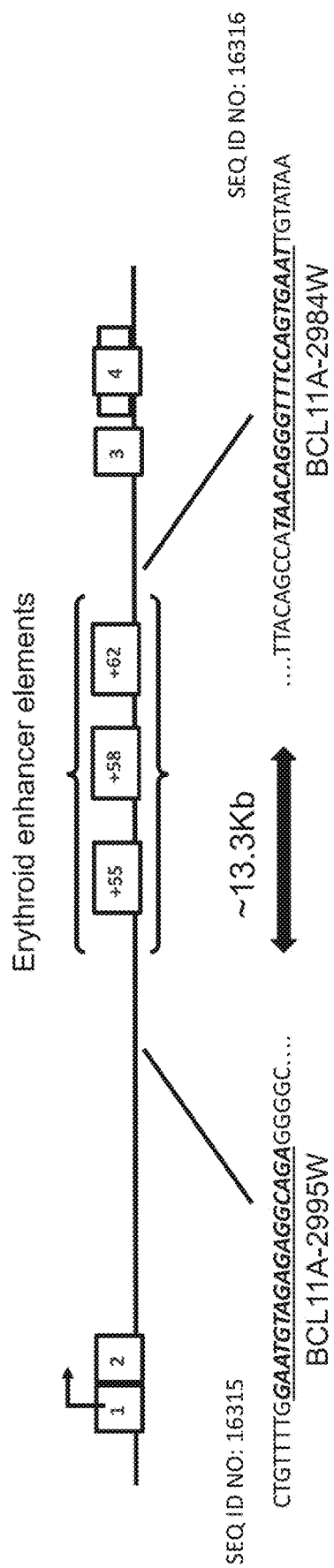

After PCR amplification, a T7E1-directed mismatch cleavage assay was performed on the PCR product. Briefly, this assay involves melting the PCR product followed by a re-annealing step. If gene modification has occurred, there will exist double stranded products that are not perfect matches due to some frequency of insertions or deletions. These double stranded products are sensitive to cleavage by a T7 endonuclease 1 enzyme at the site of mismatch. Therefore, the efficiency of cutting by the Cas9/gRNA complex was determined by analyzing the amount of T7E1 cleavage. The formula that was used to provide a measure of % NHEJ from the T7E1 cutting is the following: 100*(1−(1−(fraction cleaved))^0.5). The results of this analysis are shown in FIG. 11. The top performing gRNAs in this assay were BCL11A-2981, BCL11A-2983, BCL11A-2995, BCL11A-32, BCL11A-30, and BCL11A-71.

Example 5

Deletion of the Erythroid Enhancer Elements Using Two gRNAs Flanking the Sequence In order to test whether the erythroid enhancer sequence can be deleted using a two gRNA approach, two pairs of gRNAs were tested in 293 cells. Pair number 1 comprised BCL11A-2983W and BCL11A-2981W while Pair number 2 comprised BCL11A-2995W and BCL11A-2984W. In this example, a plasmid encoding *S. pyogenes* Cas9 downstream of a CMV promoter was delivered with either gRNA pair 1 or gRNA pair 2. The gRNAs were delivered as separate STITCHR products with each template comprising the U6 promoter, gRNA target sequence and *S. pyogenes* TRACR sequence. The DNA templates were delivered to 293 cells using lipid transfection (Lipofectamine 3000, Life Technologies). 72 hours post transfection, the cells were harvested and gDNA was isolated. To detect the deletion of the enhancer region of BCL11A, PCR primers flanking the enhancer sequences were used to amplify the deletion event. The PCR product was TOPO cloned and sequenced by Sanger sequencing. The results of these analyses are presented in FIG. 12A-13B. As shown in FIG. 12A-13B, the deletion for both gRNA pairs that were delivered to the 293 cells were detected.

Example 6

Gene Targeting of the HBB Locus by CRISPR/Cas9 to Investigate Repair Pathway Choice in Response to Different Types of DNA Lesions The CRISPR/Cas9 system was used to target the human HBB gene in the region of the sickle cell anemia-causing mutation.

To examine how the nature of the targeted break affects the frequency of different DNA repair outcomes, blunt double-strand breaks, single-strand nicks, and dual-nicks in which the nicks are placed on opposite strands and leave either 3' or 5' overhangs of varying lengths, were introduced by utilizing the wild type Cas9 nuclease, as well as two different Cas9 nickases. Several different DNA repair outcomes including indel mutations resulting from non-homologous end-joining, homology-dependent repair (HDR) using the donor as a template, and HDR using the closely related HBD gene as an endogenous template, were characterized using either single-strand oligonucleotide (ssODN) or plasmid DNA donors. The frequency of these various repair outcomes under different conditions offer insight into the mechanisms of DNA repair and how it is impacted by the nature of the DNA break. The data also indicates a therapeutic approach in which correction of the sickle-cell mutation is efficiently mediated through HDR with either a donor template or with the HBD gene.

In this study different gRNA for the HBB region that surrounds the nucleotides encoding the amino acid most commonly mutated in sickle cell disease had been tested in 293T cells with wild type Cas9 molecule. The gRNAs that induced similar high rates of NHEJ and had PAMs facing in opposite orientations were selected to test as pairs with Cas9 D10A and Cas9 N863A nickases.

Figure 14:
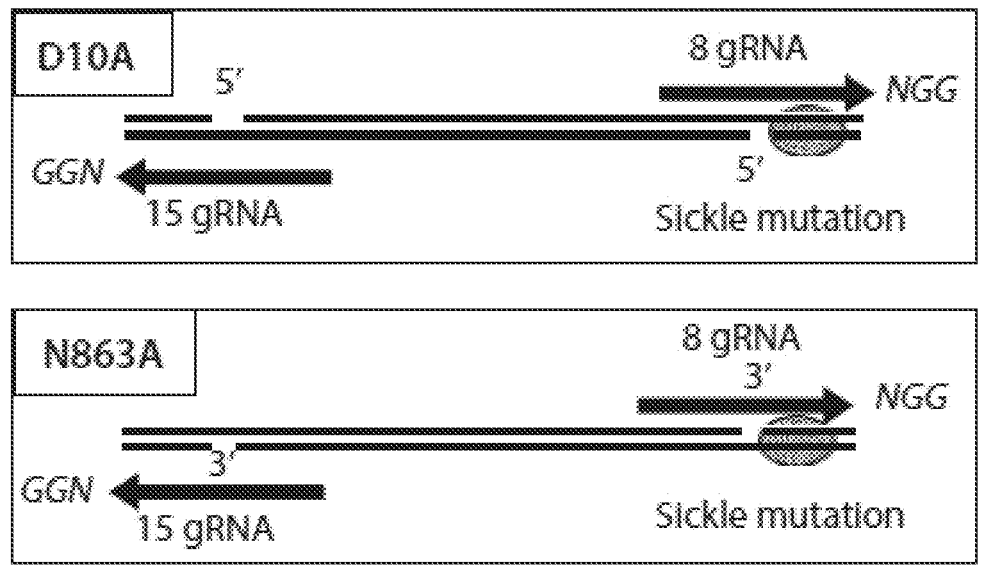
FIG. 14 depicts a scheme of the pair 8/15 of gRNAs surrounding the sickle mutation in combination with a Cas9 nickase (D10A or N863A). The nickases are shown as the grey ovals.

As shown in FIG. 14, the gRNA pair 8/15 ("8gRNA"/"15gRNA" pair) was selected as one of the best pairs of gRNA. "8gRNA" has the targeting domain sequence of GUAACGGCAGACUUCUCCUC (SEQ ID NO: 388) and "15gRNA" has the targeting domain sequence of AAGGUGAACGUGGAUGAAGU (SEQ ID NO: 387). This pair of gRNAs in combination with the mutant Cas9 D10A would generate a 5' overhang of 47 bp, and in combination with the mutant N863A would generate a 3' overhang of 47 bp.

In this Example, U20S cells were electroporated with 200 ng of each gRNA and 750 ng of plasmid that encodes wild type Cas9 or mutant Cas9. Cells were collected 6 days after electroporation and genomic DNA was extracted. PCR amplification of the HBB locus was performed and subcloned into a Topo Blunt Vector. For each condition in each experiment 96 colonies were sequenced with Sanger sequencing. In the experiments assessing HDR efficacy, cells were electroporated with 2.5 ug of single stranded oligo or double stranded oligo in addition to the gRNA and the Cas9-encoding plasmid.

Figure 15:
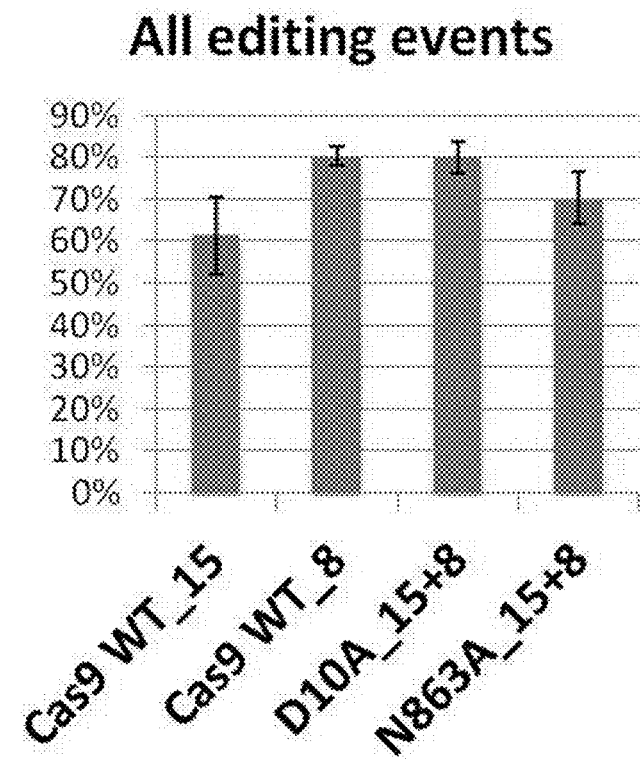
FIG. 15 depicts the percentages of total editing event after a wildtype Cas9 or a Cas9 nickase (D10A or N863A). A prepentation of at least three independent experiments for each condition is shown.

As shown in FIG. 15, the total percentages of all editing events detected by Sanger sequencing of the HBB locus were similar using wild type Cas9 or Cas9 nickases (D10A, N863A).

Figure 16A:
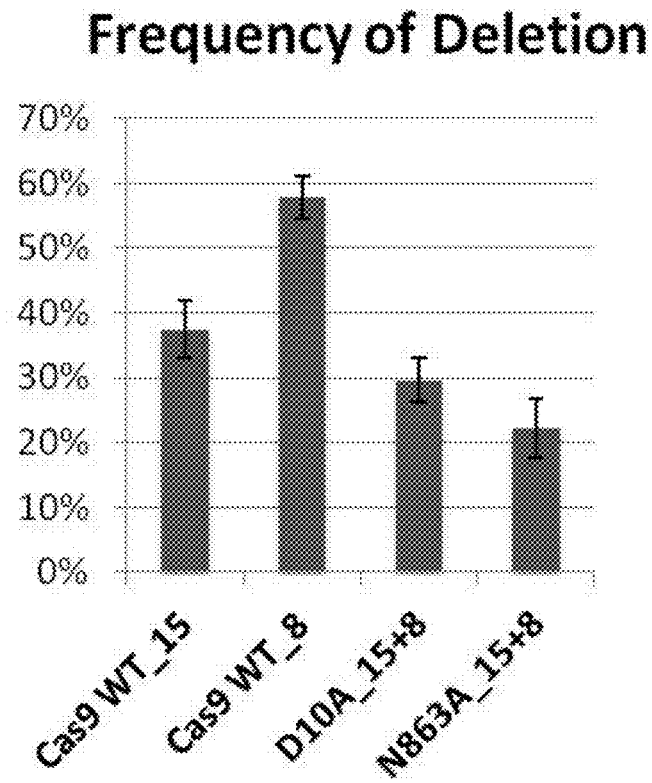
FIG. 16A depicts the frequency of deletions a wildtype Cas9 or a Cas9 nickase (D10A or N863A). A representation of at least 3 independent experiments for each condition is shown.
Figure 16B:
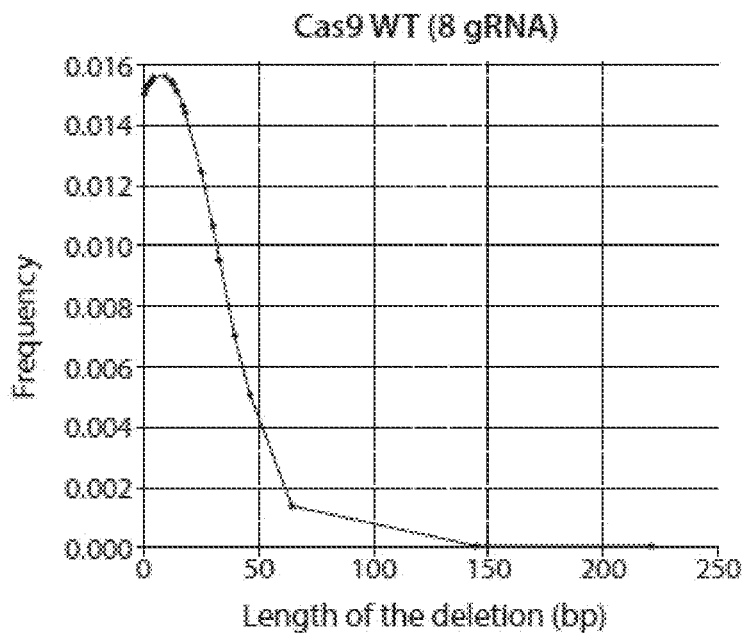
FIG. 16B depicts the frequency distribution of the length of deletions using a wildtype Cas9 and gRNA 8 (similar results have been obtained with gRNA 15).
Figure 16C:
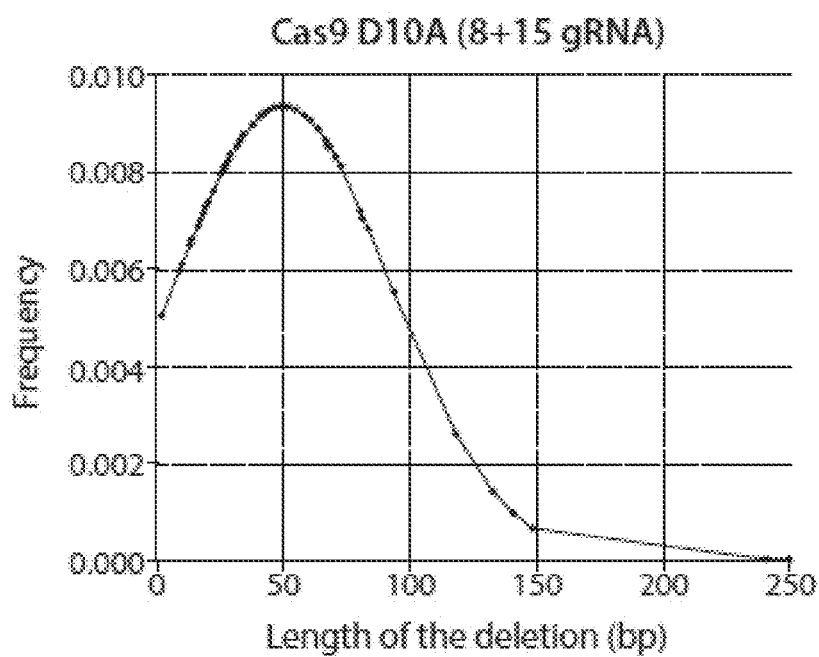
FIG. 16C depicts the frequency distribution of the length of deletions using a Cas9 nickase (D10A) with gRNAs 8/15 (similar results have been obtained using Cas9 N863A).

FIGS. 16A-16B show that a majority of the total gene editing events (about ¾ of the total) were small deletions (<10 bp). This is consistent with the notion that wildtype Cas9 generates a blunt end which are preferentially repaired by canonical NHEJ. In contrast, deletions represented only about a quarter of the total events using either nickase (D10A or N863A). Moreover, larger deletions of ~50 bp that can be mapped to the region between the two nickase sites were observed (FIG. 16A or 16C). The remaining gene-editing events were substantially different between the two nickases.

Figure 17A:
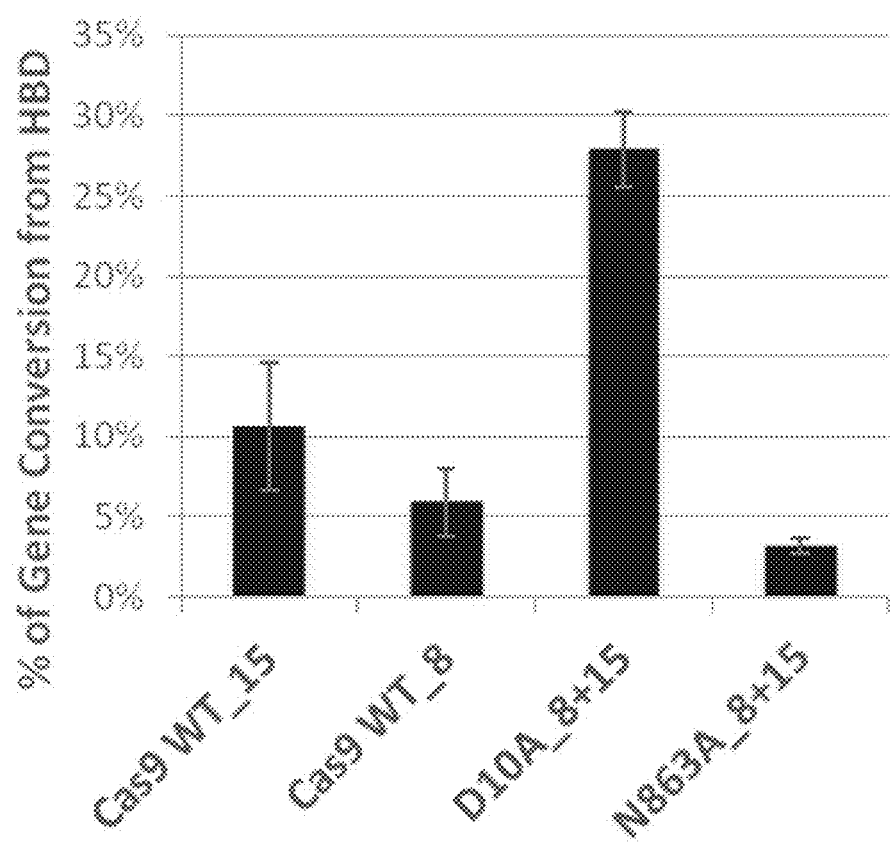
FIG. 17A depicts the frequency of gene conversion a wildtype Cas9 or a Cas9 nickase (D10A or N863A).
Figure 17B:
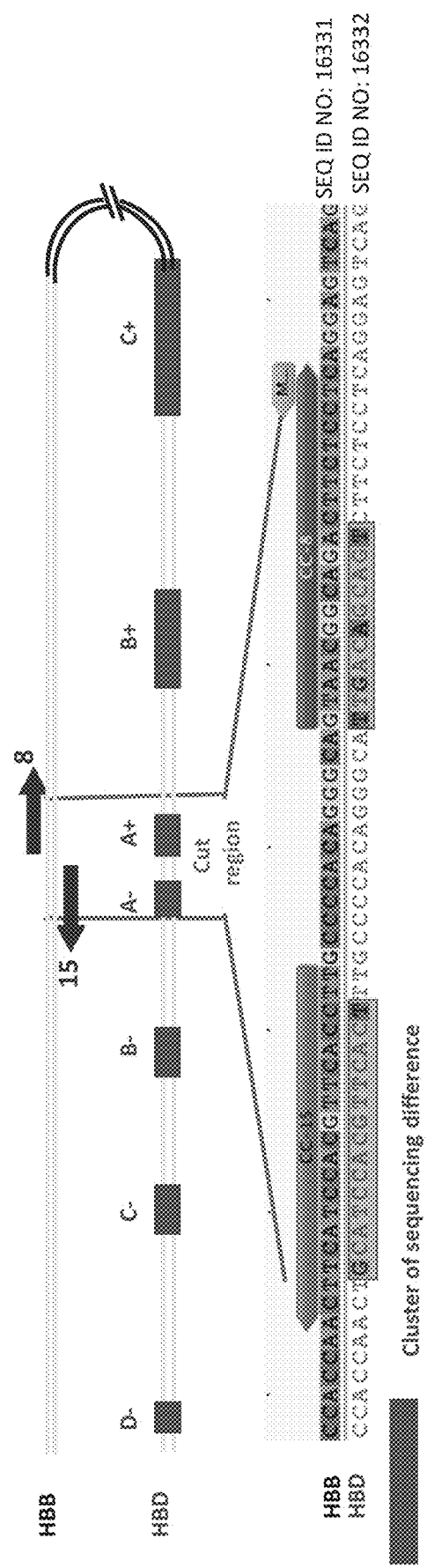
FIG. 17B shows a scheme representing the region of similarity between the HBB and HBD loci.
Figure 18:
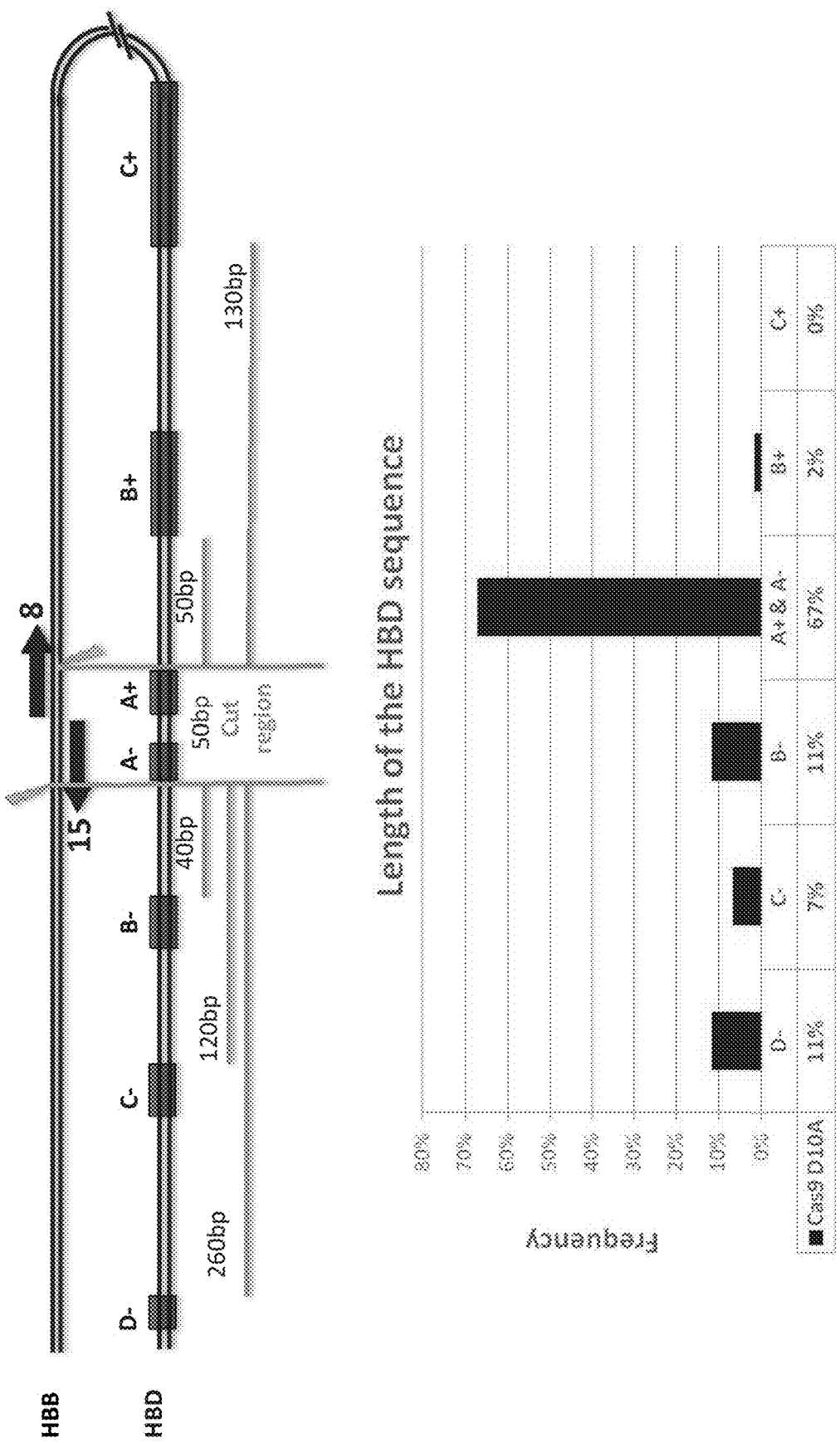
FIG. 18 depicts the frequency of different lengths of HBD sequences that were incorporated into the HBB locus.
Figure 19A:
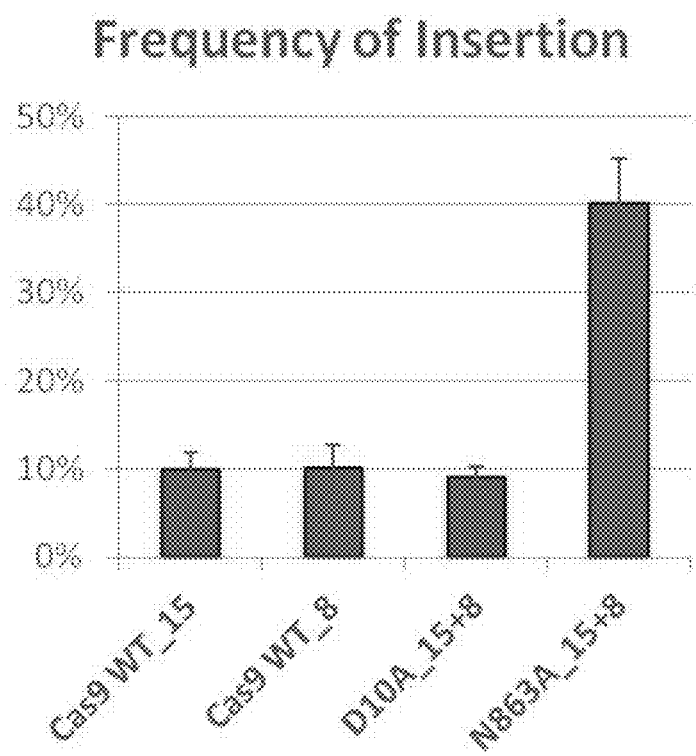
FIG. 19A depicts the frequency of insertions using a wildtype Cas9 or a Cas9 nickase (D10A or N863A). A representation of at least three independent experiments for each condition is shown.
Figure 19B:
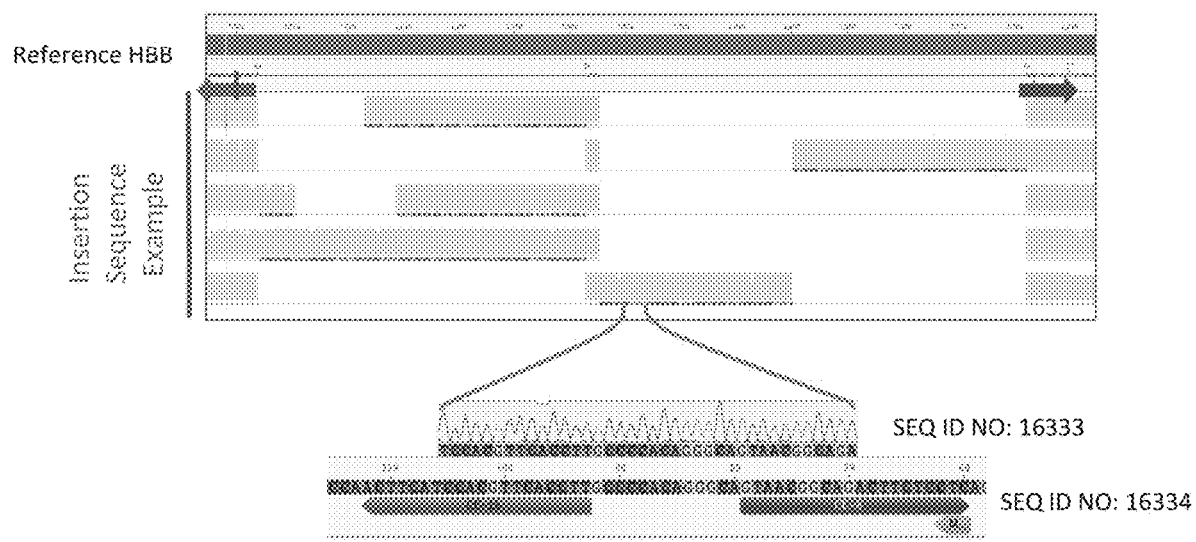
FIG. 19B depicts examples of common reads observed in U2OS cells electroporated with plasmid encoding Cas9 N863 and gRNA 8/15 pair. The HBB reference is shown on the top.

As shown in FIG. 17A, in the case of Cas9 D10A nickase which leaves a 5' protruding end, the lesion is mostly repaired through a mechanism defined as gene conversion. In gene conversion, the HBD locus will serve as a template to repair the HBB gene. HBD is a highly similar gene (92% identity with HBB) that does not carry the sickle-cell mutation (FIG. 17B). FIG. 18 shows that the majority of the HBD sequence that got incorporated in the HBB locus was in the region between the nickase cuts. In contrast, a low frequency of gene conversion was observed when the N863 nicase was used (FIG. 17A). In the case of Cas9 N863A nickase, a majority of the gene editing events were insertions in which the inserted part was a duplication of the overhangs (FIGS. 19A-19B).

Figure 20A:
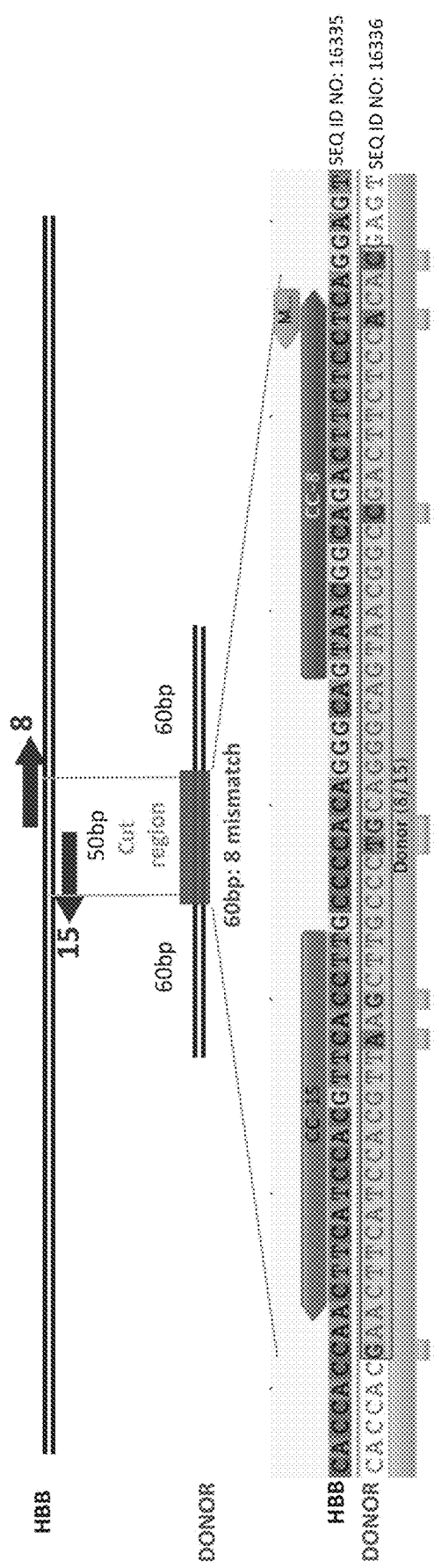
FIG. 20A is a schematic representation of the donor template.
Figure 20B:
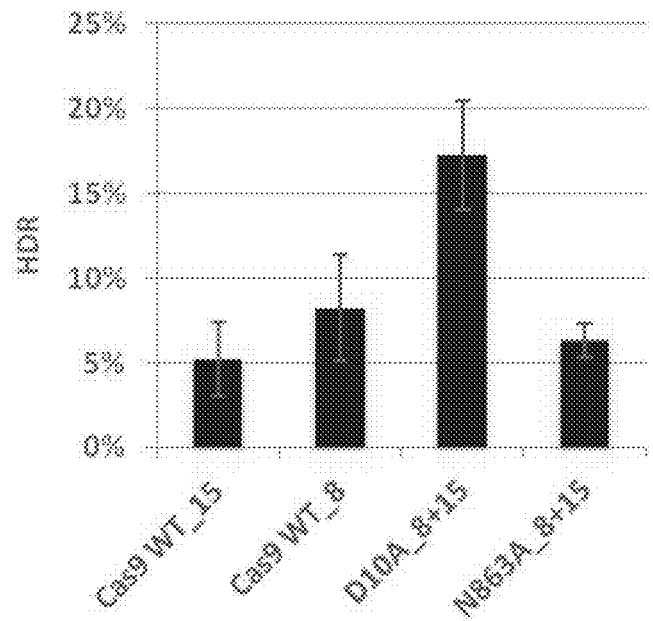
FIG. 20B depicts the frequency of HDR using a wildtype Cas9 or a Cas9 nickase (D10A or N863A).
Figure 20C:
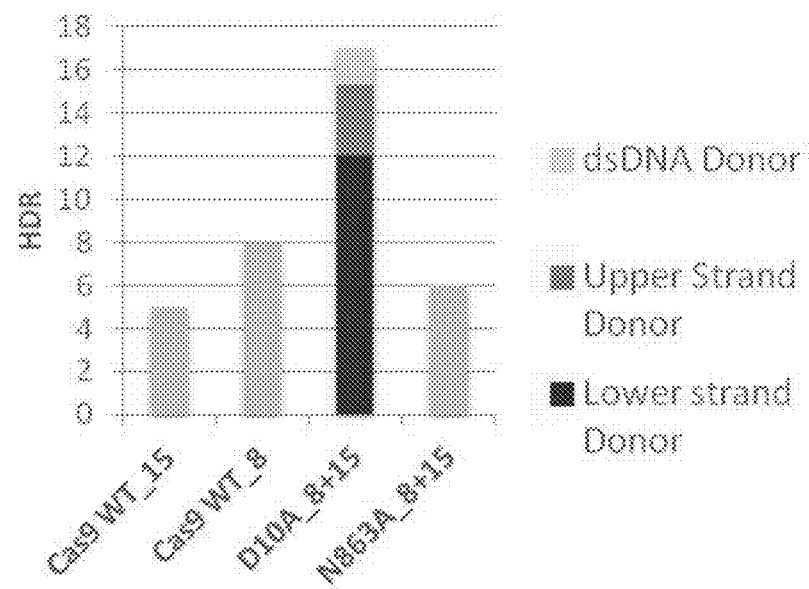
FIG. 20C depicts different forms of nonors and there contribution to HDR.

To test the effect that different lesions had on the engagement of HDR, a donor template was provided as a single strand oligo or as ds DNA donor. In both cases the length of the donor is approximately 170 bp with 60 bp of homology outside the nicks and with 8 mismatches (FIG. 20A). As shown in FIG. 20B, the Cas9 D10A nickase that resulted in a 5' overhang gave a significantly higher rate of HDR, especially when using the upper stand as a single-strand oligo donor. FIG. 20C shows different forms of donors (dsDNA, upper stand, and lower strand) and there contribution to HDR.

In summary, Cas9 nickases (D10A and N863A) showed comparable levels of efficacy compared to wildtype Cas9. Different DNA ends engage different repair pathways. The use of a wildtype Cas9 generates a blunt end, which are preferentially repaired by canonical NHEJ. Use of a Cas9 nickase with two gRNAs generates either 3' or 5' overhangs, which are not suitable substrates to be repaired by canonical NHEJ but can be repaired by alternative pathways.

The 5' protruding end was mostly repaired through a mechanism called gene conversion in which the HBB gene is repaired by using the HBD locus as a template. Use of nickase is advantageous to promote HDR. In the experiments in which a donor was provided, a significantly higher rate of HDR was observed using a nickase compared to the wildtype Cas9. The nature of the donor template also influences the outcome as HDR was preferentially observed when an SS Oligo was used.

Example 7

Assessment of Gene Targeting in Hematopoietic Stem Cells

Transplantation of autologous CD34$^+$ hematopoietic stem cells (HSCs, also known as hematopoietic stem/progenitor cells or HSPCs) genetically modified to correct the Sickle Cell Disease (SCD) mutation in the human β-hemoglobin gene (HBB) would prevent deformability (sickling) after deoxygenation in the erythrocyte progeny of corrected HSCs which could ameliorate symptoms associated with SCD. Genome editing with the CRISPR/Cas9 platform precisely alters endogenous gene targets by creating an indel at the targeted cut site that can lead to knock down of gene expression at the edited locus. In this Example, genome editing in the human K562 bone marrow erythroleukemia cell line, which serve as a proxy for HSCs and which can be predictive of genome editing in HSCs, were electroporated with Cas9 mRNA and gRNA HBB-8 and gRNA HBB-15 to induce gene editing at the human HBB locus.

K562 cells were grown in RPMI media (Life Technologies) containing 10% fetal bovine serum (FBS). For the RNA electroporation, the Maxcyte GT device (maxcyte.com) was used. *S. pyogenes* Cas9 mRNA and gRNA HBB-15 and gRNA HBB-8 were prepared by in vitro transcription using linearized plasmid DNA as templates and the Ambion mMessage mMachine® T7 Ultra Transcription kit (Life Technologies) according to the manufacturer's instructions. In this embodiment, both the Cas9 and gRNA were in vitro transcribed using a T7 polymerase. For example, a 5' ARCA cap was added to both RNA species simultaneous to transcription while a polyA tail was added after transcription to the 3' end of the RNA species by an *E. coli* polyA polymerase. Capped and tailed gRNA HBB-8 and gRNA HBB-15 were complexed at room temperature with *S. pyogenes* H-NLS-Cas9 protein at a molar ratio of ~25:1 (gRNA:Cas9 protein) in a total of 30 μg RNP. Briefly, three million K562 cells were suspended in 100 μL Maxcyte EP buffer and transferred to the RNP solution (13 μL). In addition, K562 cells were electroporated with *S. pyogenes* Cas9 mRNA and each of the gRNA HBB-8 and gRNA HBB-15. For the mRNA/gRNA electroporation with the Maxcyte device, 10 μg of gRNA HBB-8 (or 10 μg of HBB gRNA HBB-15) were mixed with 10 μg of Cas9 mRNA. Four million K562 cells were suspended in 100 μL Maxcyte EP buffer and then transferred to the mRNA/gRNA solution (13 μL). K562 cells mixed with either RNP or RNA were electroporated with the Maxcyte GT device. At 48 hours after electroporation, K562 cells were enumerated by trypan blue exclusion and were determined to have >88% viability in the electroporated cell populations. Genomic DNA was extracted from K562 cells 48 hours after electroporation and HBB locus-specific PCR reactions were performed.

Figure 21:
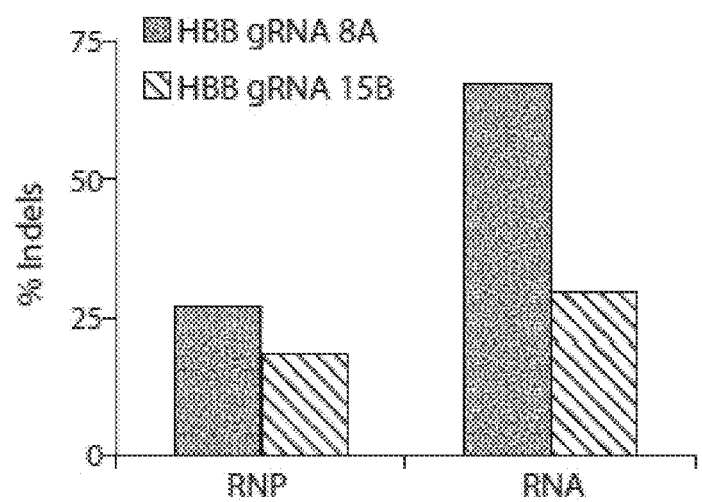
FIG. 21 depicts genome editing of the HBB locus in bone marrow leukemia K562 hematopoietic cells after electroporation of Cas9 protein complexed to HBB gRNAs 8 and 15 (RNP) or Cas9 mRNA co-delivered with HBB gRNAs 8 and 15 (RNA).

In order to detect indels at the HBB locus, T7E1 assays were performed on HBB locus-specific PCR products that were amplified from genomic DNA samples from electroporated K562 cells and the percentage of indels detected at the HBB locus was calculated (FIG. 21).

Co-delivery of 10 µg RNP which contains wild-type *S. pyogenes* Cas9 protein with HBB gRNA 8 or HBB gRNA 15 resulted in 26.8% and 16.1% indels, respectively, at the HBB locus in gDNA from K562 cells (molar ratio protein:gRNA 24:1). Co-delivery of Cas9 mRNA with gRNA HBB-8 or HBB-15 led to 66.9% and 29.5% indels at the HBB locus in gDNA from K562 cells (10 µg of each RNA/4 million cells). This example shows that delivery of Cas9 mRNA/gRNA and Cas9 RNPs leads to editing of the HBB locus in a relevant bone marrow derived hematopoietic cell line (K562 cells). Clinically, transplantation of autologous HSCs in which the HBB locus has been edited to correct the genetic mutation that causes red blood cell sickling could be used to ameliorate symptoms of SCD.

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (16336 sequences)

SEQ ID NO: 1 - protein, 1344 aa, Streptococcus mutans
KKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 2 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - protein, 1387 aa, Streptococcus thermophilus
TKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 4 - protein, 1333 aa, Listeria innocua
KKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 5 - RNA, 96 nt, Artificial Sequence
  Synthetic oligonucleotide
  misc_feature (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugc

SEQ ID NO: 6 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 7 - protein, 1368 aa, Streptococcus pyogenes [sequence omitted]

SEQ ID NO: 8 - protein, 12 aa, Artificial Sequence
  Synthetic peptide
  VARIANT (2)..(2): Xaa is Ile or Val or Met or Leu or Thr
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (6)..(6): Xaa is Ser or Tyr or Asn or Phe
  VARIANT (7)..(7): Xaa is Val or Ile or Leu or Cys or Thr or Phe
  VARIANT (9)..(9): Xaa is Trp or Phe or Val or Tyr or Ser or Leu
  VARIANT (10)..(10): Xaa is Ala or Ser or Cys or Val or Gly
  VARIANT (11)..(11): Xaa is Val or Ile or Leu or Ala or Met or His
  VARIANT (12)..(12): Any amino acid or absent
DXGXXXXGXXXX

SEQ ID NO: 9 - protein, 12 aa, Artificial Sequence
  Synthetic peptide
  VARIANT (2)..(2): Xaa is Ile or Val or Met or Leu or Thr
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (7)..(7): Xaa is Val or Ile or Leu or Cys or Thr or Phe
  VARIANT (9)..(9): Xaa is Trp or Phe or Val or Tyr or Ser or Leu
  VARIANT (10)..(10): Xaa is Ala or Ser or Cys or Val or Gly
  VARIANT (11)..(11): Xaa is Val or Ile or Leu or Ala or Met or His
  VARIANT (12)..(12): Any amino acid or absent
DXGXXSXGXXXX

SEQ ID NO: 10 - protein, 12 aa, Artificial Sequence
  Synthetic peptide
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (11)..(11): Xaa is Val or Ile or Leu or Ala or Met or His
  VARIANT (12)..(12): Any amino acid or absent
DIGXXSVGWAXX

SEQ ID NO: 11 - protein, 12 aa, Artificial Sequence
  Synthetic peptide
  MOD_RES (12)..(12): Any non-polar alkyl amino acid or a hydroxyl amino acid
DIGTNSVGWAVX

SEQ ID NO: 12 - protein, 8 aa, Artificial Sequence
  Synthetic peptide
  VARIANT (2)..(2): Xaa is Val or His
  VARIANT (3)..(3): Xaa is Ile or Leu or Val
  VARIANT (5)..(5): Xaa is Met or Thr
IXXEXARE

SEQ ID NO: 13 - protein, 8 aa, Artificial Sequence
  Synthetic peptide
  VARIANT (3)..(3): Xaa is Ile or Leu or Val
IVXEMARE

SEQ ID NO: 14 - protein, 8 aa, Artificial Sequence
  Synthetic peptide
  VARIANT (4)..(4): Xaa is His or Leu
  VARIANT (7)..(7): Xaa is Arg or Val
  VARIANT (8)..(8): Xaa is Glu or Val
HHAXDAXX

SEQ ID NO: 15 - protein, 8 aa, Artificial Sequence
  Synthetic peptide
HHAHDAYL

SEQ ID NO: 16 - protein, 30 aa, Artificial Sequence
  Synthetic polypeptide
  VARIANT (2)..(2): Xaa is Lys or Pro
  VARIANT (4)..(4): Xaa is Val or Leu or Ile or Phe
  VARIANT (5)..(5): Xaa is Gly or Ala or Ser
  VARIANT (6)..(6): Xaa is Leu or Ile or Val or Phe
  MOD_RES (7)..(26): Any amino acid and this region may encompass 5-20 residues wherein some positions may be absent
  VARIANT (29)..(29): Xaa is Asp or Glu or Asn or Gln
KXYXXXXXXXXXXXXXXXXXXXXXXXTDXY

SEQ ID NO: 17 - protein, 27 aa, Artificial Sequence
  Synthetic peptide
  VARIANT (1)..(1): Xaa is Asp or Glu or Gln or Asn
  VARIANT (2)..(2): Xaa is Leu or Ile or Arg or Gln or Val or Met or Lys
  VARIANT (3)..(3): Xaa is Asp or Glu
  VARIANT (5)..(5): Xaa is Ile or Val or Thr or Ala or Leu
  VARIANT (6)..(6): Xaa is Val or Tyr or Ile or Leu or Phe or Trp
  VARIANT (8)..(8): Xaa is Gln or His or Arg or Lys or Tyr or Ile or Leu or Phe or Trp
  VARIANT (9)..(9): Xaa is Ser or Ala or Asp or Thr or Lys
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (13)..(13): Xaa is Asp or Ser or Asn or Arg or Leu or Thr
  VARIANT (14)..(14): Xaa is Asp or Asn or Ser
  VARIANT (15)..(15): Xaa is Ser or Ala or Thr or Gly or Arg
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (19)..(19): Xaa is Lys or Leu or Arg or Met or Thr or Phe
  VARIANT (20)..(20): Xaa is Val or Leu or Ile or Ala or Thr
  VARIANT (21)..(21): Xaa is Leu or Ile or Val or Ala
  VARIANT (22)..(22): Xaa is Thr or Val or Cys or Glu or Ser or Ala
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys or Met or Asp or Phe
XXXHXXPXXXXXXXXXXNXXXXXXXXN

SEQ ID NO: 18 - protein, 27 aa, Artificial Sequence
  Synthetic peptide
  VARIANT (1)..(1): Xaa is Asp or Glu
  VARIANT (2)..(2): Xaa is Leu or Ile or Arg or Gln or Val or Met or Lys
  VARIANT (3)..(3): Xaa is Asp or Glu
  VARIANT (5)..(5): Xaa is Ile or Val or Thr or Ala or Leu
  VARIANT (6)..(6): Xaa is Val or Tyr or Ile or Leu or Phe or Trp
  VARIANT (8)..(8): Xaa is Gln or His or Arg or Lys or Tyr or Ile or Leu or Phe or Trp
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (22)..(22): Xaa is Thr or Val or Cys or Glu or Ser or Ala
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys Met or Asp or Phe
XXXHXXPXSXXXDDSXXNKVLXXXXXN

SEQ ID NO: 19 - protein, 27 aa, Artificial Sequence
  Synthetic peptide
  VARIANT (1)..(1): Xaa is Asp or Glu
  VARIANT (3)..(3): Xaa is Asp or Glu
  VARIANT (8)..(8): Xaa is Gln or His or Arg or Lys or Tyr or Ile or Leu or Trp
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys or Met or Asp or Phe
XVXHIVPXSXXXDDSXXNKVLTXXXXN

SEQ ID NO: 20 - protein, 27 aa, Artificial Sequence
  Synthetic peptide
  VARIANT (2)..(2): Xaa is Ile or Val
  VARIANT (6)..(6): Xaa is Ile or Val
  VARIANT (9)..(9): Xaa is Ala or Ser
  VARIANT (11)..(11): Xaa is Ile or Leu
  VARIANT (12)..(12): Xaa is Lys or Thr
  VARIANT (14)..(14): Xaa is Asp or Asn
  VARIANT (19)..(19): Xaa is Arg or Lys or Leu
  VARIANT (22)..(22): Xaa is Thr or Val
  VARIANT (23)..(23): Xaa is Ser or Arg
  VARIANT (25)..(25): Xaa is Lys or Asp or Ala
  VARIANT (26)..(26): Xaa is Glu or Lys or Gly or Asn
DXDHIXPQXFXXDXSIDNXVLXXSXXN

SEQ ID NO: 21 - protein, 73 aa, Artificial Sequence
  Synthetic polypeptide
  VARIANT (8)..(8): Xaa is Lys or Arg
  VARIANT (12)..(12): Xaa is Val or Thr
  VARIANT (13)..(13): Xaa is Gly or Asp
  VARIANT (14)..(14): Xaa is Glu or Gln or Asp
  VARIANT (15)..(15): Xaa is Glu or Asp
  VARIANT (19)..(19): Xaa is Asp or Asn or His
  VARIANT (20)..(20): Xaa is Tyr or Arg or Asn
  VARIANT (23)..(23): Xaa is Gln or Asp or Asn
  MOD_RES (25)..(64): Any amino acid and this region may encompass 15-40 residues wherein some positions may be absent
  VARIANT (67)..(67): Xaa is Gly or Glu
  VARIANT (69)..(69): Xaa is Ser or Gly
  VARIANT (71)..(71): Xaa is Asp or Asn
LYYLQNGXDMYXXXXLDIXXLSXYXXXXXXXXXXXXXXXXXXXXXXXXXXXXXXXXXXXXXXXXNRXKXDXVP

SEQ ID NO: 22 - DNA, 4107 bp, Artificial Sequence
  Synthetic polynucleotide
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 23 - protein, 1368 aa, Streptococcus pyogenes [sequence omitted]

SEQ ID NO: 24 - DNA, 3249 bp, Artificial Sequence
  Synthetic polynucleotide
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 25 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 26 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 27 - RNA, 104 nt, Artificial Sequence
  Synthetic polynucleotide
  misc_feature (1)..(20): a, c, u, g, unknown or other
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 28 - RNA, 106 nt, Artificial Sequence
  Synthetic polynucleotide
  misc_feature (1)..(20): a, c, u, g, unknown or other
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 29 - RNA, 116 nt, Artificial Sequence
  Synthetic polynucleotide
  misc_feature (1)..(20): a, c, u, g, unknown or other
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 30 - RNA, 96 nt, Artificial Sequence
  Synthetic oligonucleotide
  misc_feature (1)..(20): a, c, u, g, unknown or other
nnnnnnnnnnnnnnnnnnnnguauuagagcuagaaauagcaaguuaauauaaggcuaguccguuaucaacuugaaaaaguggcaccgagucggugc

SEQ ID NO: 31 - RNA, 96 nt, Artificial Sequence
  Synthetic oligonucleotide
  misc_feature (1)..(20): a, c, u, g, unknown or other
nnnnnnnnnnnnnnnnnnnnguuuaagagcuagaaauagcaaguuuaaauaaggcuaguccguuaucaacuugaaaaaguggcaccgagucggugc

SEQ ID NO: 32 - RNA, 116 nt, Artificial Sequence
  Synthetic polynucleotide
  misc_feature (1)..(20): a, c, u, g, unknown or other
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 33 - RNA, 47 nt, Artificial Sequence
  Synthetic oligonucleotide
aaggcuaguccguuaucaacuugaaaaaguggcaccgagucggugcu

SEQ ID NO: 34 - RNA, 49 nt, Artificial Sequence
  Synthetic oligonucleotide
aaggcuaguccguuaucaacuugaaaaaguggcaccgagucgguggugc

SEQ ID NO: 35 - RNA, 51 nt, Artificial Sequence
  Synthetic oligonucleotide
aaggcuaguccguuaucaacuugaaaaaguggcaccgagucggugcggauc

SEQ ID NO: 36 - RNA, 31 nt, Artificial Sequence
  Synthetic oligonucleotide
aaggcuaguccguuaucaacuugaaaaagug

SEQ ID NO: 37 - RNA, 18 nt, Artificial Sequence
  Synthetic oligonucleotide
aaggcuaguccguuauca

SEQ ID NO: 38 - RNA, 12 nt, Artificial Sequence
  Synthetic oligonucleotide
aaggcuaguccg

SEQ ID NO: 39 - DNA, 3159 bp, Artificial Sequence
  Synthetic polynucleotide
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 40 - RNA, 102 nt, Artificial Sequence
  Synthetic oligonucleotide
  misc_feature (1)..(20): n is a, c, g, or u
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 41 - skipped

SEQ ID NO: 42 - RNA, 42 nt, Streptococcus pyogenes
  misc_feature (1)..(20): a, c, u, g, unknown or other
nnnnnnnnnnnnnnnnnnnnguuuuagagcuaugcuguuuug

SEQ ID NO: 43 - RNA, 85 nt, Streptococcus pyogenes
ggaaccauucaaaacagcauagcaaguuaaaauaaggcuaguccguuaucaacuugaaaaaguggcaccgagucggugcuuuuuu

SEQ ID NO: 44 - RNA, 62 nt, Streptococcus pyogenes
  misc_feature (1)..(20): a, c, u, g, unknown or other
nnnnnnnnnnnnnnnnnnnnguuuuagagcuagaaauagcaaguuaaaauaaggcuaguccg

SEQ ID NO: 45 - RNA, 102 nt, Streptococcus pyogenes
  misc_feature (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 46 - RNA, 75 nt, Streptococcus pyogenes
  misc_feature (1)..(20): a, c, u, g, unknown or other
nnnnnnnnnnnnnnnnnnnnguuuuagagcuaugcugaaaagcauagcaaguuaaaauaaggcuaguccguuauc

SEQ ID NO: 47 - RNA, 87 nt, Streptococcus pyogenes
  misc_feature (1)..(20): a, c, u, g, unknown or other
nnnnnnnnnnnnnnnnnnnnguuuuagagcuaugcuguuuuggaaacaaaacagcauagcaaguuaaaauaaggcuaguccguuauc

SEQ ID NO: 48 - RNA, 42 nt, Streptococcus thermophilus
  misc_feature (1)..(20): a, c, u, g, unknown or other
nnnnnnnnnnnnnnnnnnnnguuuuagagcuguguuguuucg

SEQ ID NO: 49 - RNA, 78 nt, Streptococcus thermophilus
gggcgaaacaacacagcgaguuaaaauaaggcuuaguccguacucaacuugaaaagguggcaccgauucgguguuuuu

SEQ ID NO: 50 - RNA, 42 nt, Streptococcus pyogenes; identical to SEQ ID NO: 42
  misc_feature (1)..(20): a, c, u, g, unknown or other

SEQ ID NO: 51 - RNA, 42 nt, Streptococcus thermophilus; identical to SEQ ID NO: 48
  misc_feature (1)..(20): a, c, u, g, unknown or other

SEQ ID NO: 52 - RNA, 85 nt, Streptococcus pyogenes
gaaccauucaaaacagcauagcaaguuaaaauaaggcuaguccguuaucaacuugaaaaaguggcaccgagucggugcuuuuuuu

SEQ ID NO: 53 - RNA, 78 nt, Streptococcus thermophilus; identical to SEQ ID NO: 49

SEQ ID NO: 54 - protein, 12 aa, Artificial Sequence
  Synthetic peptide
DIGTNSVGWAVT

SEQ ID NO: 55 - protein, 12 aa, Artificial Sequence
  Synthetic peptide
DIGTNSVGWAVT

SEQ ID NO: 56 - protein, 12 aa, Artificial Sequence
  Synthetic peptide
DVGTNSVGWAVT

SEQ ID NO: 57 - protein, 12 aa, Artificial Sequence
  Synthetic peptide
DVGTNSVGWAVT

SEQ ID NO: 58 - protein, 12 aa, Artificial Sequence
  Synthetic peptide
DMGTNSVGWAVT

SEQ ID NO: 59 - protein, 12 aa, Artificial Sequence
  Synthetic peptide
DVGTSSVGWAVT

SEQ ID NO: 60 - protein, 12 aa, Artificial Sequence
  Synthetic peptide
DIGTASVGWAVT

SEQ ID NO: 61 - protein, 12 aa, Artificial Sequence
  Synthetic peptide
DVGTGSVGWAVT

SEQ ID NO: 62 - protein, 12 aa, Artificial Sequence
  Synthetic peptide
DIGTNSVGWAVV

SEQ ID NO: 63 - protein, 12 aa, Artificial Sequence
  Synthetic peptide
DIGTNSVGWAVI

SEQ ID NO: 64 - protein, 12 aa, Artificial Sequence
  Synthetic peptide
DIGTNSVGWAVL

SEQ ID NO: 65 - protein, 12 aa, Artificial Sequence
  Synthetic peptide
DLGTNSIGWAVV

SEQ ID NO: 66 - protein, 11 aa, Artificial Sequence
  Synthetic peptide
DLGTNSIGWAI

SEQ ID NO: 67 - protein, 12 aa, Artificial Sequence
  Synthetic peptide
DLGTNSIGWALV

SEQ ID NO: 68 - protein, 12 aa, Artificial Sequence
  Synthetic peptide
DIGTNSVGWCVT

SEQ ID NO: 69 - protein, 12 aa, Artificial Sequence
  Synthetic peptide
DIGTNSVGYAVT

SEQ ID NO: 70 - protein, 12 aa, Artificial Sequence
  Synthetic peptide
DMGTGSLGWAVT

SEQ ID NO: 71 - protein, 12 aa, Artificial Sequence
  Synthetic peptide
DIGTSSVGWAAI

SEQ ID NO: 72 - protein, 12 aa, Artificial Sequence
  Synthetic peptide
DLGTGSVGWAVV

SEQ ID NO: 73 - protein, 12 aa, Artificial Sequence
  Synthetic peptide
DLGVGSVGWAIV

SEQ ID NO: 74 - protein, 12 aa, Artificial Sequence
  Synthetic peptide
DLGIASIGWAII

SEQ ID NO: 75 - protein, 12 aa, Artificial Sequence
  Synthetic peptide
DLGIASVGWAIV

SEQ ID NO: 76 - protein, 12 aa, Artificial Sequence
  Synthetic peptide
DLGVASVGWSIV

SEQ ID NO: 77 - protein, 12 aa, Artificial Sequence
  Synthetic peptide
DIGIASVGWAIL

SEQ ID NO: 78 - protein, 12 aa, Artificial Sequence
  Synthetic peptide
DLGISSVGWSVI

SEQ ID NO: 79 - protein, 12 aa, Artificial Sequence
  Synthetic peptide
DIGIASVGWSVI

SEQ ID NO: 80 - protein, 12 aa, Artificial Sequence
  Synthetic peptide
DVGIGSIGWAVI

SEQ ID NO: 81 - protein, 12 aa, Artificial Sequence
  Synthetic peptide
DLGVGSIGFAIV

SEQ ID NO: 82 - protein, 12 aa, Artificial Sequence
  Synthetic peptide
DIGYASIGWAVI

SEQ ID NO: 83 - protein, 12 aa, Artificial Sequence
  Synthetic peptide
DTGTNSLGWAIV

SEQ ID NO: 84 - protein, 12 aa, Artificial Sequence
  Synthetic peptide
DLGTNSIGWCLL

SEQ ID NO: 85 - protein, 12 aa, Artificial Sequence
  Synthetic peptide
DIGTDSLGWAVF

SEQ ID NO: 86 - protein, 12 aa, Artificial Sequence
  Synthetic peptide
DIGSNSIGFAVV

SEQ ID NO: 87 - protein, 12 aa, Artificial Sequence
  Synthetic peptide
DLGVGSIGVAVA

SEQ ID NO: 88 - protein, 12 aa, Artificial Sequence
  Synthetic peptide
DLGIASCGWGVV

SEQ ID NO: 89 - protein, 12 aa, Artificial Sequence
  Synthetic peptide
DLGIASVGWCLT

SEQ ID NO: 90 - protein, 12 aa, Artificial Sequence
  Synthetic peptide
DIGIGSVGVGIL

SEQ ID NO: 91 - protein, 12 aa, Artificial Sequence
  Synthetic peptide
DIGITSVGYGLI

SEQ ID NO: 92 - protein, 12 aa, Artificial Sequence
  Synthetic peptide
DIGITSVGFGII

SEQ ID NO: 93 - protein, 12 aa, Artificial Sequence
  Synthetic peptide
DVGITSTGYAVL

SEQ ID NO: 94 - protein, 12 aa, Artificial Sequence
  Synthetic peptide
DLGITSFGYAIL

SEQ ID NO: 95 - protein, 12 aa, Artificial Sequence
  Synthetic peptide
DIGNASVGWSAF

SEQ ID NO: 96 - protein, 12 aa, Artificial Sequence
  Synthetic peptide
DVGTNSCGWVAM

SEQ ID NO: 97 - protein, 12 aa, Artificial Sequence
  Synthetic peptide
DVGERSIGLAAV

SEQ ID NO: 98 - protein, 12 aa, Artificial Sequence
  Synthetic peptide
DVGLNSVGLAAV

SEQ ID NO: 99 - protein, 12 aa, Artificial Sequence
  Synthetic peptide
DVGLMSVGLAAI

SEQ ID NO: 100 - protein, 12 aa, Artificial Sequence
  Synthetic peptide
DVGTFSVGLAAI

SEQ ID NO: 101 - protein, 12 aa, Artificial Sequence
  Synthetic peptide
DIGTGSVGYACM

SEQ ID NO: 102 - protein, 12 aa, Artificial Sequence
  Synthetic peptide
DLGTTSIGFAHI

SEQ ID NO: 103 - protein, 12 aa, Artificial Sequence
  Synthetic peptide
DLGTNSIGSSVR

SEQ ID NO: 104 - protein, 12 aa, Artificial Sequence
  Synthetic peptide
DIGTNSVGWAVT

SEQ ID NO: 105 - protein, 12 aa, Artificial Sequence
  Synthetic peptide
DIGTNSVGWAVT

SEQ ID NO: 106 - protein, 12 aa, Artificial Sequence
  Synthetic peptide
DVGTNSVGWAVT

SEQ ID NO: 107 - protein, 12 aa, Artificial Sequence
  Synthetic peptide
DVGTNSVGWAVT

SEQ ID NO: 108 - protein, 12 aa, Artificial Sequence
  Synthetic peptide
DMGTNSVGWAVT

SEQ ID NO: 109 - protein, 12 aa, Artificial Sequence
  Synthetic peptide
DVGTSSVGWAVT

SEQ ID NO: 110 - protein, 12 aa, Artificial Sequence
  Synthetic peptide
DIGTASVGWAVT

SEQ ID NO: 111 - protein, 12 aa, Artificial Sequence
  Synthetic peptide
DVGTGSVGWAVT

SEQ ID NO: 112 - protein, 12 aa, Artificial Sequence
  Synthetic peptide
DIGTNSVGWAVV

SEQ ID NO: 113 - protein, 12 aa, Artificial Sequence
  Synthetic peptide
DIGTNSVGWAVI

SEQ ID NO: 114 - protein, 12 aa, Artificial Sequence
  Synthetic peptide
DIGTNSIGWAVI

SEQ ID NO: 115 - protein, 12 aa, Artificial Sequence
  Synthetic peptide
DIGTNSVGWAVL

SEQ ID NO: 116 - protein, 12 aa, Artificial Sequence
  Synthetic peptide
DLGTNSIGWAVV

SEQ ID NO: 117 - protein, 11 aa, Artificial Sequence
  Synthetic peptide
DLGTNSIGWAI

SEQ ID NO: 118 - protein, 12 aa, Artificial Sequence
  Synthetic peptide
DLGTNSIGWALV

SEQ ID NO: 119 - protein, 12 aa, Artificial Sequence
  Synthetic peptide
DIGTNSVGWCVT

SEQ ID NO: 120 - protein, 12 aa, Artificial Sequence
  Synthetic peptide
DIGTNSVGYAVT

SEQ ID NO: 121 - protein, 12 aa, Artificial Sequence
  Synthetic peptide
DMGTGSLGWAVT

SEQ ID NO: 122 - protein, 12 aa, Artificial Sequence
  Synthetic peptide
DIGTSSVGWAAI

SEQ ID NO: 123 - protein, 12 aa, Artificial Sequence
  Synthetic peptide
DLGTGSVGWAVV

SEQ ID NO: 124 - protein, 12 aa, Artificial Sequence
  Synthetic peptide
DLGVGSVGWAIV

SEQ ID NO: 125 - protein, 12 aa, Artificial Sequence
  Synthetic peptide
DLGIASIGWAII

SEQ ID NO: 126 - protein, 12 aa, Artificial Sequence
  Synthetic peptide
DLGIASVGWAIV

SEQ ID NO: 127 - protein, 12 aa, Artificial Sequence
  Synthetic peptide
DLGIASVGWAVV

SEQ ID NO: 128 - protein, 12 aa, Artificial Sequence
  Synthetic peptide
DLGVASVGWSIV

SEQ ID NO: 129 - protein, 12 aa, Artificial Sequence
  Synthetic peptide
DIGIASVGWAIL

SEQ ID NO: 130 - protein, 12 aa, Artificial Sequence
  Synthetic peptide
DIGIASVGWAVL

SEQ ID NO: 131 - protein, 12 aa, Artificial Sequence
  Synthetic peptide
DIGIASIGWAVI

SEQ ID NO: 132 - protein, 12 aa, Artificial Sequence
  Synthetic peptide
DIGIASVGWAII

SEQ ID NO: 133 - protein, 12 aa, Artificial Sequence
  Synthetic peptide
DVGIASVGWAVI

SEQ ID NO: 134 - protein, 11 aa, Artificial Sequence
  Synthetic peptide
DIGIASVGWAL

SEQ ID NO: 135 - protein, 12 aa, Artificial Sequence
  Synthetic peptide
DIGIASVGWAMV

SEQ ID NO: 136 - protein, 12 aa, Artificial Sequence
  Synthetic peptide
DIGIASVGWSVI

SEQ ID NO: 137 - protein, 12 aa, Artificial Sequence
  Synthetic peptide
DLGISSVGWSVI

SEQ ID NO: 138 - protein, 12 aa, Artificial Sequence
  Synthetic peptide
DIGITSVGWAVI

SEQ ID NO: 139 - protein, 12 aa, Artificial Sequence
  Synthetic peptide
DVGIGSIGWAVI

SEQ ID NO: 140 - protein, 12 aa, Artificial Sequence
  Synthetic peptide
DLGISSLGWAIV

SEQ ID NO: 141 - protein, 12 aa, Artificial Sequence
  Synthetic peptide
DLGVGSIGFAIV

SEQ ID NO: 142 - protein, 12 aa, Artificial Sequence
  Synthetic peptide
DIGYASIGWAVI

SEQ ID NO: 143 - protein, 12 aa, Artificial Sequence
  Synthetic peptide
DLGTNSIGWCLL

SEQ ID NO: 144 - protein, 12 aa, Artificial Sequence
  Synthetic peptide
DLGTNSIGWGLL

SEQ ID NO: 145 - protein, 12 aa, Artificial Sequence
  Synthetic peptide
DTGTNSLGWAIV

SEQ ID NO: 146 - protein, 12 aa, Artificial Sequence
  Synthetic peptide
DIGTDSLGWAVF

SEQ ID NO: 147 - protein, 12 aa, Artificial Sequence
  Synthetic peptide
DLGSTSLGWAIF

SEQ ID NO: 148 - protein, 12 aa, Artificial Sequence
  Synthetic peptide
DIGISSIGWAFS

SEQ ID NO: 149 - protein, 12 aa, Artificial Sequence
  Synthetic peptide
DLGIASVGWCLT

SEQ ID NO: 150 - protein, 12 aa, Artificial Sequence
  Synthetic peptide
DLGIASCGWGVV

SEQ ID NO: 151 - protein, 12 aa, Artificial Sequence
  Synthetic peptide
DIGSNSIGFAVV

SEQ ID NO: 152 - protein, 12 aa, Artificial Sequence
  Synthetic peptide
DIGTTSIGFSVI

SEQ ID NO: 153 - protein, 12 aa, Artificial Sequence
  Synthetic peptide
DIGITSVGYGLI

SEQ ID NO: 154 - protein, 12 aa, Artificial Sequence
  Synthetic peptide
DIGITSVGFGII

SEQ ID NO: 155 - protein, 12 aa, Artificial Sequence
  Synthetic peptide
DLGTTSIGFAHI

SEQ ID NO: 156 - protein, 12 aa, Artificial Sequence
  Synthetic peptide
DIGIGSVGVGIL

SEQ ID NO: 157 - protein, 12 aa, Artificial Sequence
  Synthetic peptide
DLGVGSIGVAVA

SEQ ID NO: 158 - protein, 12 aa, Artificial Sequence
  Synthetic peptide
DVGITSTGYAVL

SEQ ID NO: 159 - protein, 12 aa, Artificial Sequence
  Synthetic peptide
DLGITSFGYAIL

SEQ ID NO: 160 - protein, 12 aa, Artificial Sequence
  Synthetic peptide
DIGTSSIGWWLY

SEQ ID NO: 161 - protein, 12 aa, Artificial Sequence
  Synthetic peptide
DLGSNSLGWFVT

SEQ ID NO: 162 - protein, 12 aa, Artificial Sequence
  Synthetic peptide
DLGANSLGWFVV

SEQ ID NO: 163 - protein, 12 aa, Artificial Sequence
  Synthetic peptide
DIGNASVGWSAF

SEQ ID NO: 164 - protein, 12 aa, Artificial Sequence
  Synthetic peptide
DVGTNSCGWVAM

SEQ ID NO: 165 - protein, 12 aa, Artificial Sequence
  Synthetic peptide
DVGERSIGLAAV

SEQ ID NO: 166 - protein, 12 aa, Artificial Sequence
  Synthetic peptide
DVGLNSVGLAAV

SEQ ID NO: 167 - protein, 12 aa, Artificial Sequence
  Synthetic peptide
DVGLMSVGLAAI

SEQ ID NO: 168 - protein, 12 aa, Artificial Sequence
  Synthetic peptide
DVGTFSVGLAAI

SEQ ID NO: 169 - protein, 12 aa, Artificial Sequence
  Synthetic peptide
DIGTGSVGYACM

SEQ ID NO: 170 - protein, 12 aa, Artificial Sequence
  Synthetic peptide
DLGTNSIGSSVR

SEQ ID NO: 171 - protein, 15 aa, Artificial Sequence
  Synthetic peptide
DIGLRIGITSCGWSI

SEQ ID NO: 172 - protein, 12 aa, Artificial Sequence
  Synthetic peptide
DMGAKYTGVFYA

SEQ ID NO: 173 - protein, 12 aa, Artificial Sequence
  Synthetic peptide
DLGGKNTGFFSF

SEQ ID NO: 174 - protein, 12 aa, Artificial Sequence
  Synthetic peptide
DLGVKNTGVFSA

SEQ ID NO: 175 - protein, 12 aa, Artificial Sequence
  Synthetic peptide
DLGAKFTGVALY

SEQ ID NO: 176 - protein, 12 aa, Artificial Sequence
  Synthetic peptide
DLGGKFTGVCLS

SEQ ID NO: 177 - protein, 12 aa, Artificial Sequence
  Synthetic peptide
DLGGTYTGTFIT

SEQ ID NO: 178 - protein, 28 aa, Artificial Sequence
  Synthetic peptide
YDIDHIYPRSLTKDDSFDNLVLCERTAN

SEQ ID NO: 179 - protein, 28 aa, Artificial Sequence
  Synthetic peptide
DIDHIYPRSKVIKDDSFDNLVLVLKNEN

SEQ ID NO: 180 - protein, 27 aa, Artificial Sequence
  Synthetic peptide
DRDHIYPQSKIKDDSIDNLVLVNKTYN

SEQ ID NO: 181 - protein, 27 aa, Artificial Sequence
  Synthetic peptide
DIDHIYPRSKIKDDSITNRVLVEKDIN

SEQ ID NO: 182 - protein, 27 aa, Artificial Sequence
  Synthetic peptide
DIDHIYPQSKIKDDSISNRVLVCSSCN

SEQ ID NO: 183 - protein, 27 aa, Artificial Sequence
  Synthetic peptide
DIDHIYPQSKTMDDSLNNRVLVKKNYN

SEQ ID NO: 184 - protein, 27 aa, Artificial Sequence
  Synthetic peptide
DQDHIYPKSKIYDDSLENRVLVKKNLN

SEQ ID NO: 185 - protein, 27 aa, Artificial Sequence
  Synthetic peptide
QIDHIVPQSLVKDDSFDNRVLVVPSEN

SEQ ID NO: 186 - protein, 27 aa, Artificial Sequence
  Synthetic peptide
DIDHIIPQAFIKDNSIDNRVLTSSKEN

SEQ ID NO: 187 - protein, 27 aa, Artificial Sequence
  Synthetic peptide
DIDHIIPQAFLKDNSIDNKVLVSSASN

SEQ ID NO: 188 - protein, 27 aa, Artificial Sequence
  Synthetic peptide
DIDHIIPQAYTKDNSLDNRVLVSNITN

SEQ ID NO: 189 - protein, 27 aa, Artificial Sequence
  Synthetic peptide
DIDHIVPQSFITDNSIDNLVLTSSAGN

SEQ ID NO: 190 - protein, 27 aa, Artificial Sequence
  Synthetic peptide
DVDHIVPQSFLKDDSIDNKVLTRSDKN

SEQ ID NO: 191 - protein, 27 aa, Artificial Sequence
  Synthetic peptide
NIDHIYPQSMVKDDSLDNKVLVQSEIN

SEQ ID NO: 192 - protein, 27 aa, Artificial Sequence
  Synthetic peptide
DIDHILPQSLIKDDSLDNRVLVNATIN

SEQ ID NO: 193 - protein, 27 aa, Artificial Sequence
  Synthetic peptide
DIDHILPQSFIKDDSLENRVLVKKAVN

SEQ ID NO: 194 - protein, 27 aa, Artificial Sequence
  Synthetic peptide
EVDHIFPRSFIKDDSIDNKVLVIKKMN

SEQ ID NO: 195 - protein, 27 aa, Artificial Sequence
  Synthetic peptide
EVDHIIPRSYIKDDSFENKVLVYREEN

SEQ ID NO: 196 - protein, 27 aa, Artificial Sequence
  Synthetic peptide
DIDHIIPQAVTQNDSIDNRVLVARAEN

SEQ ID NO: 197 - protein, 27 aa, Artificial Sequence
  Synthetic peptide
EIDHIIPYSISFDDSSSNKLLVLAESN

SEQ ID NO: 198 - protein, 27 aa, Artificial Sequence
  Synthetic peptide
EIDHIIPYSLCFDDSSANKVLVHKQSN

SEQ ID NO: 199 - protein, 27 aa, Artificial Sequence
  Synthetic peptide
DIDHIIPYSRSMDDSYSNKVLVLSGEN

SEQ ID NO: 200 - protein, 27 aa, Artificial Sequence
  Synthetic peptide
DIDHIIPYSKSMDDSFNNKVLCLAEEN

SEQ ID NO: 201 - protein, 27 aa, Artificial Sequence
  Synthetic peptide
EIDHIYPYSRSFDDSYMNKVLVFTKQN

SEQ ID NO: 202 - protein, 27 aa, Artificial Sequence
  Synthetic peptide
QIDHIYPYSRSMDDSYMNKVLVLTDEN

SEQ ID NO: 203 - protein, 27 aa, Artificial Sequence
  Synthetic peptide
EIDHIIPFSRSFDDSLSNKILVLGSEN

SEQ ID NO: 204 - protein, 27 aa, Artificial Sequence
  Synthetic peptide
EIDHALPFSRTWDDSFNNKVLVLGSEN

SEQ ID NO: 205 - protein, 27 aa, Artificial Sequence
  Synthetic peptide
EIDHALPFSRTWDDSFNNKVLVLASEN

SEQ ID NO: 206 - protein, 27 aa, Artificial Sequence
  Synthetic peptide
EIDHIIPISISLDDSINNKVLVLSKAN

SEQ ID NO: 207 - protein, 27 aa, Artificial Sequence
  Synthetic peptide
EVDHIIPISISLDDSITNKVLVTHREN

SEQ ID NO: 208 - protein, 27 aa, Artificial Sequence
  Synthetic peptide
QVDHALPYSRSYDDSKNNKVLVLTHEN

SEQ ID NO: 209 - protein, 27 aa, Artificial Sequence
  Synthetic peptide
EVDHILPLSITFDDSLANKVLVYATAN

SEQ ID NO: 210 - protein, 27 aa, Artificial Sequence
  Synthetic peptide
EIDHIIPRSISFDDARSNKVLVYRSEN

SEQ ID NO: 211 - protein, 27 aa, Artificial Sequence
  Synthetic peptide
EVDHIIPRSVSFDNSYHNKVLVKQSEN

SEQ ID NO: 212 - protein, 27 aa, Artificial Sequence
  Synthetic peptide
DIDHILPYSITFDDSFRNKVLVTSQEN

SEQ ID NO: 213 - protein, 27 aa, Artificial Sequence
  Synthetic peptide
EIDHILPRSRSADDSFANKVLCLARAN

SEQ ID NO: 214 - protein, 27 aa, Artificial Sequence
  Synthetic peptide
EIEHLLPFSLTLDDSMANKTVCFRQAN

SEQ ID NO: 215 - protein, 27 aa, Artificial Sequence
  Synthetic peptide
DIDHILPFSVSLDDSAANKVVCLREAN

SEQ ID NO: 216 - protein, 27 aa, Artificial Sequence
  Synthetic peptide
DIDHLIPFSISWDDSAANKVVCMRYAN

SEQ ID NO: 217 - protein, 27 aa, Artificial Sequence
  Synthetic peptide
DIDHILPVAMTLDDSPANKIICMRYAN

SEQ ID NO: 218 - protein, 27 aa, Artificial Sequence
  Synthetic peptide
DVDHILPYSRTLDDSFPNRTLCLREAN

SEQ ID NO: 219 - protein, 27 aa, Artificial Sequence
  Synthetic peptide
EIEHILPFSRTLDDSLNNRTVAMRRAN

SEQ ID NO: 220 - protein, 27 aa, Artificial Sequence
  Synthetic peptide
EVDHIIPYSISWDDSYTNKVLTSAKCN

SEQ ID NO: 221 - protein, 27 aa, Artificial Sequence
  Synthetic peptide
QVDHILPWSRFGDDSYLNKTLCTARSN

SEQ ID NO: 222 - protein, 27 aa, Artificial Sequence
  Synthetic peptide
QVDHILPFSKTLDDSFANKVLAQHDAN

SEQ ID NO: 223 - protein, 27 aa, Artificial Sequence
  Synthetic peptide
QIDHAFPLSRSLDDSQSNKVLCLTSSN

SEQ ID NO: 224 - protein, 27 aa, Artificial Sequence
  Synthetic peptide
DIDHIVPRSISFDDSFSNLVIVNKLDN

SEQ ID NO: 225 - protein, 27 aa, Artificial Sequence
  Synthetic peptide
EIEHIIPYSMSYDNSQANKILTEKAEN

SEQ ID NO: 226 - protein, 27 aa, Artificial Sequence
  Synthetic peptide
EIDHVIPYSKSADDSWFNKLLVKKSTN

SEQ ID NO: 227 - protein, 27 aa, Artificial Sequence
  Synthetic peptide
EMDHILPYSRSLDNGWHNRVLVHGKDN

SEQ ID NO: 228 - protein, 27 aa, Artificial Sequence
  Synthetic peptide
EVDHIVPYSLILDNTINNKALVYAEEN

SEQ ID NO: 229 - protein, 27 aa, Artificial Sequence
  Synthetic peptide
EIEHVIPQSLYFDDSFSNKVICEAEVN

SEQ ID NO: 230 - protein, 27 aa, Artificial Sequence
  Synthetic peptide
DIEHIIPQARLFDDSFSNKTLEARSVN

SEQ ID NO: 231 - protein, 27 aa, Artificial Sequence
  Synthetic peptide
EIEHIVPKARVFDDSFSNKTLTFHRIN

SEQ ID NO: 232 - protein, 28 aa, Artificial Sequence
  Synthetic peptide
DKDHIIPQSMKKDDSIINNLVLVNKNAN

SEQ ID NO: 233 - protein, 27 aa, Artificial Sequence
  Synthetic peptide
EVEHIWPRSRSFDNSPRNKTLCRKDVN

SEQ ID NO: 234 - protein, 27 aa, Artificial Sequence
  Synthetic peptide
IVNHIIPYNRSFDDTYHNRVLTLTETK

SEQ ID NO: 235 - protein, 27 aa, Artificial Sequence
  Synthetic peptide
DMEHTIPKSISFDNSDQNLTLCESYYN

SEQ ID NO: 236 - protein, 27 aa, Artificial Sequence
  Synthetic peptide
DIEHTIPRSAGGDSTKMNLTLCSSRFN

SEQ ID NO: 237 - protein, 27 aa, Artificial Sequence
  Synthetic peptide
DIEHTIPRSISQDNSQMNKTLCSLKFN

SEQ ID NO: 238 - protein, 27 aa, Artificial Sequence
  Synthetic peptide
DIDHVIPLARGGRDSLDNMVLCQSDAN

SEQ ID NO: 239 - protein, 27 aa, Artificial Sequence
  Synthetic peptide
DIEHLFPIAESEDNGRNNLVISHSACN

SEQ ID NO: 240 - protein, 27 aa, Artificial Sequence
  Synthetic peptide
DVDHIFPRDDTADNSYGNKVVAHRQCN

SEQ ID NO: 241 - protein, 27 aa, Artificial Sequence
  Synthetic peptide
DIEHIVPQSLGGLSTDYNTIVTLKSVN

SEQ ID NO: 242 - protein, 27 aa, Artificial Sequence
  Synthetic peptide
ELDHIVPRTDGGSNRHENLAITCGACN

SEQ ID NO: 243 - protein, 28 aa, Artificial Sequence
  Synthetic peptide
EMDHIVPRKGVGSTNTRTNFAAVCAECN

SEQ ID NO: 244 - protein, 28 aa, Artificial Sequence
  Synthetic peptide
EMDHIVPRKGVGSTNTRVNLAAACAACN

SEQ ID NO: 245 - protein, 28 aa, Artificial Sequence
  Synthetic peptide
EMDHIVPRAGQGSTNTRENLVAVCHRCN

SEQ ID NO: 246 - protein, 33 aa, Artificial Sequence
  Synthetic polypeptide
EIDHILPRSLIKDARGIVFNAEPNLIYASSRGN

SEQ ID NO: 247 - protein, 33 aa, Artificial Sequence
  Synthetic polypeptide
EIDHIIPRSLTGRTKKTVFNSEANLIYCSSKGN

SEQ ID NO: 248 - protein, 33 aa, Artificial Sequence
  Synthetic polypeptide
EIDHIIPRSLTLKKSESIYNSEVNLIFVSAQGN

SEQ ID NO: 249 - protein, 33 aa, Artificial Sequence
  Synthetic polypeptide
EIDHIYPRSLSKKHFGVIFNSEVNLIYCSSQGN

SEQ ID NO: 250 - protein, 33 aa, Artificial Sequence
  Synthetic polypeptide
EIDHILPRSHTLKIYGTVFNPEGNLIYVHQKCN

SEQ ID NO: 251 - protein, 30 aa, Artificial Sequence
  Synthetic polypeptide
ELDHIIPRSHKKYGTLNDEANLICVTRGDN

SEQ ID NO: 252 - protein, 27 aa, Artificial Sequence
  Synthetic peptide
ELEHIVPHSFRQSNALSSLVLTWPGVN

SEQ ID NO: 253 - protein, 28 aa, Artificial Sequence
  Synthetic peptide
YDIDHIYPRSLTKDDSFDNLVLCERTAN

SEQ ID NO: 254 - protein, 28 aa, Artificial Sequence
  Synthetic peptide
DIDHIYPRSKVIKDDSFDNLVLVLKNEN

SEQ ID NO: 255 - protein, 27 aa, Artificial Sequence
  Synthetic peptide
DRDHIYPQSKIKDDSIDNLVLVNKTYN

SEQ ID NO: 256 - protein, 27 aa, Artificial Sequence
  Synthetic peptide
DIDHIYPRSKIKDDSITNRVLVEKDIN

SEQ ID NO: 257 - protein, 27 aa, Artificial Sequence
  Synthetic peptide
DIDHIYPQSKIKDDSISNRVLVCSSCN

SEQ ID NO: 258 - protein, 27 aa, Artificial Sequence
  Synthetic peptide
DIDHIYPQSKTMDDSLNNRVLVKKNYN

SEQ ID NO: 259 - protein, 27 aa, Artificial Sequence
  Synthetic peptide
DQDHIYPKSKIYDDSLENRVLVKKNLN

SEQ ID NO: 260 - protein, 27 aa, Artificial Sequence
  Synthetic peptide
QIDHIVPQSLVKDDSFDNRVLVVPSEN

SEQ ID NO: 261 - protein, 27 aa, Artificial Sequence
  Synthetic peptide
DIDHIIPQAFIKDNSIDNRVLTSSKEN

SEQ ID NO: 262 - protein, 27 aa, Artificial Sequence
  Synthetic peptide
DIDHIIPQAFLKDNSIDNKVLVSSASN

SEQ ID NO: 263 - protein, 27 aa, Artificial Sequence
  Synthetic peptide
DIDHIIPQAYTKDNSLDNRVLVSNITN

SEQ ID NO: 264 - protein, 27 aa, Artificial Sequence
  Synthetic peptide
DIDHIVPQSFITDNSIDNLVLTSSAGN

SEQ ID NO: 265 - protein, 27 aa, Artificial Sequence
  Synthetic peptide
DVDHIVPQSFLKDDSIDNKVLTRSDKN

SEQ ID NO: 266 - protein, 27 aa, Artificial Sequence
  Synthetic peptide
NIDHIYPQSMVKDDSLDNKVLVQSEIN

SEQ ID NO: 267 - protein, 27 aa, Artificial Sequence
  Synthetic peptide
DIDHILPQSLIKDDSLDNRVLVNATIN

SEQ ID NO: 268 - protein, 27 aa, Artificial Sequence
  Synthetic peptide
DIDHILPQSFIKDDSLENRVLVKKAVN

SEQ ID NO: 269 - protein, 27 aa, Artificial Sequence
  Synthetic peptide
EVDHIFPRSFIKDDSIDNKVLVIKKMN

SEQ ID NO: 270 - protein, 27 aa, Artificial Sequence
  Synthetic peptide
EVDHIIPRSYIKDDSFENKVLVYREEN

SEQ ID NO: 271 - protein, 27 aa, Artificial Sequence
  Synthetic peptide
DIDHIIPQAVTQNDSIDNRVLVARAEN

SEQ ID NO: 272 - protein, 27 aa, Artificial Sequence
  Synthetic peptide
DIDHIVPRSISFDDSFSNLVIVNKLDN

SEQ ID NO: 273 - protein, 27 aa, Artificial Sequence
  Synthetic peptide
EIDHIIPYSISFDDSSSNKLLVLAESN

SEQ ID NO: 274 - protein, 27 aa, Artificial Sequence
  Synthetic peptide
EIDHIIPYSLCFDDSSANKVLVHKQSN

SEQ ID NO: 275 - protein, 27 aa, Artificial Sequence
  Synthetic peptide
EIDHIIPISISLDDSINNKVLVLSKAN

SEQ ID NO: 276 - protein, 27 aa, Artificial Sequence
  Synthetic peptide
EVDHIIPISISLDDSITNKVLVTHREN

SEQ ID NO: 277 - protein, 27 aa, Artificial Sequence
  Synthetic peptide
EVDHILPLSITFDDSLANKVLVYATAN

SEQ ID NO: 278 - protein, 27 aa, Artificial Sequence
  Synthetic peptide
EIDHIIPRSISFDDARSNKVLVYRSEN

SEQ ID NO: 279 - protein, 27 aa, Artificial Sequence
  Synthetic peptide
EVDHIIPRSVSFDNSYHNKVLVKQSEN

SEQ ID NO: 280 - protein, 27 aa, Artificial Sequence
  Synthetic peptide
EVDHIIPYSISWDDSYTNKVLTSAKCN

SEQ ID NO: 281 - protein, 27 aa, Artificial Sequence
  Synthetic peptide
DIDHIIPYSRSMDDSYSNKVLVLSGEN

SEQ ID NO: 282 - protein, 27 aa, Artificial Sequence
  Synthetic peptide
EIEHIIPYSMSYDNSQANKILTEKAEN

SEQ ID NO: 283 - protein, 27 aa, Artificial Sequence
  Synthetic peptide
EVDHIVPYSLILDNTINNKALVYAEEN

SEQ ID NO: 284 - protein, 27 aa, Artificial Sequence
  Synthetic peptide
EIDHVIPYSKSADDSWFNKLLVKKSTN

SEQ ID NO: 285 - protein, 27 aa, Artificial Sequence
  Synthetic peptide
EMDHILPYSRSLDNGWHNRVLVHGKDN

SEQ ID NO: 286 - protein, 27 aa, Artificial Sequence
  Synthetic peptide
EIEHVIPQSLYFDDSFSNKVICEAEVN

SEQ ID NO: 287 - protein, 27 aa, Artificial Sequence
  Synthetic peptide
DIEHIIPQARLFDDSFSNKTLEARSVN

SEQ ID NO: 288 - protein, 27 aa, Artificial Sequence
  Synthetic peptide
EIEHIVPKARVFDDSFSNKTLTFHRIN

SEQ ID NO: 289 - protein, 28 aa, Artificial Sequence
  Synthetic peptide
DKDHIIPQSMKKDDSIINNLVLVNKNAN

SEQ ID NO: 290 - protein, 27 aa, Artificial Sequence
  Synthetic peptide
QVDHILPWSRFGDDSYLNKTLCTARSN

SEQ ID NO: 291 - protein, 27 aa, Artificial Sequence
  Synthetic peptide
DIDHVIPLARGGRDSLDNMVLCQSDAN

SEQ ID NO: 292 - protein, 27 aa, Artificial Sequence
  Synthetic peptide
DMEHTIPKSISFDNSDQNLTLCESYYN

SEQ ID NO: 293 - protein, 27 aa, Artificial Sequence
  Synthetic peptide
DIEHTIPRSAGGDSTKMNLTLCSSRFN

SEQ ID NO: 294 - protein, 27 aa, Artificial Sequence
  Synthetic peptide
DIEHTIPRSISQDNSQMNKTLCSLKFN

SEQ ID NO: 295 - protein, 27 aa, Artificial Sequence
  Synthetic peptide
DIEHLFPIAESEDNGRNNLVISHSACN

SEQ ID NO: 296 - protein, 27 aa, Artificial Sequence
  Synthetic peptide
DVDHIFPRDDTADNSYGNKVVAHRQCN

SEQ ID NO: 297 - protein, 27 aa, Artificial Sequence
  Synthetic peptide
DIEHIVPQSLGGLSTDYNTIVTLKSVN

SEQ ID NO: 298 - protein, 27 aa, Artificial Sequence
  Synthetic peptide
ELDHIVPRTDGGSNRHENLAITCGACN

SEQ ID NO: 299 - protein, 28 aa, Artificial Sequence
  Synthetic peptide
EMDHIVPRKGVGSTNTRTNFAAVCAECN

SEQ ID NO: 300 - protein, 28 aa, Artificial Sequence
  Synthetic peptide
EMDHIVPRKGVGSTNTRVNLAAACAACN

SEQ ID NO: 301 - protein, 28 aa, Artificial Sequence
  Synthetic peptide
EMDHIVPRAGQGSTNTRENLVAVCHRCN

SEQ ID NO: 302 - protein, 27 aa, Artificial Sequence
  Synthetic peptide
ELEHIVPHSFRQSNALSSLVLTWPGVN

SEQ ID NO: 303 - DNA, 3333 bp, Artificial Sequence
  Synthetic polynucleotide
atggtgcctaagaagaagagaaaggtggctgccttcaaacctaattcaatcaactacatcctcggcctcgatatcggcatcgcatccgtcggctgggcgatggtagaaattgacgaagaagaaaaccccatccgcctgattgatttgggcgtgcgcgtatttgagcgtgccgaagtaccgaaaacaggcgactcccttgccatggcaaggcgtttggcgcgcagtgttcgccgcctgacccgccgtcgcgcccaccgcctgcttcggacccgccgcctattgaaacgcgaaggcgtattacaagccgccaattttgacgaaaacggcttgattaaatccttaccgaatacaccatggcaacttcgcgcagccgcattagaccgcaaactgacgcctttagagtggtcggcagtcttgttgcatttaatcaaacatcgcggctatttatcgcaacggaaaaacgagggcgaaactgccgataaggagcttggcgctttgcttaaaggcgtagccggcaatgcccatgccttacagacaggcgatttccgcacaccggccgaattggctttaaataaatttgagaaagaaagcggccatatccgcaatcagcgcagcgattattcgcatacgttcagccgcaaagatttacaggcggagctgattttgctgtttgaaaaacaaaaagaatttggcaatccgcatgtttcaggcggccttaaagaaggtattgaaaccctactgatgacgcaacgccctgccctgtccggcgatgccgttcaaaaaatgttggggcattgcaccttcgaaccggcagagccgaaagccgctaaaaacacctacacagccgaacgtttcatctggctgaccaagctgaacaacctgcgtattttagagcaaggcagcgagcggccattgaccgataccgaacgcgccacgcttatggacgagccatacagaaaatccaaactgacttacgcacaagcccgtaagctgctgggtttagaagataccgcctttttcaaaggcttgcgctatggtaaagacaatgccgaagcctcaacattgatggaaatgaaggcctaccatgccatcagccgtgcactggaaaaagaaggattgaaagacaaaaaatccccattaaacctttctcccgaattacaagacgaaatcggcacggcattctccctgttcaaaaccgatgaagacattacaggccgtctgaaagaccgtatacagcccgaaatcttagaagcgctgttgaaacacatcagcttcgataagttcgtccaaatttccttgaaagcattgcgccgaattgtgcctctaatggaacaaggcaaacgttacgatgaagcctgcgccgaaatctacggagaccattacggcaagaagaatacggaagaaaagatttatctgccgccgattcccgccgacgaaatccgcaaccccgtcgtcttgcgcgccttatctcaagcacgtaaggtcattaacggcgtggtacgccgttacggctccccagctcgtatccatattgaaactgcaagggaagtaggtaaatcgtttaaagaccgcaaagaaattgagaaacgccaagaagaaaaccgcaaagaccgggaaaaagccgccgccaaattccgagagtatttccccaattttgtcggagaacccaaatccaaagatattctgaaactgcgcctgtacgagcaacaacacggcaaatgcctgtattcgggcaaagaaatcaacttaggccgtctgaacgaaaaaggctatgtcgaaatcgaccatgccctgccgttctcgcgcacatgggacgacagtttcaacaataaagtactggtattgggcagcgaaaaccaaaacaaaggcaatcaaaccccttacgaatacttcaacggcaaagacaacagccgcgaatggcaggaatttaaagcgcgtgtcgaaaccagccgtttcccgcgcagtaaaaaacaacggattctgctgcaaaaattcgatgaagacggctttaaagaacgcaatctgaacgacacgcgctacgtcaaccgtttcctgtgtcaatttgttgccgaccgtatgcggctgacaggtaaaggcaagaaacgtgtctttgcatccaacggacaaattaccaatctgttgcgcggcttttggggattgcgcaaagtgcgtgcggaaaacgaccgccatcacgccttggacgccgtcgtcgttgcctgctcgaccgttgccatgcagcagaaaattacccgttttgtacgctataaagagatgaacgcgtttgacggtaaaaccatagacaaagaaacaggagaagtgctgcatcaaaaaacacacttcccacaaccttgggaatttttcgcacaagaagtcatgattcgcgtcttcggcaaaccggacggcaaacccgaattcgaagaagccgataccctagaaaaactgcgcacgttgcttgccgaaaaattatcatctcgccccgaagccgtacacgaatacgttacgccactgtttgtttcacgcgcgcccaatcggaagatgagcgggcaagggcatatggagaccgtcaaatccgccaaacgactggacgaaggcgtcagcgtgttgcgcgtaccgctgacacagttaaaactgaaagacttggaaaaaatggtcaatcgggagcgcgaacctaagctatacgaagcactgaaagcacggctggaagcacataaagacgatcctgccaaagcctttgccgagccgttttacaaatacgataaagcaggcaaccgcacccaacaggtaaaagccgtacgcgtagagcaagtacagaaaaccggcgtatgggtgcgcaaccataacggtattgccgacaacgcaaccatggtgcgcgtagatgtgtttgagaaaggcgacaagtattatctggtaccgatttacagttggcaggtagcgaaagggattttgccggatagggctgttgtacaaggaaaagatgaagaagattggcaacttattgatgatagtttcaactttaaattctcattacaccctaatgatttagtcgaggttataacaaaaaaagctagaatgtttggttactttgccagctgccatcgaggcacaggtaatatcaatatacgcattcatgatcttgatcataaaattggcaaaaatggaatactggaaggtatcggcgtcaaaaccgccctttcattccaaaaataccaaattgacgaactgggcaaagaaatcagaccatgccgtctgaaaaaacgcccgcctgtccgttacccatacgatgttccagattacgctgcagctccagcagcgaagaaaaagaagctggattaa

SEQ ID NO: 304 - protein, 1053 aa, Staphylococcus aureus; identical to SEQ ID NO: 26

SEQ ID NO: 305 - protein, 1368 aa, Streptococcus pyogenes [sequence omitted]

SEQ ID NO: 306 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 307 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 308 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 309 - protein, 1397 aa, Veillonella atypica
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 310 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 311 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 312 - protein, 1389 aa, Oenococcus kitaharae
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 313 - protein, 1323 aa, Fructobacillus fructosus
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 314 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 315 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 316 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 317 - protein, 1391 aa, Eubacterium yurii
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 318 - protein, 1364 aa, Peptoniphilus duerdenii
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 319 - protein, 1358 aa, Acidaminococcus sp.
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 320 - protein, 1356 aa, Lactobacillus farciminis
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 321 - protein, 1421 aa, Streptococcus sanguinis
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 322 - protein, 1338 aa, Coprococcus catus
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 323 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 324 - protein, 1368 aa, Streptococcus pyogenes [sequence omitted]

SEQ ID NO: 325 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 326 - protein, 1374 aa, Fusobacterium nucleatum
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 327 - protein, 1333 aa, Planococcus antarcticus
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 328 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 329 - protein, 1327 aa, Solobacterium moorei
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 330 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 331 - protein, 1472 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHQFTAFVEGIDFKVLPSGKFEKI

SEQ ID NO: 332 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 333 - protein, 1415 aa, Bergeyella zoohelcum
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 334 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 335 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 336 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 337 - protein, 1517 aa, Bacteroides sp.
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 338 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 339 - protein, 1424 aa, Prevotella sp.
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 340 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 341 - protein, 1146 aa, Alicyclobacillus hesperidum
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 342 - protein, 1442 aa, Caenispirillum salinarum
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 343 - protein, 1114 aa, Eubacterium rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 344 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 345 - protein, 1197 aa, Porphyromonas sp.
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 346 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 347 - protein, 1152 aa, Roseburia inulinivorans
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 348 - protein, 1082 aa, Methylosinus trichosporium
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 349 - protein, 1156 aa, Ruminococcus albus
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 350 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 351 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 352 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 353 - protein, 1105 aa, Actinomyces coleocanis
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 354 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 355 - protein, 1181 aa, Actinomyces sp.
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 356 - protein, 1113 aa, Alcanivorax sp.
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 357 - protein, 1052 aa, Aminomonas paucivorans
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 358 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 359 - protein, 1119 aa, Lactobacillus coryniformis
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 360 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 361 - protein, 1082 aa, Neisseria meningitidis; identical to SEQ ID NO: 25

SEQ ID NO: 362 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 363 - protein, 1059 aa, Rhodovulum sp.
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 364 - protein, 1096 aa, Eubacterium dolichum
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 365 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 366 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 367 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 368 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 369 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 370 - protein, 1179 aa, Sphaerochaeta globus
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 371 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 372 - protein, 1061 aa, Treponema sp.
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 373 - protein, 1011 aa, Unknown
  Uncultured delta polypeptide
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 374 - protein, 1029 aa, Alicycliphilus denitrificans
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 375 - protein, 1168 aa, Azospirillum sp.
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 376 - protein, 1064 aa, Bradyrhizobium sp.
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 377 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 378 - protein, 1218 aa, Prevotella timonensis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 379 - protein, 1088 aa, Bacillus smithii
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 380 - protein, 1035 aa, Puniceispirillum marinum
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 381 - protein, 1153 aa, Barnesiella intestinihominis
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 382 - protein, 1062 aa, Ralstonia syzygii
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 383 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 384 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 385 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 386 - protein, 1265 aa, Mycoplasma ovipneumoniae
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 387 - RNA, 20 nt, Artificial Sequence
  Synthetic
aaggugaacguggaugaagu

SEQ ID NO: 388 - RNA, 20 nt, Artificial Sequence
  Synthetic
guaacggcagacuucuccuc

SEQ ID NO: 389 - RNA, 17 nt, Artificial Sequence
  Synthetic
gugaacguggaugaagu

SEQ ID NO: 390 - RNA, 17 nt, Artificial Sequence
  Synthetic
acggcagacuucuccuc

SEQ ID NO: 391 - RNA, 20 nt, Artificial Sequence
  Synthetic
gaaguugguggugaggcccu

SEQ ID NO: 392 - RNA, 20 nt, Artificial Sequence
  Synthetic
gcaaccucaaacagacacca

SEQ ID NO: 393 - RNA, 17 nt, Artificial Sequence
  Synthetic
gccccacagggcaguaa

SEQ ID NO: 394 - RNA, 17 nt, Artificial Sequence
  Synthetic
gccguuacugcccugug

SEQ ID NO: 395 - RNA, 17 nt, Artificial Sequence
  Synthetic
ggagaccaauagaaacu

SEQ ID NO: 396 - RNA, 17 nt, Artificial Sequence
  Synthetic
ggaugaaguugguggug

SEQ ID NO: 397 - RNA, 17 nt, Artificial Sequence
  Synthetic
ggugcaucugacuccug

SEQ ID NO: 398 - RNA, 20 nt, Artificial Sequence
  Synthetic
gucugccguuacugcccugu

SEQ ID NO: 399 - RNA, 20 nt, Artificial Sequence
  Synthetic
gugaacguggaugaaguugg

SEQ ID NO: 400 - RNA, 17 nt, Artificial Sequence
  Synthetic
guggggcaaggugaacg

SEQ ID NO: 401 - RNA, 17 nt, Artificial Sequence
  Synthetic
guggugaggcccugggc

SEQ ID NO: 402 - RNA, 17 nt, Artificial Sequence
  Synthetic
guuacaagacagguuua

SEQ ID NO: 403 - RNA, 17 nt, Artificial Sequence
  Synthetic
guucaccuugccccaca

SEQ ID NO: 404 - RNA, 17 nt, Artificial Sequence
  Synthetic
guugguggugaggcccu

SEQ ID NO: 405 - RNA, 17 nt, Artificial Sequence
  Synthetic
aacguggaugaaguugg

SEQ ID NO: 406 - RNA, 20 nt, Artificial Sequence
  Synthetic
aagguuacaagacagguuua

SEQ ID NO: 407 - RNA, 17 nt, Artificial Sequence
  Synthetic
acaugcccaguuucuau

SEQ ID NO: 408 - RNA, 17 nt, Artificial Sequence
  Synthetic
accauggugucuguuug

SEQ ID NO: 409 - RNA, 17 nt, Artificial Sequence
  Synthetic
accucaaacagacacca

SEQ ID NO: 410 - RNA, 20 nt, Artificial Sequence
  Synthetic
accuugauaccaaccugccc

SEQ ID NO: 411 - RNA, 17 nt, Artificial Sequence
  Synthetic
aggagaccaauagaaac

SEQ ID NO: 412 - RNA, 17 nt, Artificial Sequence
  Synthetic
aggagucagaugcacca

SEQ ID NO: 413 - RNA, 20 nt, Artificial Sequence
  Synthetic
agucugccguuacugcccug

SEQ ID NO: 414 - RNA, 17 nt, Artificial Sequence
  Synthetic
aguugguggugaggccc

SEQ ID NO: 415 - RNA, 20 nt, Artificial Sequence
  Synthetic
cacguucaccuugccccaca

SEQ ID NO: 416 - RNA, 20 nt, Artificial Sequence
  Synthetic
cauggugcaucugacuccug

SEQ ID NO: 417 - RNA, 20 nt, Artificial Sequence
  Synthetic
ccacguucaccuugccccac

SEQ ID NO: 418 - RNA, 20 nt, Artificial Sequence
  Synthetic
cccugggcagguugguauca

SEQ ID NO: 419 - RNA, 20 nt, Artificial Sequence
  Synthetic
ccuguggggcaaggugaacg

SEQ ID NO: 420 - RNA, 20 nt, Artificial Sequence
  Synthetic
ccuugauaccaaccugccca

SEQ ID NO: 421 - RNA, 20 nt, Artificial Sequence
  Synthetic
cguggaugaaguugguggug

SEQ ID NO: 422 - RNA, 20 nt, Artificial Sequence
  Synthetic
cguuacugcccuguggggca

SEQ ID NO: 423 - RNA, 17 nt, Artificial Sequence
  Synthetic
cguucaccuugccccac

SEQ ID NO: 424 - RNA, 20 nt, Artificial Sequence
  Synthetic
cucaggagucagaugcacca

SEQ ID NO: 425 - RNA, 17 nt, Artificial Sequence
  Synthetic
cugccguuacugcccug

SEQ ID NO: 426 - RNA, 20 nt, Artificial Sequence
  Synthetic
cuugccccacagggcaguaa

SEQ ID NO: 427 - RNA, 20 nt, Artificial Sequence
  Synthetic
uaaggagaccaauagaaacu

SEQ ID NO: 428 - RNA, 17 nt, Artificial Sequence
  Synthetic
uacugcccuguggggca

SEQ ID NO: 429 - RNA, 17 nt, Artificial Sequence
  Synthetic
uaucaagguuacaagac

SEQ ID NO: 430 - RNA, 20 nt, Artificial Sequence
  Synthetic
ucugccguuacugcccugug

SEQ ID NO: 431 - RNA, 20 nt, Artificial Sequence
  Synthetic
ugaaguugguggugaggccc

SEQ ID NO: 432 - RNA, 17 nt, Artificial Sequence
  Synthetic
ugaggcccugggcaggu

SEQ ID NO: 433 - RNA, 17 nt, Artificial Sequence
  Synthetic
ugauaccaaccugccca

SEQ ID NO: 434 - RNA, 20 nt, Artificial Sequence
  Synthetic
ugcaccauggugucuguuug

SEQ ID NO: 435 - RNA, 17 nt, Artificial Sequence
  Synthetic
ugccguuacugcccugu

SEQ ID NO: 436 - RNA, 17 nt, Artificial Sequence
  Synthetic
ugggcagguugguauca

SEQ ID NO: 437 - RNA, 20 nt, Artificial Sequence
  Synthetic
ugguaucaagguuacaagac

SEQ ID NO: 438 - RNA, 20 nt, Artificial Sequence
  Synthetic
uggugaggcccugggcaggu

SEQ ID NO: 439 - RNA, 20 nt, Artificial Sequence
  Synthetic
uuaaggagaccaauagaaac

SEQ ID NO: 440 - RNA, 17 nt, Artificial Sequence
  Synthetic
uugauaccaaccugccc

SEQ ID NO: 441 - RNA, 20 nt, Artificial Sequence
  Synthetic
uugguggugaggcccugggc

SEQ ID NO: 442 - RNA, 20 nt, Artificial Sequence
  Synthetic
caccauggugcaucugacuc

SEQ ID NO: 443 - RNA, 20 nt, Artificial Sequence
  Synthetic
ccauggugcaucugacuccu

SEQ ID NO: 444 - RNA, 20 nt, Artificial Sequence
  Synthetic
cauggugcaucugacuccug

SEQ ID NO: 445 - RNA, 20 nt, Artificial Sequence
  Synthetic
uggugcaucugacuccugag

SEQ ID NO: 446 - RNA, 20 nt, Artificial Sequence
  Synthetic
aagucugccguuacugcccu

SEQ ID NO: 447 - RNA, 20 nt, Artificial Sequence
  Synthetic
agucugccguuacugcccug

SEQ ID NO: 448 - RNA, 20 nt, Artificial Sequence
  Synthetic
uuacugcccuguggggcaag

SEQ ID NO: 449 - RNA, 20 nt, Artificial Sequence
  Synthetic
cccuguggggcaaggugaac

SEQ ID NO: 450 - RNA, 20 nt, Artificial Sequence
  Synthetic
guggggcaaggugaacgugg

SEQ ID NO: 451 - RNA, 20 nt, Artificial Sequence
  Synthetic
gaacguggaugaaguuggug

SEQ ID NO: 452 - RNA, 20 nt, Artificial Sequence
  Synthetic
augaaguugguggugaggcc

SEQ ID NO: 453 - RNA, 20 nt, Artificial Sequence
  Synthetic
caagguuacaagacagguuu

SEQ ID NO: 454 - RNA, 20 nt, Artificial Sequence
  Synthetic
aagguuacaagacagguuua

SEQ ID NO: 455 - RNA, 20 nt, Artificial Sequence
  Synthetic
gacagguuuaaggagaccaa

SEQ ID NO: 456 - RNA, 20 nt, Artificial Sequence
  Synthetic
uuuaaggagaccaauagaaa

SEQ ID NO: 457 - RNA, 17 nt, Artificial Sequence
  Synthetic
cauggugcaucugacuc

SEQ ID NO: 458 - RNA, 17 nt, Artificial Sequence
  Synthetic
uggugcaucugacuccu

SEQ ID NO: 459 - RNA, 17 nt, Artificial Sequence
  Synthetic
ggugcaucugacuccug

SEQ ID NO: 460 - RNA, 17 nt, Artificial Sequence
  Synthetic
ugcaucugacuccugag

SEQ ID NO: 461 - RNA, 17 nt, Artificial Sequence
  Synthetic
ucugccguuacugcccu

SEQ ID NO: 462 - RNA, 17 nt, Artificial Sequence
  Synthetic
cugccguuacugcccug

SEQ ID NO: 463 - RNA, 17 nt, Artificial Sequence
  Synthetic
cugcccuguggggcaag

SEQ ID NO: 464 - RNA, 17 nt, Artificial Sequence
  Synthetic
uguggggcaaggugaac

SEQ ID NO: 465 - RNA, 17 nt, Artificial Sequence
  Synthetic
gggcaaggugaacgugg

SEQ ID NO: 466 - RNA, 17 nt, Artificial Sequence
  Synthetic
cguggaugaaguuggug

SEQ ID NO: 467 - RNA, 17 nt, Artificial Sequence
  Synthetic
aaguugguggugaggcc

SEQ ID NO: 468 - RNA, 17 nt, Artificial Sequence
  Synthetic
gguuacaagacagguuu

SEQ ID NO: 469 - RNA, 17 nt, Artificial Sequence
  Synthetic
guuacaagacagguuua

SEQ ID NO: 470 - RNA, 17 nt, Artificial Sequence
  Synthetic
agguuuaaggagaccaa

SEQ ID NO: 471 - RNA, 17 nt, Artificial Sequence
  Synthetic
aaggagaccaauagaaa

SEQ ID NO: 472 - RNA, 20 nt, Artificial Sequence
  Synthetic
gcuagugaacacaguugugu

SEQ ID NO: 473 - RNA, 20 nt, Artificial Sequence
  Synthetic
gugucuguuugagguugcua

SEQ ID NO: 474 - RNA, 20 nt, Artificial Sequence
  Synthetic
agaugcaccauggugucugu

SEQ ID NO: 475 - RNA, 20 nt, Artificial Sequence
  Synthetic
guaacggcagacuucuccuc

SEQ ID NO: 476 - RNA, 20 nt, Artificial Sequence
  Synthetic
aguaacggcagacuucuccu

SEQ ID NO: 477 - RNA, 20 nt, Artificial Sequence
  Synthetic
uccacguucaccuugcccca

SEQ ID NO: 478 - RNA, 20 nt, Artificial Sequence
  Synthetic
aaccuugauaccaaccugcc

SEQ ID NO: 479 - RNA, 17 nt, Artificial Sequence
  Synthetic
agugaacacaguugugu

SEQ ID NO: 480 - RNA, 17 nt, Artificial Sequence
  Synthetic
ucuguuugagguugcua

SEQ ID NO: 481 - RNA, 17 nt, Artificial Sequence
  Synthetic
ugcaccauggugucugu

SEQ ID NO: 482 - RNA, 17 nt, Artificial Sequence
  Synthetic
acggcagacuucuccuc

SEQ ID NO: 483 - RNA, 17 nt, Artificial Sequence
  Synthetic
aacggcagacuucuccu

SEQ ID NO: 484 - RNA, 17 nt, Artificial Sequence
  Synthetic
acguucaccuugcccca

SEQ ID NO: 485 - RNA, 17 nt, Artificial Sequence
  Synthetic
cuugauaccaaccugcc

SEQ ID NO: 486 - RNA, 20 nt, Artificial Sequence
  Synthetic
uggcauccaggucacgccag

SEQ ID NO: 487 - RNA, 20 nt, Artificial Sequence
  Synthetic
gaugcuuuuuucaucucgau

SEQ ID NO: 488 - RNA, 20 nt, Artificial Sequence
  Synthetic
gcauccaaucccguggaggu

SEQ ID NO: 489 - RNA, 20 nt, Artificial Sequence
  Synthetic
uuuucaucucgauuggugaa

SEQ ID NO: 490 - RNA, 20 nt, Artificial Sequence
  Synthetic
ccagaugaacuucccauugg

SEQ ID NO: 491 - RNA, 20 nt, Artificial Sequence
  Synthetic
aggaggucaugauccccuuc

SEQ ID NO: 492 - RNA, 17 nt, Artificial Sequence
  Synthetic
cauccaggucacgccag

SEQ ID NO: 493 - RNA, 17 nt, Artificial Sequence
  Synthetic
gcuuuuuucaucucgau

SEQ ID NO: 494 - RNA, 17 nt, Artificial Sequence
  Synthetic
uccaaucccguggaggu

SEQ ID NO: 495 - RNA, 17 nt, Artificial Sequence
  Synthetic
ucaucucgauuggugaa

SEQ ID NO: 496 - RNA, 17 nt, Artificial Sequence
  Synthetic
gaugaacuucccauugg

SEQ ID NO: 497 - RNA, 17 nt, Artificial Sequence
  Synthetic
aggucaugauccccuuc

SEQ ID NO: 498 - RNA, 20 nt, Artificial Sequence
  Synthetic
gaaaaaagcauccaaucccg

SEQ ID NO: 499 - RNA, 20 nt, Artificial Sequence
  Synthetic
gaaccagaccacggcccguu

SEQ ID NO: 500 - RNA, 20 nt, Artificial Sequence
  Synthetic
gaccuggaugccaaccucca

SEQ ID NO: 501 - RNA, 20 nt, Artificial Sequence
  Synthetic
gagcuccaugugcagaacga

SEQ ID NO: 502 - RNA, 17 nt, Artificial Sequence
  Synthetic
gagcucccaacgggccg

SEQ ID NO: 503 - RNA, 20 nt, Artificial Sequence
  Synthetic
gagcucuaauccccacgccu

SEQ ID NO: 504 - RNA, 20 nt, Artificial Sequence
  Synthetic
gagugcagaauaugccccgc

SEQ ID NO: 505 - RNA, 20 nt, Artificial Sequence
  Synthetic
gauaaacaaucgucauccuc

SEQ ID NO: 506 - RNA, 20 nt, Artificial Sequence
  Synthetic
gaucaugaccuccucaccug

SEQ ID NO: 507 - RNA, 17 nt, Artificial Sequence
  Synthetic
gaugaugaaccagacca

SEQ ID NO: 508 - RNA, 20 nt, Artificial Sequence
  Synthetic
gaugccaaccuccacgggau

SEQ ID NO: 509 - RNA, 17 nt, Artificial Sequence
  Synthetic
gcacucaucccaggcgu

SEQ ID NO: 510 - RNA, 17 nt, Artificial Sequence
  Synthetic
gcagaauaugccccgca

SEQ ID NO: 511 - RNA, 20 nt, Artificial Sequence
  Synthetic
gcauauucugcacucauccc

SEQ ID NO: 512 - RNA, 17 nt, Artificial Sequence
  Synthetic
gccaaccuccacgggau

SEQ ID NO: 513 - RNA, 20 nt, Artificial Sequence
  Synthetic
gccagaugaacuucccauug

SEQ ID NO: 514 - RNA, 20 nt, Artificial Sequence
  Synthetic
gcccguugggagcuccagaa

SEQ ID NO: 515 - RNA, 17 nt, Artificial Sequence
  Synthetic
gcuauguguuccuguuu

SEQ ID NO: 516 - RNA, 17 nt, Artificial Sequence
  Synthetic
gcuccaugugcagaacg

SEQ ID NO: 517 - RNA, 20 nt, Artificial Sequence
  Synthetic
gcucccaacgggccgugguc

SEQ ID NO: 518 - RNA, 17 nt, Artificial Sequence
  Synthetic
gcucuaauccccacgcc

SEQ ID NO: 519 - RNA, 20 nt, Artificial Sequence
  Synthetic
gcugggguuugccuugcuug

SEQ ID NO: 520 - RNA, 20 nt, Artificial Sequence
  Synthetic
ggagcucuaauccccacgcc

SEQ ID NO: 521 - RNA, 17 nt, Artificial Sequence
  Synthetic
ggcacugcccacaggug

SEQ ID NO: 522 - RNA, 20 nt, Artificial Sequence
  Synthetic
ggcacugcccacaggugagg

SEQ ID NO: 523 - RNA, 20 nt, Artificial Sequence
  Synthetic
ggcccguugggagcuccaga

SEQ ID NO: 524 - RNA, 17 nt, Artificial Sequence
  Synthetic
gggguuugccuugcuug

SEQ ID NO: 525 - RNA, 17 nt, Artificial Sequence
  Synthetic
guaagaauggcuucaag

SEQ ID NO: 526 - RNA, 20 nt, Artificial Sequence
  Synthetic
gugcagaacgaggggaggag

SEQ ID NO: 527 - RNA, 20 nt, Artificial Sequence
  Synthetic
gugccagaugaacuucccau

SEQ ID NO: 528 - RNA, 20 nt, Artificial Sequence
  Synthetic
guucaucuggcacugcccac

SEQ ID NO: 529 - RNA, 17 nt, Artificial Sequence
  Synthetic
guugggagcuccagaag

SEQ ID NO: 530 - RNA, 17 nt, Artificial Sequence
  Synthetic
aaaagcauccaaucccg

SEQ ID NO: 531 - RNA, 20 nt, Artificial Sequence
  Synthetic
aaaagcauccaaucccgugg

SEQ ID NO: 532 - RNA, 20 nt, Artificial Sequence
  Synthetic
aaaauaagaaugucccccaa

SEQ ID NO: 533 - RNA, 17 nt, Artificial Sequence
  Synthetic
aaacaaucgucauccuc

SEQ ID NO: 534 - RNA, 17 nt, Artificial Sequence
  Synthetic
aaacggaaacaaugcaa

SEQ ID NO: 535 - RNA, 17 nt, Artificial Sequence
  Synthetic
aaacuucugcacuggag

SEQ ID NO: 536 - RNA, 20 nt, Artificial Sequence
  Synthetic
aaauaagaaugucccccaau

SEQ ID NO: 537 - RNA, 20 nt, Artificial Sequence
  Synthetic
aaccccagcacuuaagcaaa

SEQ ID NO: 538 - RNA, 20 nt, Artificial Sequence
  Synthetic
acagaugaugaaccagacca

SEQ ID NO: 539 - RNA, 17 nt, Artificial Sequence
  Synthetic
accagaccacggcccgu

SEQ ID NO: 540 - RNA, 20 nt, Artificial Sequence
  Synthetic
accccagcacuuaagcaaac

SEQ ID NO: 541 - RNA, 20 nt, Artificial Sequence
  Synthetic
accuggaugccaaccuccac

SEQ ID NO: 542 - RNA, 17 nt, Artificial Sequence
  Synthetic
acugcccacaggugagg

SEQ ID NO: 543 - RNA, 20 nt, Artificial Sequence
  Synthetic
agagcuccaugugcagaacg

SEQ ID NO: 544 - RNA, 17 nt, Artificial Sequence
  Synthetic
agaugaacuucccauug

SEQ ID NO: 545 - RNA, 17 nt, Artificial Sequence
  Synthetic
agcauccaaucccgugg

SEQ ID NO: 546 - RNA, 20 nt, Artificial Sequence
  Synthetic
agcuccaugugcagaacgag

SEQ ID NO: 547 - RNA, 17 nt, Artificial Sequence
  Synthetic
aggaauuugccccaaac

SEQ ID NO: 548 - RNA, 20 nt, Artificial Sequence
  Synthetic
agugcagaauaugccccgca

SEQ ID NO: 549 - RNA, 17 nt, Artificial Sequence
  Synthetic
auaagaaugucccccaa

SEQ ID NO: 550 - RNA, 20 nt, Artificial Sequence
  Synthetic
aucaugaccuccucaccugu

SEQ ID NO: 551 - RNA, 20 nt, Artificial Sequence
  Synthetic
aucucgauuggugaagggga

SEQ ID NO: 552 - RNA, 17 nt, Artificial Sequence
  Synthetic
augaccuccucaccugu

SEQ ID NO: 553 - RNA, 17 nt, Artificial Sequence
  Synthetic
augugcagaacgagggg

SEQ ID NO: 554 - RNA, 20 nt, Artificial Sequence
  Synthetic
auucccguuugcuuaagugc

SEQ ID NO: 555 - RNA, 17 nt, Artificial Sequence
  Synthetic
auuggugaaggggaagg

SEQ ID NO: 556 - RNA, 20 nt, Artificial Sequence
  Synthetic
cacaaacggaaacaaugcaa

SEQ ID NO: 557 - RNA, 17 nt, Artificial Sequence
  Synthetic
cacucaucccaggcgug

SEQ ID NO: 558 - RNA, 17 nt, Artificial Sequence
  Synthetic
cagaacgaggggaggag

SEQ ID NO: 559 - RNA, 17 nt, Artificial Sequence
  Synthetic
cagaugaacuucccauu

SEQ ID NO: 560 - RNA, 17 nt, Artificial Sequence
  Synthetic
cagcuuuuucuaagcag

SEQ ID NO: 561 - RNA, 17 nt, Artificial Sequence
  Synthetic
cauccucuggcgugacc

SEQ ID NO: 562 - RNA, 17 nt, Artificial Sequence
  Synthetic
caucucgauuggugaag

SEQ ID NO: 563 - RNA, 17 nt, Artificial Sequence
  Synthetic
caucuggcacugcccac

SEQ ID NO: 564 - RNA, 17 nt, Artificial Sequence
  Synthetic
caugaccuccucaccug

SEQ ID NO: 565 - RNA, 17 nt, Artificial Sequence
  Synthetic
ccaaugggaaguucauc

SEQ ID NO: 566 - RNA, 20 nt, Artificial Sequence
  Synthetic
ccacagcuuuuucuaagcag

SEQ ID NO: 567 - RNA, 17 nt, Artificial Sequence
  Synthetic
ccagaccacggcccguu

SEQ ID NO: 568 - RNA, 17 nt, Artificial Sequence
  Synthetic
ccagaugaacuucccau

SEQ ID NO: 569 - RNA, 17 nt, Artificial Sequence
  Synthetic
ccagcacuuaagcaaac

SEQ ID NO: 570 - RNA, 17 nt, Artificial Sequence
  Synthetic
cccaacgggccgugguc

SEQ ID NO: 571 - RNA, 17 nt, Artificial Sequence
  Synthetic
cccagcacuuaagcaaa

SEQ ID NO: 572 - RNA, 20 nt, Artificial Sequence
  Synthetic
cccccaaugggaaguucauc

SEQ ID NO: 573 - RNA, 20 nt, Artificial Sequence
  Synthetic
ccccuucuggagcucccaac

SEQ ID NO: 574 - RNA, 20 nt, Artificial Sequence
  Synthetic
cccguugggagcuccagaag

SEQ ID NO: 575 - RNA, 17 nt, Artificial Sequence
  Synthetic
cccguuugcuuaagugc

SEQ ID NO: 576 - RNA, 17 nt, Artificial Sequence
  Synthetic
ccguugggagcuccaga

SEQ ID NO: 577 - RNA, 17 nt, Artificial Sequence
  Synthetic
ccguuugcuuaagugcu

SEQ ID NO: 578 - RNA, 20 nt, Artificial Sequence
  Synthetic
ccucugcuuagaaaaagcug

SEQ ID NO: 579 - RNA, 17 nt, Artificial Sequence
  Synthetic
ccuucuggagcucccaa

SEQ ID NO: 580 - RNA, 20 nt, Artificial Sequence
  Synthetic
cgucauccucuggcgugacc

SEQ ID NO: 581 - RNA, 17 nt, Artificial Sequence
  Synthetic
cguggagguuggcaucc

SEQ ID NO: 582 - RNA, 17 nt, Artificial Sequence
  Synthetic
cguugggagcuccagaa

SEQ ID NO: 583 - RNA, 17 nt, Artificial Sequence
  Synthetic
cguuugcuuaagugcug

SEQ ID NO: 584 - RNA, 17 nt, Artificial Sequence
  Synthetic
cuauguguuccuguuug

SEQ ID NO: 585 - RNA, 17 nt, Artificial Sequence
  Synthetic
cuccaugugcagaacga

SEQ ID NO: 586 - RNA, 17 nt, Artificial Sequence
  Synthetic
cucuaauccccacgccu

SEQ ID NO: 587 - RNA, 20 nt, Artificial Sequence
  Synthetic
cugcacucaucccaggcgug

SEQ ID NO: 588 - RNA, 17 nt, Artificial Sequence
  Synthetic
cugcuuagaaaaagcug

SEQ ID NO: 589 - RNA, 20 nt, Artificial Sequence
  Synthetic
cuggagcucccaacgggccg

SEQ ID NO: 590 - RNA, 17 nt, Artificial Sequence
  Synthetic
cuggaugccaaccucca

SEQ ID NO: 591 - RNA, 17 nt, Artificial Sequence
  Synthetic
cuucuggagcucccaac

SEQ ID NO: 592 - RNA, 17 nt, Artificial Sequence
  Synthetic
uaaacuucugcacugga

SEQ ID NO: 593 - RNA, 17 nt, Artificial Sequence
  Synthetic
uaagaaugucccccaau

SEQ ID NO: 594 - RNA, 20 nt, Artificial Sequence
  Synthetic
uagaggaauuugccccaaac

SEQ ID NO: 595 - RNA, 17 nt, Artificial Sequence
  Synthetic
uauucugcacucauccc

SEQ ID NO: 596 - RNA, 17 nt, Artificial Sequence
  Synthetic
uccaugugcagaacgag

SEQ ID NO: 597 - RNA, 20 nt, Artificial Sequence
  Synthetic
uccaugugcagaacgagggg

SEQ ID NO: 598 - RNA, 17 nt, Artificial Sequence
  Synthetic
uccccucguucugcaca

SEQ ID NO: 599 - RNA, 20 nt, Artificial Sequence
  Synthetic
uccccuucuggagcucccaa

SEQ ID NO: 600 - RNA, 20 nt, Artificial Sequence
  Synthetic
ucccguggagguuggcaucc

SEQ ID NO: 601 - RNA, 20 nt, Artificial Sequence
  Synthetic
ucccguuugcuuaagugcug

SEQ ID NO: 602 - RNA, 20 nt, Artificial Sequence
  Synthetic
uccuccccucguucugcaca

SEQ ID NO: 603 - RNA, 17 nt, Artificial Sequence
  Synthetic
ucgauuggugaagggga

SEQ ID NO: 604 - RNA, 20 nt, Artificial Sequence
  Synthetic
ucgauuggugaaggggaagg

SEQ ID NO: 605 - RNA, 20 nt, Artificial Sequence
  Synthetic
ucugcacucaucccaggcgu

SEQ ID NO: 606 - RNA, 20 nt, Artificial Sequence
  Synthetic
ucuggcacugcccacaggug

SEQ ID NO: 607 - RNA, 20 nt, Artificial Sequence
  Synthetic
ucuguaagaauggcuucaag

SEQ ID NO: 608 - RNA, 20 nt, Artificial Sequence
  Synthetic
ugaaccagaccacggcccgu

SEQ ID NO: 609 - RNA, 17 nt, Artificial Sequence
  Synthetic
ugcacucaucccaggcg

SEQ ID NO: 610 - RNA, 17 nt, Artificial Sequence
  Synthetic
ugcagaauaugccccgc

SEQ ID NO: 611 - RNA, 20 nt, Artificial Sequence
  Synthetic
ugccagaugaacuucccauu

SEQ ID NO: 612 - RNA, 17 nt, Artificial Sequence
  Synthetic
ugcuauguguuccuguu

SEQ ID NO: 613 - RNA, 17 nt, Artificial Sequence
  Synthetic
uggaugccaaccuccac

SEQ ID NO: 614 - RNA, 20 nt, Artificial Sequence
  Synthetic
ugguucaucaucuguaagaa

SEQ ID NO: 615 - RNA, 20 nt, Artificial Sequence
  Synthetic
uguuuaucaacgucaucuag

SEQ ID NO: 616 - RNA, 17 nt, Artificial Sequence
  Synthetic
uuaucaacgucaucuag

SEQ ID NO: 617 - RNA, 20 nt, Artificial Sequence
  Synthetic
uuauuuuuaucgagcacaaa

SEQ ID NO: 618 - RNA, 17 nt, Artificial Sequence
  Synthetic
uucaucaucuguaagaa

SEQ ID NO: 619 - RNA, 17 nt, Artificial Sequence
  Synthetic
uucaucucgauugguga

SEQ ID NO: 620 - RNA, 20 nt, Artificial Sequence
  Synthetic
uucccguuugcuuaagugcu

SEQ ID NO: 621 - RNA, 20 nt, Artificial Sequence
  Synthetic
uucugcacucaucccaggcg

SEQ ID NO: 622 - RNA, 20 nt, Artificial Sequence
  Synthetic
uuucaucucgauuggugaag

SEQ ID NO: 623 - RNA, 17 nt, Artificial Sequence
  Synthetic
uuuuuaucgagcacaaa

SEQ ID NO: 624 - RNA, 20 nt, Artificial Sequence
  Synthetic
uuuuucaucucgauugguga

SEQ ID NO: 625 - RNA, 20 nt, Artificial Sequence
  Synthetic
aacagccauucaccagugca

SEQ ID NO: 626 - RNA, 20 nt, Artificial Sequence
  Synthetic
caacacgcacagaacacuca

SEQ ID NO: 627 - RNA, 20 nt, Artificial Sequence
  Synthetic
aucuacuuagaaagcgaaca

SEQ ID NO: 628 - RNA, 20 nt, Artificial Sequence
  Synthetic
acggaaguccccugaccccg

SEQ ID NO: 629 - RNA, 20 nt, Artificial Sequence
  Synthetic
cggaaguccccugaccccgc

SEQ ID NO: 630 - RNA, 20 nt, Artificial Sequence
  Synthetic
aguccccugaccccgcgggu

SEQ ID NO: 631 - RNA, 20 nt, Artificial Sequence
  Synthetic
ccgcggguugguaucccuuc

SEQ ID NO: 632 - RNA, 20 nt, Artificial Sequence
  Synthetic
guugguaucccuucaggacu

SEQ ID NO: 633 - RNA, 20 nt, Artificial Sequence
  Synthetic
ccuucccagccaccucucca

SEQ ID NO: 634 - RNA, 20 nt, Artificial Sequence
  Synthetic
cuucccagccaccucuccau

SEQ ID NO: 635 - RNA, 20 nt, Artificial Sequence
  Synthetic
uuuaaccugcuaagaauacc

SEQ ID NO: 636 - RNA, 20 nt, Artificial Sequence
  Synthetic
accaggaucaguaucgagag

SEQ ID NO: 637 - RNA, 20 nt, Artificial Sequence
  Synthetic
ucaguaucgagagaggcuuc

SEQ ID NO: 638 - RNA, 20 nt, Artificial Sequence
  Synthetic
aucgagagaggcuuccggcc

SEQ ID NO: 639 - RNA, 20 nt, Artificial Sequence
  Synthetic
gaggcuuccggccuggcaga

SEQ ID NO: 640 - RNA, 20 nt, Artificial Sequence
  Synthetic
aggcuuccggccuggcagaa

SEQ ID NO: 641 - RNA, 20 nt, Artificial Sequence
  Synthetic
uccaccaccgagacaucacu

SEQ ID NO: 642 - RNA, 20 nt, Artificial Sequence
  Synthetic
cccccaccgcauagagcgcc

SEQ ID NO: 643 - RNA, 20 nt, Artificial Sequence
  Synthetic
ccccaccgcauagagcgccu

SEQ ID NO: 644 - RNA, 20 nt, Artificial Sequence
  Synthetic
cccaccgcauagagcgccug

SEQ ID NO: 645 - RNA, 20 nt, Artificial Sequence
  Synthetic
ccaccgcauagagcgccugg

SEQ ID NO: 646 - RNA, 20 nt, Artificial Sequence
  Synthetic
ccgcauagagcgccuggggg

SEQ ID NO: 647 - RNA, 20 nt, Artificial Sequence
  Synthetic
gcgccugggggcggaagaga

SEQ ID NO: 648 - RNA, 20 nt, Artificial Sequence
  Synthetic
gggggcggaagagauggccc

SEQ ID NO: 649 - RNA, 20 nt, Artificial Sequence
  Synthetic
aucacccgagugccuuugac

SEQ ID NO: 650 - RNA, 20 nt, Artificial Sequence
  Synthetic
ucacccgagugccuuugaca

SEQ ID NO: 651 - RNA, 20 nt, Artificial Sequence
  Synthetic
gugccuuugacagggugcug

SEQ ID NO: 652 - RNA, 20 nt, Artificial Sequence
  Synthetic
ggugcugcgguugaauccaa

SEQ ID NO: 653 - RNA, 20 nt, Artificial Sequence
  Synthetic
gcgguugaauccaauggcua

SEQ ID NO: 654 - RNA, 20 nt, Artificial Sequence
  Synthetic
ggcuauggagccucccgcca

SEQ ID NO: 655 - RNA, 20 nt, Artificial Sequence
  Synthetic
cucccgccauggauuucucu

SEQ ID NO: 656 - RNA, 20 nt, Artificial Sequence
  Synthetic
cucuaggagacuuagagagc

SEQ ID NO: 657 - RNA, 20 nt, Artificial Sequence
  Synthetic
aggagacuuagagagcuggc

SEQ ID NO: 658 - RNA, 20 nt, Artificial Sequence
  Synthetic
ggagacuuagagagcuggca

SEQ ID NO: 659 - RNA, 20 nt, Artificial Sequence
  Synthetic
ucuagcccaccgcugucccc

SEQ ID NO: 660 - RNA, 20 nt, Artificial Sequence
  Synthetic
gcccaccgcuguccccaggc

SEQ ID NO: 661 - RNA, 20 nt, Artificial Sequence
  Synthetic
gccggcccagcccuaugcaa

SEQ ID NO: 662 - RNA, 20 nt, Artificial Sequence
  Synthetic
uuacugcaaccauuccagcc

SEQ ID NO: 663 - RNA, 20 nt, Artificial Sequence
  Synthetic
agguagcaagccgcccuucc

SEQ ID NO: 664 - RNA, 20 nt, Artificial Sequence
  Synthetic
cccuccucccucccagcccc

SEQ ID NO: 665 - RNA, 20 nt, Artificial Sequence
  Synthetic
uccaagucaugcgaguucug

SEQ ID NO: 666 - RNA, 20 nt, Artificial Sequence
  Synthetic
guucaaauuucagagcaacc

SEQ ID NO: 667 - RNA, 20 nt, Artificial Sequence
  Synthetic
caaauuucagagcaaccugg

SEQ ID NO: 668 - RNA, 20 nt, Artificial Sequence
  Synthetic
agagcaaccugguggugcac

SEQ ID NO: 669 - RNA, 20 nt, Artificial Sequence
  Synthetic
ggugcaccggcgcagccaca

SEQ ID NO: 670 - RNA, 20 nt, Artificial Sequence
  Synthetic
gugcaccggcgcagccacac

SEQ ID NO: 671 - RNA, 20 nt, Artificial Sequence
  Synthetic
gugcgaccacgcgugcaccc

SEQ ID NO: 672 - RNA, 20 nt, Artificial Sequence
  Synthetic
gcacaaaucgucccccauga

SEQ ID NO: 673 - RNA, 20 nt, Artificial Sequence
  Synthetic
augacggucaaguccgacga

SEQ ID NO: 674 - RNA, 20 nt, Artificial Sequence
  Synthetic
ucucuccaccgccagcuccc

SEQ ID NO: 675 - RNA, 20 nt, Artificial Sequence
  Synthetic
accgccagcuccccggaacc

SEQ ID NO: 676 - RNA, 20 nt, Artificial Sequence
  Synthetic
ggaacccggcaccagcgacu

SEQ ID NO: 677 - RNA, 20 nt, Artificial Sequence
  Synthetic
acccggcaccagcgacuugg

SEQ ID NO: 678 - RNA, 20 nt, Artificial Sequence
  Synthetic
cccggcaccagcgacuuggu

SEQ ID NO: 679 - RNA, 20 nt, Artificial Sequence
  Synthetic
cagcagcgcgcucaaguccg

SEQ ID NO: 680 - RNA, 20 nt, Artificial Sequence
  Synthetic
cagcgcgcucaaguccgugg

SEQ ID NO: 681 - RNA, 20 nt, Artificial Sequence
  Synthetic
gaacgaccccaaccugaucc

SEQ ID NO: 682 - RNA, 20 nt, Artificial Sequence
  Synthetic
cccaaccugaucccggagaa

SEQ ID NO: 683 - RNA, 20 nt, Artificial Sequence
  Synthetic
ccaaccugaucccggagaac

SEQ ID NO: 684 - RNA, 20 nt, Artificial Sequence
  Synthetic
caaccugaucccggagaacg

SEQ ID NO: 685 - RNA, 20 nt, Artificial Sequence
  Synthetic
gaucccggagaacggggacg

SEQ ID NO: 686 - RNA, 20 nt, Artificial Sequence
  Synthetic
cccggagaacggggacgagg

SEQ ID NO: 687 - RNA, 20 nt, Artificial Sequence
  Synthetic
gaacggggacgaggaggaag

SEQ ID NO: 688 - RNA, 20 nt, Artificial Sequence
  Synthetic
cggggacgaggaggaagagg

SEQ ID NO: 689 - RNA, 20 nt, Artificial Sequence
  Synthetic
ggaggaagaggaggacgacg

SEQ ID NO: 690 - RNA, 20 nt, Artificial Sequence
  Synthetic
agaggaggacgacgaggaag

SEQ ID NO: 691 - RNA, 20 nt, Artificial Sequence
  Synthetic
cgacgaggaagaggaagaag

SEQ ID NO: 692 - RNA, 20 nt, Artificial Sequence
  Synthetic
cgaggaagaggaagaagagg

SEQ ID NO: 693 - RNA, 20 nt, Artificial Sequence
  Synthetic
agaggaagaagaggaggaag

SEQ ID NO: 694 - RNA, 20 nt, Artificial Sequence
  Synthetic
ggaagaagaggaggaagagg

SEQ ID NO: 695 - RNA, 20 nt, Artificial Sequence
  Synthetic
agaagaggaggaagaggagg

SEQ ID NO: 696 - RNA, 20 nt, Artificial Sequence
  Synthetic
agaggaggaagaggaggagg

SEQ ID NO: 697 - RNA, 20 nt, Artificial Sequence
  Synthetic
uccuccucguccccguucuc

SEQ ID NO: 698 - RNA, 20 nt, Artificial Sequence
  Synthetic
ccuccucguccccguucucc

SEQ ID NO: 699 - RNA, 20 nt, Artificial Sequence
  Synthetic
cguccccguucuccgggauc

SEQ ID NO: 700 - RNA, 20 nt, Artificial Sequence
  Synthetic
cccguucuccgggaucaggu

SEQ ID NO: 701 - RNA, 20 nt, Artificial Sequence
  Synthetic
ccguucuccgggaucagguu

SEQ ID NO: 702 - RNA, 20 nt, Artificial Sequence
  Synthetic
cguucuccgggaucagguug

SEQ ID NO: 703 - RNA, 20 nt, Artificial Sequence
  Synthetic
gucguucucgcucuugaacu

SEQ ID NO: 704 - RNA, 20 nt, Artificial Sequence
  Synthetic
gcucuugaacuuggccacca

SEQ ID NO: 705 - RNA, 20 nt, Artificial Sequence
  Synthetic
cacggacuugagcgcgcugc

SEQ ID NO: 706 - RNA, 20 nt, Artificial Sequence
  Synthetic
ggcgcugcccaccaagucgc

SEQ ID NO: 707 - RNA, 20 nt, Artificial Sequence
  Synthetic
gcccaccaagucgcuggugc

SEQ ID NO: 708 - RNA, 20 nt, Artificial Sequence
  Synthetic
cccaccaagucgcuggugcc

SEQ ID NO: 709 - RNA, 20 nt, Artificial Sequence
  Synthetic
aagucgcuggugccggguuc

SEQ ID NO: 710 - RNA, 20 nt, Artificial Sequence
  Synthetic
agucgcuggugccggguucc

SEQ ID NO: 711 - RNA, 20 nt, Artificial Sequence
  Synthetic
gucgcuggugccggguuccg

SEQ ID NO: 712 - RNA, 20 nt, Artificial Sequence
  Synthetic
ggugccggguuccggggagc

SEQ ID NO: 713 - RNA, 20 nt, Artificial Sequence
  Synthetic
gccggguuccggggagcugg

SEQ ID NO: 714 - RNA, 20 nt, Artificial Sequence
  Synthetic
ggguuccggggagcuggcgg

SEQ ID NO: 715 - RNA, 20 nt, Artificial Sequence
  Synthetic
ggcgguggagagaccgucgu

SEQ ID NO: 716 - RNA, 20 nt, Artificial Sequence
  Synthetic
gucgucggacuugaccguca

SEQ ID NO: 717 - RNA, 20 nt, Artificial Sequence
  Synthetic
ucgucggacuugaccgucau

SEQ ID NO: 718 - RNA, 20 nt, Artificial Sequence
  Synthetic
cgucggacuugaccgucaug

SEQ ID NO: 719 - RNA, 20 nt, Artificial Sequence
  Synthetic
gucggacuugaccgucaugg

SEQ ID NO: 720 - RNA, 20 nt, Artificial Sequence
  Synthetic
ugugcaugugcgucuucaug

SEQ ID NO: 721 - RNA, 20 nt, Artificial Sequence
  Synthetic
cauguggcgcuucagcuugc

SEQ ID NO: 722 - RNA, 20 nt, Artificial Sequence
  Synthetic
ggcgcuucagcuugcuggcc

SEQ ID NO: 723 - RNA, 20 nt, Artificial Sequence
  Synthetic
gcgcuucagcuugcuggccu

SEQ ID NO: 724 - RNA, 20 nt, Artificial Sequence
  Synthetic
ugcuggccugggugcacgcg

SEQ ID NO: 725 - RNA, 20 nt, Artificial Sequence
  Synthetic
gggugcacgcguggucgcac

SEQ ID NO: 726 - RNA, 20 nt, Artificial Sequence
  Synthetic
gucgcacagguugcacuugu

SEQ ID NO: 727 - RNA, 20 nt, Artificial Sequence
  Synthetic
ucgcacagguugcacuugua

SEQ ID NO: 728 - RNA, 20 nt, Artificial Sequence
  Synthetic
uguagggcuucucgcccgug

SEQ ID NO: 729 - RNA, 20 nt, Artificial Sequence
  Synthetic
ucucgcccguguggcugcgc

SEQ ID NO: 730 - RNA, 20 nt, Artificial Sequence
  Synthetic
ggcugcgccggugcaccacc

SEQ ID NO: 731 - RNA, 20 nt, Artificial Sequence
  Synthetic
gccgcagaacucgcaugacu

SEQ ID NO: 732 - RNA, 20 nt, Artificial Sequence
  Synthetic
ucgcaugacuuggacuugac

SEQ ID NO: 733 - RNA, 20 nt, Artificial Sequence
  Synthetic
cgcaugacuuggacuugacc

SEQ ID NO: 734 - RNA, 20 nt, Artificial Sequence
  Synthetic
gcaugacuuggacuugaccg

SEQ ID NO: 735 - RNA, 20 nt, Artificial Sequence
  Synthetic
caugacuuggacuugaccgg

SEQ ID NO: 736 - RNA, 20 nt, Artificial Sequence
  Synthetic
acuuggacuugaccgggggc

SEQ ID NO: 737 - RNA, 20 nt, Artificial Sequence
  Synthetic
cuuggacuugaccgggggcu

SEQ ID NO: 738 - RNA, 20 nt, Artificial Sequence
  Synthetic
ggacuugaccgggggcuggg

SEQ ID NO: 739 - RNA, 20 nt, Artificial Sequence
  Synthetic
gacuugaccgggggcuggga

SEQ ID NO: 740 - RNA, 20 nt, Artificial Sequence
  Synthetic
uugaccgggggcugggaggg

SEQ ID NO: 741 - RNA, 20 nt, Artificial Sequence
  Synthetic
accgggggcugggagggagg

SEQ ID NO: 742 - RNA, 20 nt, Artificial Sequence
  Synthetic
ccgggggcugggagggagga

SEQ ID NO: 743 - RNA, 20 nt, Artificial Sequence
  Synthetic
cgggggcugggagggaggag

SEQ ID NO: 744 - RNA, 20 nt, Artificial Sequence
  Synthetic
gggcugggagggaggagggg

SEQ ID NO: 745 - RNA, 20 nt, Artificial Sequence
  Synthetic
ggaggaggggcggauugcag

SEQ ID NO: 746 - RNA, 20 nt, Artificial Sequence
  Synthetic
ggaggggcggauugcagagg

SEQ ID NO: 747 - RNA, 20 nt, Artificial Sequence
  Synthetic
gaggggcggauugcagagga

SEQ ID NO: 748 - RNA, 20 nt, Artificial Sequence
  Synthetic
gggcggauugcagaggaggg

SEQ ID NO: 749 - RNA, 20 nt, Artificial Sequence
  Synthetic
ggcggauugcagaggaggga

SEQ ID NO: 750 - RNA, 20 nt, Artificial Sequence
  Synthetic
gcggauugcagaggagggag

SEQ ID NO: 751 - RNA, 20 nt, Artificial Sequence
  Synthetic
cggauugcagaggagggagg

SEQ ID NO: 752 - RNA, 20 nt, Artificial Sequence
  Synthetic
ggauugcagaggagggaggg

SEQ ID NO: 753 - RNA, 20 nt, Artificial Sequence
  Synthetic
gauugcagaggagggagggg

SEQ ID NO: 754 - RNA, 20 nt, Artificial Sequence
  Synthetic
gagggagggggggcgucgcc

SEQ ID NO: 755 - RNA, 20 nt, Artificial Sequence
  Synthetic
gagggggggcgucgccagga

SEQ ID NO: 756 - RNA, 20 nt, Artificial Sequence
  Synthetic
agggggggcgucgccaggaa

SEQ ID NO: 757 - RNA, 20 nt, Artificial Sequence
  Synthetic
gggggcgucgccaggaaggg

SEQ ID NO: 758 - RNA, 20 nt, Artificial Sequence
  Synthetic
aggaagggcggcuugcuacc

SEQ ID NO: 759 - RNA, 20 nt, Artificial Sequence
  Synthetic
agggcggcuugcuaccuggc

SEQ ID NO: 760 - RNA, 20 nt, Artificial Sequence
  Synthetic
ggcuugcuaccuggcuggaa

SEQ ID NO: 761 - RNA, 20 nt, Artificial Sequence
  Synthetic
gguugcaguaaccuuugcau

SEQ ID NO: 762 - RNA, 20 nt, Artificial Sequence
  Synthetic
guugcaguaaccuuugcaua

SEQ ID NO: 763 - RNA, 20 nt, Artificial Sequence
  Synthetic
caguaaccuuugcauagggc

SEQ ID NO: 764 - RNA, 20 nt, Artificial Sequence
  Synthetic
aguaaccuuugcauagggcu

SEQ ID NO: 765 - RNA, 20 nt, Artificial Sequence
  Synthetic
accuuugcauagggcugggc

SEQ ID NO: 766 - RNA, 20 nt, Artificial Sequence
  Synthetic
ugcauagggcugggccggcc

SEQ ID NO: 767 - RNA, 20 nt, Artificial Sequence
  Synthetic
gcauagggcugggccggccu

SEQ ID NO: 768 - RNA, 20 nt, Artificial Sequence
  Synthetic
cauagggcugggccggccug

SEQ ID NO: 769 - RNA, 20 nt, Artificial Sequence
  Synthetic
cugggccggccuggggacag

SEQ ID NO: 770 - RNA, 20 nt, Artificial Sequence
  Synthetic
ggccggccuggggacagcgg

SEQ ID NO: 771 - RNA, 20 nt, Artificial Sequence
  Synthetic
gccggccuggggacagcggu

SEQ ID NO: 772 - RNA, 20 nt, Artificial Sequence
  Synthetic
aagucuccuagagaaaucca

SEQ ID NO: 773 - RNA, 20 nt, Artificial Sequence
  Synthetic
ucuccuagagaaauccaugg

SEQ ID NO: 774 - RNA, 20 nt, Artificial Sequence
  Synthetic
cuccuagagaaauccauggc

SEQ ID NO: 775 - RNA, 20 nt, Artificial Sequence
  Synthetic
cuagagaaauccauggcggg

SEQ ID NO: 776 - RNA, 20 nt, Artificial Sequence
  Synthetic
gcgggaggcuccauagccau

SEQ ID NO: 777 - RNA, 20 nt, Artificial Sequence
  Synthetic
caaccgcagcacccugucaa

SEQ ID NO: 778 - RNA, 20 nt, Artificial Sequence
  Synthetic
agcacccugucaaaggcacu

SEQ ID NO: 779 - RNA, 20 nt, Artificial Sequence
  Synthetic
gcacccugucaaaggcacuc

SEQ ID NO: 780 - RNA, 20 nt, Artificial Sequence
  Synthetic
ugucaaaggcacucggguga

SEQ ID NO: 781 - RNA, 20 nt, Artificial Sequence
  Synthetic
gucaaaggcacucgggugau

SEQ ID NO: 782 - RNA, 20 nt, Artificial Sequence
  Synthetic
aaaggcacucgggugauggg

SEQ ID NO: 783 - RNA, 20 nt, Artificial Sequence
  Synthetic
cacucgggugauggguggcc

SEQ ID NO: 784 - RNA, 20 nt, Artificial Sequence
  Synthetic
acucgggugauggguggcca

SEQ ID NO: 785 - RNA, 20 nt, Artificial Sequence
  Synthetic
gggccaucucuuccgccccc

SEQ ID NO: 786 - RNA, 20 nt, Artificial Sequence
  Synthetic
ccgcccccaggcgcucuaug

SEQ ID NO: 787 - RNA, 20 nt, Artificial Sequence
  Synthetic
cccccaggcgcucuaugcgg

SEQ ID NO: 788 - RNA, 20 nt, Artificial Sequence
  Synthetic
ccccaggcgcucuaugcggu

SEQ ID NO: 789 - RNA, 20 nt, Artificial Sequence
  Synthetic
cccaggcgcucuaugcggug

SEQ ID NO: 790 - RNA, 20 nt, Artificial Sequence
  Synthetic
ccaggcgcucuaugcggugg

SEQ ID NO: 791 - RNA, 20 nt, Artificial Sequence
  Synthetic
uggggguccaagugaugucu

SEQ ID NO: 792 - RNA, 20 nt, Artificial Sequence
  Synthetic
ggguccaagugaugucucgg

SEQ ID NO: 793 - RNA, 20 nt, Artificial Sequence
  Synthetic
uccaagugaugucucggugg

SEQ ID NO: 794 - RNA, 20 nt, Artificial Sequence
  Synthetic
gucucggugguggacuaaac

SEQ ID NO: 795 - RNA, 20 nt, Artificial Sequence
  Synthetic
ucucggugguggacuaaaca

SEQ ID NO: 796 - RNA, 20 nt, Artificial Sequence
  Synthetic
cucggugguggacuaaacag

SEQ ID NO: 797 - RNA, 20 nt, Artificial Sequence
  Synthetic
ucggugguggacuaaacagg

SEQ ID NO: 798 - RNA, 20 nt, Artificial Sequence
  Synthetic
cggugguggacuaaacaggg

SEQ ID NO: 799 - RNA, 20 nt, Artificial Sequence
  Synthetic
ggugguggacuaaacagggg

SEQ ID NO: 800 - RNA, 20 nt, Artificial Sequence
  Synthetic
uggacuaaacagggggggag

SEQ ID NO: 801 - RNA, 20 nt, Artificial Sequence
  Synthetic
ggacuaaacagggggggagu

SEQ ID NO: 802 - RNA, 20 nt, Artificial Sequence
  Synthetic
cuaaacagggggggaguggg

SEQ ID NO: 803 - RNA, 20 nt, Artificial Sequence
  Synthetic
guggaaagcgcccuucugcc

SEQ ID NO: 804 - RNA, 20 nt, Artificial Sequence
  Synthetic
aaagcgcccuucugccaggc

SEQ ID NO: 805 - RNA, 20 nt, Artificial Sequence
  Synthetic
gccucucucgauacugaucc

SEQ ID NO: 806 - RNA, 20 nt, Artificial Sequence
  Synthetic
cugauccugguauucuuagc

SEQ ID NO: 807 - RNA, 20 nt, Artificial Sequence
  Synthetic
ugguauucuuagcagguuaa

SEQ ID NO: 808 - RNA, 20 nt, Artificial Sequence
  Synthetic
gguauucuuagcagguuaaa

SEQ ID NO: 809 - RNA, 20 nt, Artificial Sequence
  Synthetic
guauucuuagcagguuaaag

SEQ ID NO: 810 - RNA, 20 nt, Artificial Sequence
  Synthetic
ugucugcaauaugaauccca

SEQ ID NO: 811 - RNA, 20 nt, Artificial Sequence
  Synthetic
gcaauaugaaucccauggag

SEQ ID NO: 812 - RNA, 20 nt, Artificial Sequence
  Synthetic
auaugaaucccauggagagg

SEQ ID NO: 813 - RNA, 20 nt, Artificial Sequence
  Synthetic
gaaucccauggagagguggc

SEQ ID NO: 814 - RNA, 20 nt, Artificial Sequence
  Synthetic
aaucccauggagagguggcu

SEQ ID NO: 815 - RNA, 20 nt, Artificial Sequence
  Synthetic
ccauggagagguggcuggga

SEQ ID NO: 816 - RNA, 20 nt, Artificial Sequence
  Synthetic
cauucugcaccuaguccuga

SEQ ID NO: 817 - RNA, 20 nt, Artificial Sequence
  Synthetic
auucugcaccuaguccugaa

SEQ ID NO: 818 - RNA, 20 nt, Artificial Sequence
  Synthetic
ccugaagggauaccaacccg

SEQ ID NO: 819 - RNA, 20 nt, Artificial Sequence
  Synthetic
cugaagggauaccaacccgc

SEQ ID NO: 820 - RNA, 20 nt, Artificial Sequence
  Synthetic
ugaagggauaccaacccgcg

SEQ ID NO: 821 - RNA, 20 nt, Artificial Sequence
  Synthetic
ggauaccaacccgcgggguc

SEQ ID NO: 822 - RNA, 20 nt, Artificial Sequence
  Synthetic
gauaccaacccgcgggguca

SEQ ID NO: 823 - RNA, 20 nt, Artificial Sequence
  Synthetic
auaccaacccgcggggucag

SEQ ID NO: 824 - RNA, 20 nt, Artificial Sequence
  Synthetic
uugcaagagaaaccaugcac

SEQ ID NO: 825 - RNA, 20 nt, Artificial Sequence
  Synthetic
agaaaccaugcacuggugaa

SEQ ID NO: 826 - RNA, 20 nt, Artificial Sequence
  Synthetic
aguuguacauguguagcugc

SEQ ID NO: 827 - RNA, 20 nt, Artificial Sequence
  Synthetic
guuguacauguguagcugcu

SEQ ID NO: 828 - RNA, 17 nt, Artificial Sequence
  Synthetic
agccauucaccagugca

SEQ ID NO: 829 - RNA, 17 nt, Artificial Sequence
  Synthetic
cacgcacagaacacuca

SEQ ID NO: 830 - RNA, 17 nt, Artificial Sequence
  Synthetic
uacuuagaaagcgaaca

SEQ ID NO: 831 - RNA, 17 nt, Artificial Sequence
  Synthetic
gaaguccccugaccccg

SEQ ID NO: 832 - RNA, 17 nt, Artificial Sequence
  Synthetic
aaguccccugaccccgc

SEQ ID NO: 833 - RNA, 17 nt, Artificial Sequence
  Synthetic
ccccugaccccgcgggu

SEQ ID NO: 834 - RNA, 17 nt, Artificial Sequence
  Synthetic
cggguugguaucccuuc

SEQ ID NO: 835 - RNA, 17 nt, Artificial Sequence
  Synthetic
gguaucccuucaggacu

SEQ ID NO: 836 - RNA, 17 nt, Artificial Sequence
  Synthetic
ucccagccaccucucca

SEQ ID NO: 837 - RNA, 17 nt, Artificial Sequence
  Synthetic
cccagccaccucuccau

SEQ ID NO: 838 - RNA, 17 nt, Artificial Sequence
  Synthetic
aaccugcuaagaauacc

SEQ ID NO: 839 - RNA, 17 nt, Artificial Sequence
  Synthetic
aggaucaguaucgagag

SEQ ID NO: 840 - RNA, 17 nt, Artificial Sequence
  Synthetic
guaucgagagaggcuuc

SEQ ID NO: 841 - RNA, 17 nt, Artificial Sequence
  Synthetic
gagagaggcuuccggcc

SEQ ID NO: 842 - RNA, 17 nt, Artificial Sequence
  Synthetic
gcuuccggccuggcaga

SEQ ID NO: 843 - RNA, 17 nt, Artificial Sequence
  Synthetic
cuuccggccuggcagaa

SEQ ID NO: 844 - RNA, 17 nt, Artificial Sequence
  Synthetic
accaccgagacaucacu

SEQ ID NO: 845 - RNA, 17 nt, Artificial Sequence
  Synthetic
ccaccgcauagagcgcc

SEQ ID NO: 846 - RNA, 17 nt, Artificial Sequence
  Synthetic
caccgcauagagcgccu

SEQ ID NO: 847 - RNA, 17 nt, Artificial Sequence
  Synthetic
accgcauagagcgccug

SEQ ID NO: 848 - RNA, 17 nt, Artificial Sequence
  Synthetic
ccgcauagagcgccugg

SEQ ID NO: 849 - RNA, 17 nt, Artificial Sequence
  Synthetic
cauagagcgccuggggg

SEQ ID NO: 850 - RNA, 17 nt, Artificial Sequence
  Synthetic
ccugggggcggaagaga

SEQ ID NO: 851 - RNA, 17 nt, Artificial Sequence
  Synthetic
ggcggaagagauggccc

SEQ ID NO: 852 - RNA, 17 nt, Artificial Sequence
  Synthetic
acccgagugccuuugac

SEQ ID NO: 853 - RNA, 17 nt, Artificial Sequence
  Synthetic
cccgagugccuuugaca

SEQ ID NO: 854 - RNA, 17 nt, Artificial Sequence
  Synthetic
ccuuugacagggugcug

SEQ ID NO: 855 - RNA, 17 nt, Artificial Sequence
  Synthetic
gcugcgguugaauccaa

SEQ ID NO: 856 - RNA, 17 nt, Artificial Sequence
  Synthetic
guugaauccaauggcua

SEQ ID NO: 857 - RNA, 17 nt, Artificial Sequence
  Synthetic
uauggagccucccgcca

SEQ ID NO: 858 - RNA, 17 nt, Artificial Sequence
  Synthetic
ccgccauggauuucucu

SEQ ID NO: 859 - RNA, 17 nt, Artificial Sequence
  Synthetic
uaggagacuuagagagc

SEQ ID NO: 860 - RNA, 17 nt, Artificial Sequence
  Synthetic
agacuuagagagcuggc

SEQ ID NO: 861 - RNA, 17 nt, Artificial Sequence
  Synthetic
gacuuagagagcuggca

SEQ ID NO: 862 - RNA, 17 nt, Artificial Sequence
  Synthetic
agcccaccgcugucccc

SEQ ID NO: 863 - RNA, 17 nt, Artificial Sequence
  Synthetic
caccgcuguccccaggc

SEQ ID NO: 864 - RNA, 17 nt, Artificial Sequence
  Synthetic
ggcccagcccuaugcaa

SEQ ID NO: 865 - RNA, 17 nt, Artificial Sequence
  Synthetic
cugcaaccauuccagcc

SEQ ID NO: 866 - RNA, 17 nt, Artificial Sequence
  Synthetic
uagcaagccgcccuucc

SEQ ID NO: 867 - RNA, 17 nt, Artificial Sequence
  Synthetic
uccucccucccagcccc

SEQ ID NO: 868 - RNA, 17 nt, Artificial Sequence
  Synthetic
aagucaugcgaguucug

SEQ ID NO: 869 - RNA, 17 nt, Artificial Sequence
  Synthetic
caaauuucagagcaacc

SEQ ID NO: 870 - RNA, 17 nt, Artificial Sequence
  Synthetic
auuucagagcaaccugg

SEQ ID NO: 871 - RNA, 17 nt, Artificial Sequence
  Synthetic
gcaaccugguggugcac

SEQ ID NO: 872 - RNA, 17 nt, Artificial Sequence
  Synthetic
gcaccggcgcagccaca

SEQ ID NO: 873 - RNA, 17 nt, Artificial Sequence
  Synthetic
caccggcgcagccacac

SEQ ID NO: 874 - RNA, 17 nt, Artificial Sequence
  Synthetic
cgaccacgcgugcaccc

SEQ ID NO: 875 - RNA, 17 nt, Artificial Sequence
  Synthetic
caaaucgucccccauga

SEQ ID NO: 876 - RNA, 17 nt, Artificial Sequence
  Synthetic
acggucaaguccgacga

SEQ ID NO: 877 - RNA, 17 nt, Artificial Sequence
  Synthetic
cuccaccgccagcuccc

SEQ ID NO: 878 - RNA, 17 nt, Artificial Sequence
  Synthetic
gccagcuccccggaacc

SEQ ID NO: 879 - RNA, 17 nt, Artificial Sequence
  Synthetic
acccggcaccagcgacu

SEQ ID NO: 880 - RNA, 17 nt, Artificial Sequence
  Synthetic
cggcaccagcgacuugg

SEQ ID NO: 881 - RNA, 17 nt, Artificial Sequence
  Synthetic
ggcaccagcgacuuggu

SEQ ID NO: 882 - RNA, 17 nt, Artificial Sequence
  Synthetic
cagcgcgcucaaguccg

SEQ ID NO: 883 - RNA, 17 nt, Artificial Sequence
  Synthetic
cgcgcucaaguccgugg

SEQ ID NO: 884 - RNA, 17 nt, Artificial Sequence
  Synthetic
cgaccccaaccugaucc

SEQ ID NO: 885 - RNA, 17 nt, Artificial Sequence
  Synthetic
aaccugaucccggagaa

SEQ ID NO: 886 - RNA, 17 nt, Artificial Sequence
  Synthetic
accugaucccggagaac

SEQ ID NO: 887 - RNA, 17 nt, Artificial Sequence
  Synthetic
ccugaucccggagaacg

SEQ ID NO: 888 - RNA, 17 nt, Artificial Sequence
  Synthetic
cccggagaacggggacg

SEQ ID NO: 889 - RNA, 17 nt, Artificial Sequence
  Synthetic
ggagaacggggacgagg

SEQ ID NO: 890 - RNA, 17 nt, Artificial Sequence
  Synthetic
cggggacgaggaggaag

SEQ ID NO: 891 - RNA, 17 nt, Artificial Sequence
  Synthetic
ggacgaggaggaagagg

SEQ ID NO: 892 - RNA, 17 nt, Artificial Sequence
  Synthetic
ggaagaggaggacgacg

SEQ ID NO: 893 - RNA, 17 nt, Artificial Sequence
  Synthetic
ggaggacgacgaggaag

SEQ ID NO: 894 - RNA, 17 nt, Artificial Sequence
  Synthetic
cgaggaagaggaagaag

SEQ ID NO: 895 - RNA, 17 nt, Artificial Sequence
  Synthetic
ggaagaggaagaagagg

SEQ ID NO: 896 - RNA, 17 nt, Artificial Sequence
  Synthetic
ggaagaagaggaggaag

SEQ ID NO: 897 - RNA, 17 nt, Artificial Sequence
  Synthetic
agaagaggaggaagagg

SEQ ID NO: 898 - RNA, 17 nt, Artificial Sequence
  Synthetic
agaggaggaagaggagg

SEQ ID NO: 899 - RNA, 17 nt, Artificial Sequence
  Synthetic
ggaggaagaggaggagg

SEQ ID NO: 900 - RNA, 17 nt, Artificial Sequence
  Synthetic
uccucguccccguucuc

SEQ ID NO: 901 - RNA, 17 nt, Artificial Sequence
  Synthetic
ccucguccccguucucc

SEQ ID NO: 902 - RNA, 17 nt, Artificial Sequence
  Synthetic
ccccguucuccgggauc

SEQ ID NO: 903 - RNA, 17 nt, Artificial Sequence
  Synthetic
guucuccgggaucaggu

SEQ ID NO: 904 - RNA, 17 nt, Artificial Sequence
  Synthetic
uucuccgggaucagguu

SEQ ID NO: 905 - RNA, 17 nt, Artificial Sequence
  Synthetic
ucuccgggaucagguug

SEQ ID NO: 906 - RNA, 17 nt, Artificial Sequence
  Synthetic
guucucgcucuugaacu

SEQ ID NO: 907 - RNA, 17 nt, Artificial Sequence
  Synthetic
cuugaacuuggccacca

SEQ ID NO: 908 - RNA, 17 nt, Artificial Sequence
  Synthetic
ggacuugagcgcgcugc

SEQ ID NO: 909 - RNA, 17 nt, Artificial Sequence
  Synthetic
gcugcccaccaagucgc

SEQ ID NO: 910 - RNA, 17 nt, Artificial Sequence
  Synthetic
caccaagucgcuggugc

SEQ ID NO: 911 - RNA, 17 nt, Artificial Sequence
  Synthetic
accaagucgcuggugcc

SEQ ID NO: 912 - RNA, 17 nt, Artificial Sequence
  Synthetic
ucgcuggugccggguuc

SEQ ID NO: 913 - RNA, 17 nt, Artificial Sequence
  Synthetic
cgcuggugccggguucc

SEQ ID NO: 914 - RNA, 17 nt, Artificial Sequence
  Synthetic
gcuggugccggguuccg

SEQ ID NO: 915 - RNA, 17 nt, Artificial Sequence
  Synthetic
gccggguuccggggagc

SEQ ID NO: 916 - RNA, 17 nt, Artificial Sequence
  Synthetic
ggguuccggggagcugg

SEQ ID NO: 917 - RNA, 17 nt, Artificial Sequence
  Synthetic
uuccggggagcuggcgg

SEQ ID NO: 918 - RNA, 17 nt, Artificial Sequence
  Synthetic
gguggagagaccgucgu

SEQ ID NO: 919 - RNA, 17 nt, Artificial Sequence
  Synthetic
gucggacuugaccguca

SEQ ID NO: 920 - RNA, 17 nt, Artificial Sequence
  Synthetic
ucggacuugaccgucau

SEQ ID NO: 921 - RNA, 17 nt, Artificial Sequence
  Synthetic
cggacuugaccgucaug

SEQ ID NO: 922 - RNA, 17 nt, Artificial Sequence
  Synthetic
ggacuugaccgucaugg

SEQ ID NO: 923 - RNA, 17 nt, Artificial Sequence
  Synthetic
gcaugugcgucuucaug

SEQ ID NO: 924 - RNA, 17 nt, Artificial Sequence
  Synthetic
guggcgcuucagcuugc

SEQ ID NO: 925 - RNA, 17 nt, Artificial Sequence
  Synthetic
gcuucagcuugcuggcc

SEQ ID NO: 926 - RNA, 17 nt, Artificial Sequence
  Synthetic
cuucagcuugcuggccu

SEQ ID NO: 927 - RNA, 17 nt, Artificial Sequence
  Synthetic
uggccugggugcacgcg

SEQ ID NO: 928 - RNA, 17 nt, Artificial Sequence
  Synthetic
ugcacgcguggucgcac

SEQ ID NO: 929 - RNA, 17 nt, Artificial Sequence
  Synthetic
gcacagguugcacuugu

SEQ ID NO: 930 - RNA, 17 nt, Artificial Sequence
  Synthetic
cacagguugcacuugua

SEQ ID NO: 931 - RNA, 17 nt, Artificial Sequence
  Synthetic
agggcuucucgcccgug

SEQ ID NO: 932 - RNA, 17 nt, Artificial Sequence
  Synthetic
cgcccguguggcugcgc

SEQ ID NO: 933 - RNA, 17 nt, Artificial Sequence
  Synthetic
ugcgccggugcaccacc

SEQ ID NO: 934 - RNA, 17 nt, Artificial Sequence
  Synthetic
gcagaacucgcaugacu

SEQ ID NO: 935 - RNA, 17 nt, Artificial Sequence
  Synthetic
caugacuuggacuugac

SEQ ID NO: 936 - RNA, 17 nt, Artificial Sequence
  Synthetic
augacuuggacuugacc

SEQ ID NO: 937 - RNA, 17 nt, Artificial Sequence
  Synthetic
ugacuuggacuugaccg

SEQ ID NO: 938 - RNA, 17 nt, Artificial Sequence
  Synthetic
gacuuggacuugaccgg

SEQ ID NO: 939 - RNA, 17 nt, Artificial Sequence
  Synthetic
uggacuugaccgggggc

SEQ ID NO: 940 - RNA, 17 nt, Artificial Sequence
  Synthetic
ggacuugaccgggggcu

SEQ ID NO: 941 - RNA, 17 nt, Artificial Sequence
  Synthetic
cuugaccgggggcuggg

SEQ ID NO: 942 - RNA, 17 nt, Artificial Sequence
  Synthetic
uugaccgggggcuggga

SEQ ID NO: 943 - RNA, 17 nt, Artificial Sequence
  Synthetic
accgggggcugggaggg

SEQ ID NO: 944 - RNA, 17 nt, Artificial Sequence
  Synthetic
gggggcugggagggagg

SEQ ID NO: 945 - RNA, 17 nt, Artificial Sequence
  Synthetic
ggggcugggagggagga

SEQ ID NO: 946 - RNA, 17 nt, Artificial Sequence
  Synthetic
gggcugggagggaggag

SEQ ID NO: 947 - RNA, 17 nt, Artificial Sequence
  Synthetic
cugggagggaggagggg

SEQ ID NO: 948 - RNA, 17 nt, Artificial Sequence
  Synthetic
ggaggggcggauugcag

SEQ ID NO: 949 - RNA, 17 nt, Artificial Sequence
  Synthetic
ggggcggauugcagagg

SEQ ID NO: 950 - RNA, 17 nt, Artificial Sequence
  Synthetic
gggcggauugcagagga

SEQ ID NO: 951 - RNA, 17 nt, Artificial Sequence
  Synthetic
cggauugcagaggaggg

SEQ ID NO: 952 - RNA, 17 nt, Artificial Sequence
  Synthetic
ggauugcagaggaggga

SEQ ID NO: 953 - RNA, 17 nt, Artificial Sequence
  Synthetic
gauugcagaggagggag

SEQ ID NO: 954 - RNA, 17 nt, Artificial Sequence
  Synthetic
auugcagaggagggagg

SEQ ID NO: 955 - RNA, 17 nt, Artificial Sequence
  Synthetic
uugcagaggagggaggg

SEQ ID NO: 956 - RNA, 17 nt, Artificial Sequence
  Synthetic
ugcagaggagggagggg

SEQ ID NO: 957 - RNA, 17 nt, Artificial Sequence
  Synthetic
ggagggggggcgucgcc

SEQ ID NO: 958 - RNA, 17 nt, Artificial Sequence
  Synthetic
ggggggcgucgccagga

SEQ ID NO: 959 - RNA, 17 nt, Artificial Sequence
  Synthetic
gggggcgucgccaggaa

SEQ ID NO: 960 - RNA, 17 nt, Artificial Sequence
  Synthetic
ggcgucgccaggaaggg

SEQ ID NO: 961 - RNA, 17 nt, Artificial Sequence
  Synthetic
aagggcggcuugcuacc

SEQ ID NO: 962 - RNA, 17 nt, Artificial Sequence
  Synthetic
gcggcuugcuaccuggc

SEQ ID NO: 963 - RNA, 17 nt, Artificial Sequence
  Synthetic
uugcuaccuggcuggaa

SEQ ID NO: 964 - RNA, 17 nt, Artificial Sequence
  Synthetic
ugcaguaaccuuugcau

SEQ ID NO: 965 - RNA, 17 nt, Artificial Sequence
  Synthetic
gcaguaaccuuugcaua

SEQ ID NO: 966 - RNA, 17 nt, Artificial Sequence
  Synthetic
uaaccuuugcauagggc

SEQ ID NO: 967 - RNA, 17 nt, Artificial Sequence
  Synthetic
aaccuuugcauagggcu

SEQ ID NO: 968 - RNA, 17 nt, Artificial Sequence
  Synthetic
uuugcauagggcugggc

SEQ ID NO: 969 - RNA, 17 nt, Artificial Sequence
  Synthetic
auagggcugggccggcc

SEQ ID NO: 970 - RNA, 17 nt, Artificial Sequence
  Synthetic
uagggcugggccggccu

SEQ ID NO: 971 - RNA, 17 nt, Artificial Sequence
  Synthetic
agggcugggccggccug

SEQ ID NO: 972 - RNA, 17 nt, Artificial Sequence
  Synthetic
ggccggccuggggacag

SEQ ID NO: 973 - RNA, 17 nt, Artificial Sequence
  Synthetic
cggccuggggacagcgg

SEQ ID NO: 974 - RNA, 17 nt, Artificial Sequence
  Synthetic
ggccuggggacagcggu

SEQ ID NO: 975 - RNA, 17 nt, Artificial Sequence
  Synthetic
ucuccuagagaaaucca

SEQ ID NO: 976 - RNA, 17 nt, Artificial Sequence
  Synthetic
ccuagagaaauccaugg

SEQ ID NO: 977 - RNA, 17 nt, Artificial Sequence
  Synthetic
cuagagaaauccauggc

SEQ ID NO: 978 - RNA, 17 nt, Artificial Sequence
  Synthetic
gagaaauccauggcggg

SEQ ID NO: 979 - RNA, 17 nt, Artificial Sequence
  Synthetic
ggaggcuccauagccau

SEQ ID NO: 980 - RNA, 17 nt, Artificial Sequence
  Synthetic
ccgcagcacccugucaa

SEQ ID NO: 981 - RNA, 17 nt, Artificial Sequence
  Synthetic
acccugucaaaggcacu

SEQ ID NO: 982 - RNA, 17 nt, Artificial Sequence
  Synthetic
cccugucaaaggcacuc

SEQ ID NO: 983 - RNA, 17 nt, Artificial Sequence
  Synthetic
caaaggcacucggguga

SEQ ID NO: 984 - RNA, 17 nt, Artificial Sequence
  Synthetic
aaaggcacucgggugau

SEQ ID NO: 985 - RNA, 17 nt, Artificial Sequence
  Synthetic
ggcacucgggugauggg

SEQ ID NO: 986 - RNA, 17 nt, Artificial Sequence
  Synthetic
ucgggugauggguggcc

SEQ ID NO: 987 - RNA, 17 nt, Artificial Sequence
  Synthetic
cgggugauggguggcca

SEQ ID NO: 988 - RNA, 17 nt, Artificial Sequence
  Synthetic
ccaucucuuccgccccc

SEQ ID NO: 989 - RNA, 17 nt, Artificial Sequence
  Synthetic
cccccaggcgcucuaug

SEQ ID NO: 990 - RNA, 17 nt, Artificial Sequence
  Synthetic
ccaggcgcucuaugcgg

SEQ ID NO: 991 - RNA, 17 nt, Artificial Sequence
  Synthetic
caggcgcucuaugcggu

SEQ ID NO: 992 - RNA, 17 nt, Artificial Sequence
  Synthetic
aggcgcucuaugcggug

SEQ ID NO: 993 - RNA, 17 nt, Artificial Sequence
  Synthetic
ggcgcucuaugcggugg

SEQ ID NO: 994 - RNA, 17 nt, Artificial Sequence
  Synthetic
ggguccaagugaugucu

SEQ ID NO: 995 - RNA, 17 nt, Artificial Sequence
  Synthetic
uccaagugaugucucgg

SEQ ID NO: 996 - RNA, 17 nt, Artificial Sequence
  Synthetic
aagugaugucucggugg

SEQ ID NO: 997 - RNA, 17 nt, Artificial Sequence
  Synthetic
ucggugguggacuaaac

SEQ ID NO: 998 - RNA, 17 nt, Artificial Sequence
  Synthetic
cggugguggacuaaaca

SEQ ID NO: 999 - RNA, 17 nt, Artificial Sequence
  Synthetic
ggugguggacuaaacag

SEQ ID NO: 1000 - RNA, 17 nt, Artificial Sequence
  Synthetic
gugguggacuaaacagg

SEQ ID NO: 1001 - RNA, 17 nt, Artificial Sequence
  Synthetic
ugguggacuaaacaggg

SEQ ID NO: 1002 - RNA, 17 nt, Artificial Sequence
  Synthetic
gguggacuaaacagggg

SEQ ID NO: 1003 - RNA, 17 nt, Artificial Sequence
  Synthetic
acuaaacagggggggag

SEQ ID NO: 1004 - RNA, 17 nt, Artificial Sequence
  Synthetic
cuaaacagggggggagu

SEQ ID NO: 1005 - RNA, 17 nt, Artificial Sequence
  Synthetic
aacagggggggaguggg

SEQ ID NO: 1006 - RNA, 17 nt, Artificial Sequence
  Synthetic
gaaagcgcccuucugcc

SEQ ID NO: 1007 - RNA, 17 nt, Artificial Sequence
  Synthetic
gcgcccuucugccaggc

SEQ ID NO: 1008 - RNA, 17 nt, Artificial Sequence
  Synthetic
ucucucgauacugaucc

SEQ ID NO: 1009 - RNA, 17 nt, Artificial Sequence
  Synthetic
auccugguauucuuagc

SEQ ID NO: 1010 - RNA, 17 nt, Artificial Sequence
  Synthetic
uauucuuagcagguuaa

SEQ ID NO: 1011 - RNA, 17 nt, Artificial Sequence
  Synthetic
auucuuagcagguuaaa

SEQ ID NO: 1012 - RNA, 17 nt, Artificial Sequence
  Synthetic
uucuuagcagguuaaag

SEQ ID NO: 1013 - RNA, 17 nt, Artificial Sequence
  Synthetic
cugcaauaugaauccca

SEQ ID NO: 1014 - RNA, 17 nt, Artificial Sequence
  Synthetic
auaugaaucccauggag

SEQ ID NO: 1015 - RNA, 17 nt, Artificial Sequence
  Synthetic
ugaaucccauggagagg

SEQ ID NO: 1016 - RNA, 17 nt, Artificial Sequence
  Synthetic
ucccauggagagguggc

SEQ ID NO: 1017 - RNA, 17 nt, Artificial Sequence
  Synthetic
cccauggagagguggcu

SEQ ID NO: 1018 - RNA, 17 nt, Artificial Sequence
  Synthetic
uggagagguggcuggga

SEQ ID NO: 1019 - RNA, 17 nt, Artificial Sequence
  Synthetic
ucugcaccuaguccuga

SEQ ID NO: 1020 - RNA, 17 nt, Artificial Sequence
  Synthetic
cugcaccuaguccugaa

SEQ ID NO: 1021 - RNA, 17 nt, Artificial Sequence
  Synthetic
gaagggauaccaacccg

SEQ ID NO: 1022 - RNA, 17 nt, Artificial Sequence
  Synthetic
aagggauaccaacccgc

SEQ ID NO: 1023 - RNA, 17 nt, Artificial Sequence
  Synthetic
agggauaccaacccgcg

SEQ ID NO: 1024 - RNA, 17 nt, Artificial Sequence
  Synthetic
uaccaacccgcgggguc

SEQ ID NO: 1025 - RNA, 17 nt, Artificial Sequence
  Synthetic
accaacccgcgggguca

SEQ ID NO: 1026 - RNA, 17 nt, Artificial Sequence
  Synthetic
ccaacccgcggggucag

SEQ ID NO: 1027 - RNA, 17 nt, Artificial Sequence
  Synthetic
caagagaaaccaugcac

SEQ ID NO: 1028 - RNA, 17 nt, Artificial Sequence
  Synthetic
aaccaugcacuggugaa

SEQ ID NO: 1029 - RNA, 17 nt, Artificial Sequence
  Synthetic
uguacauguguagcugc

SEQ ID NO: 1030 - RNA, 17 nt, Artificial Sequence
  Synthetic
guacauguguagcugcu

SEQ ID NO: 1031 - RNA, 20 nt, Artificial Sequence
  Synthetic
agaggaggaggaggagcuga

SEQ ID NO: 1032 - RNA, 20 nt, Artificial Sequence
  Synthetic
aggagcugacggagagcgag

SEQ ID NO: 1033 - RNA, 20 nt, Artificial Sequence
  Synthetic
ggagcugacggagagcgaga

SEQ ID NO: 1034 - RNA, 20 nt, Artificial Sequence
  Synthetic
gcugacggagagcgagaggg

SEQ ID NO: 1035 - RNA, 20 nt, Artificial Sequence
  Synthetic
gagagcgagaggguggacua

SEQ ID NO: 1036 - RNA, 20 nt, Artificial Sequence
  Synthetic
gagaggguggacuacggcuu

SEQ ID NO: 1037 - RNA, 20 nt, Artificial Sequence
  Synthetic
agaggguggacuacggcuuc

SEQ ID NO: 1038 - RNA, 20 nt, Artificial Sequence
  Synthetic
cuacggcuucgggcugagcc

SEQ ID NO: 1039 - RNA, 20 nt, Artificial Sequence
  Synthetic
cggcuucgggcugagccugg

SEQ ID NO: 1040 - RNA, 20 nt, Artificial Sequence
  Synthetic
cuucgggcugagccuggagg

SEQ ID NO: 1041 - RNA, 20 nt, Artificial Sequence
  Synthetic
gccaccacgagaacagcucg

SEQ ID NO: 1042 - RNA, 20 nt, Artificial Sequence
  Synthetic
ccaccacgagaacagcucgc

SEQ ID NO: 1043 - RNA, 20 nt, Artificial Sequence
  Synthetic
caccacgagaacagcucgcg

SEQ ID NO: 1044 - RNA, 20 nt, Artificial Sequence
  Synthetic
cgagaacagcucgcggggcg

SEQ ID NO: 1045 - RNA, 20 nt, Artificial Sequence
  Synthetic
cagcucgcggggcgcggucg

SEQ ID NO: 1046 - RNA, 20 nt, Artificial Sequence
  Synthetic
agcucgcggggcgcggucgu

SEQ ID NO: 1047 - RNA, 20 nt, Artificial Sequence
  Synthetic
gcggggcgcggucgugggcg

SEQ ID NO: 1048 - RNA, 20 nt, Artificial Sequence
  Synthetic
cggggcgcggucgugggcgu

SEQ ID NO: 1049 - RNA, 20 nt, Artificial Sequence
  Synthetic
cgcccugcccgacgucaugc

SEQ ID NO: 1050 - RNA, 20 nt, Artificial Sequence
  Synthetic
gcccugcccgacgucaugca

SEQ ID NO: 1051 - RNA, 20 nt, Artificial Sequence
  Synthetic
gcccgacgucaugcagggca

SEQ ID NO: 1052 - RNA, 20 nt, Artificial Sequence
  Synthetic
cuccaugcagcacuucagcg

SEQ ID NO: 1053 - RNA, 20 nt, Artificial Sequence
  Synthetic
cuucagcgaggccuuccacc

SEQ ID NO: 1054 - RNA, 20 nt, Artificial Sequence
  Synthetic
cgaggccuuccaccaggucc

SEQ ID NO: 1055 - RNA, 20 nt, Artificial Sequence
  Synthetic
gaggccuuccaccagguccu

SEQ ID NO: 1056 - RNA, 20 nt, Artificial Sequence
  Synthetic
cugggcgagaagcauaagcg

SEQ ID NO: 1057 - RNA, 20 nt, Artificial Sequence
  Synthetic
gaagcauaagcgcggccacc

SEQ ID NO: 1058 - RNA, 20 nt, Artificial Sequence
  Synthetic
uaagcgcggccaccuggccg

SEQ ID NO: 1059 - RNA, 20 nt, Artificial Sequence
  Synthetic
cggccaccuggccgaggccg

SEQ ID NO: 1060 - RNA, 20 nt, Artificial Sequence
  Synthetic
ggccaccuggccgaggccga

SEQ ID NO: 1061 - RNA, 20 nt, Artificial Sequence
  Synthetic
uggccgaggccgagggccac

SEQ ID NO: 1062 - RNA, 20 nt, Artificial Sequence
  Synthetic
ggccgaggccgagggccaca

SEQ ID NO: 1063 - RNA, 20 nt, Artificial Sequence
  Synthetic
ggacacuugcgacgaagacu

SEQ ID NO: 1064 - RNA, 20 nt, Artificial Sequence
  Synthetic
cacuugcgacgaagacucgg

SEQ ID NO: 1065 - RNA, 20 nt, Artificial Sequence
  Synthetic
ugcgacgaagacucgguggc

SEQ ID NO: 1066 - RNA, 20 nt, Artificial Sequence
  Synthetic
agacucgguggccggcgagu

SEQ ID NO: 1067 - RNA, 20 nt, Artificial Sequence
  Synthetic
gagucggaccgcauagacga

SEQ ID NO: 1068 - RNA, 20 nt, Artificial Sequence
  Synthetic
auagacgauggcacuguuaa

SEQ ID NO: 1069 - RNA, 20 nt, Artificial Sequence
  Synthetic
gauggcacuguuaauggccg

SEQ ID NO: 1070 - RNA, 20 nt, Artificial Sequence
  Synthetic
uaauggccgcggcugcuccc

SEQ ID NO: 1071 - RNA, 20 nt, Artificial Sequence
  Synthetic
aauggccgcggcugcucccc

SEQ ID NO: 1072 - RNA, 20 nt, Artificial Sequence
  Synthetic
cggcugcuccccgggcgagu

SEQ ID NO: 1073 - RNA, 20 nt, Artificial Sequence
  Synthetic
cuccccgggcgagucggccu

SEQ ID NO: 1074 - RNA, 20 nt, Artificial Sequence
  Synthetic
uccccgggcgagucggccuc

SEQ ID NO: 1075 - RNA, 20 nt, Artificial Sequence
  Synthetic
ccccgggcgagucggccucg

SEQ ID NO: 1076 - RNA, 20 nt, Artificial Sequence
  Synthetic
cccgggcgagucggccucgg

SEQ ID NO: 1077 - RNA, 20 nt, Artificial Sequence
  Synthetic
ccgggcgagucggccucggg

SEQ ID NO: 1078 - RNA, 20 nt, Artificial Sequence
  Synthetic
ccuguccaaaaagcugcugc

SEQ ID NO: 1079 - RNA, 20 nt, Artificial Sequence
  Synthetic
cuguccaaaaagcugcugcu

SEQ ID NO: 1080 - RNA, 20 nt, Artificial Sequence
  Synthetic
uaagcgcaucaagcucgaga

SEQ ID NO: 1081 - RNA, 20 nt, Artificial Sequence
  Synthetic
gaaggaguucgaccugcccc

SEQ ID NO: 1082 - RNA, 20 nt, Artificial Sequence
  Synthetic
cccggccgcgaugcccaaca

SEQ ID NO: 1083 - RNA, 20 nt, Artificial Sequence
  Synthetic
cggagaacguguacucgcag

SEQ ID NO: 1084 - RNA, 20 nt, Artificial Sequence
  Synthetic
guguacucgcaguggcucgc

SEQ ID NO: 1085 - RNA, 20 nt, Artificial Sequence
  Synthetic
gcaguggcucgccggcuacg

SEQ ID NO: 1086 - RNA, 20 nt, Artificial Sequence
  Synthetic
ucgccggcuacgcggccucc

SEQ ID NO: 1087 - RNA, 20 nt, Artificial Sequence
  Synthetic
aaagaucccuuccuuagcuu

SEQ ID NO: 1088 - RNA, 20 nt, Artificial Sequence
  Synthetic
aucgccuuuugccuccucgu

SEQ ID NO: 1089 - RNA, 20 nt, Artificial Sequence
  Synthetic
cuccucgucggagcacuccu

SEQ ID NO: 1090 - RNA, 20 nt, Artificial Sequence
  Synthetic
ucggagcacuccucggagaa

SEQ ID NO: 1091 - RNA, 20 nt, Artificial Sequence
  Synthetic
cggagcacuccucggagaac

SEQ ID NO: 1092 - RNA, 20 nt, Artificial Sequence
  Synthetic
uugcgcuucuccacaccgcc

SEQ ID NO: 1093 - RNA, 20 nt, Artificial Sequence
  Synthetic
ugcgcuucuccacaccgccc

SEQ ID NO: 1094 - RNA, 20 nt, Artificial Sequence
  Synthetic
gcgcuucuccacaccgcccg

SEQ ID NO: 1095 - RNA, 20 nt, Artificial Sequence
  Synthetic
cuccacaccgcccggggagc

SEQ ID NO: 1096 - RNA, 20 nt, Artificial Sequence
  Synthetic
acaccgcccggggagcugga

SEQ ID NO: 1097 - RNA, 20 nt, Artificial Sequence
  Synthetic
ccgcccggggagcuggacgg

SEQ ID NO: 1098 - RNA, 20 nt, Artificial Sequence
  Synthetic
cgcccggggagcuggacgga

SEQ ID NO: 1099 - RNA, 20 nt, Artificial Sequence
  Synthetic
ggagcuggacggagggaucu

SEQ ID NO: 1100 - RNA, 20 nt, Artificial Sequence
  Synthetic
gagcuggacggagggaucuc

SEQ ID NO: 1101 - RNA, 20 nt, Artificial Sequence
  Synthetic
agcuggacggagggaucucg

SEQ ID NO: 1102 - RNA, 20 nt, Artificial Sequence
  Synthetic
ggagggaucucggggcgcag

SEQ ID NO: 1103 - RNA, 20 nt, Artificial Sequence
  Synthetic
gaucucggggcgcagcggca

SEQ ID NO: 1104 - RNA, 20 nt, Artificial Sequence
  Synthetic
aucucggggcgcagcggcac

SEQ ID NO: 1105 - RNA, 20 nt, Artificial Sequence
  Synthetic
gggcgcagcggcacgggaag

SEQ ID NO: 1106 - RNA, 20 nt, Artificial Sequence
  Synthetic
cgcagcggcacgggaagugg

SEQ ID NO: 1107 - RNA, 20 nt, Artificial Sequence
  Synthetic
gcagcggcacgggaagugga

SEQ ID NO: 1108 - RNA, 20 nt, Artificial Sequence
  Synthetic
gggagcacgccccauauuag

SEQ ID NO: 1109 - RNA, 20 nt, Artificial Sequence
  Synthetic
cacgccccauauuagugguc

SEQ ID NO: 1110 - RNA, 20 nt, Artificial Sequence
  Synthetic
acgccccauauuaguggucc

SEQ ID NO: 1111 - RNA, 20 nt, Artificial Sequence
  Synthetic
ccauauuagugguccgggcc

SEQ ID NO: 1112 - RNA, 20 nt, Artificial Sequence
  Synthetic
cauauuagugguccgggccc

SEQ ID NO: 1113 - RNA, 20 nt, Artificial Sequence
  Synthetic
uuagugguccgggcccgggc

SEQ ID NO: 1114 - RNA, 20 nt, Artificial Sequence
  Synthetic
gggcaggcccagcucaaaag

SEQ ID NO: 1115 - RNA, 20 nt, Artificial Sequence
  Synthetic
ggcaggcccagcucaaaaga

SEQ ID NO: 1116 - RNA, 20 nt, Artificial Sequence
  Synthetic
gcgucugcccucuuuugagc

SEQ ID NO: 1117 - RNA, 20 nt, Artificial Sequence
  Synthetic
cgucugcccucuuuugagcu

SEQ ID NO: 1118 - RNA, 20 nt, Artificial Sequence
  Synthetic
ucuuuugagcugggccugcc

SEQ ID NO: 1119 - RNA, 20 nt, Artificial Sequence
  Synthetic
cuuuugagcugggccugccc

SEQ ID NO: 1120 - RNA, 20 nt, Artificial Sequence
  Synthetic
gagcugggccugcccgggcc

SEQ ID NO: 1121 - RNA, 20 nt, Artificial Sequence
  Synthetic
ccgggcccggaccacuaaua

SEQ ID NO: 1122 - RNA, 20 nt, Artificial Sequence
  Synthetic
cgggcccggaccacuaauau

SEQ ID NO: 1123 - RNA, 20 nt, Artificial Sequence
  Synthetic
gggcccggaccacuaauaug

SEQ ID NO: 1124 - RNA, 20 nt, Artificial Sequence
  Synthetic
gaucccuccguccagcuccc

SEQ ID NO: 1125 - RNA, 20 nt, Artificial Sequence
  Synthetic
aucccuccguccagcucccc

SEQ ID NO: 1126 - RNA, 20 nt, Artificial Sequence
  Synthetic
ccuccguccagcuccccggg

SEQ ID NO: 1127 - RNA, 20 nt, Artificial Sequence
  Synthetic
guccagcuccccgggcggug

SEQ ID NO: 1128 - RNA, 20 nt, Artificial Sequence
  Synthetic
gcgcaaacucccguucuccg

SEQ ID NO: 1129 - RNA, 20 nt, Artificial Sequence
  Synthetic
cuccgaggagugcuccgacg

SEQ ID NO: 1130 - RNA, 20 nt, Artificial Sequence
  Synthetic
cgaggagugcuccgacgagg

SEQ ID NO: 1131 - RNA, 20 nt, Artificial Sequence
  Synthetic
ugcuccgacgaggaggcaaa

SEQ ID NO: 1132 - RNA, 20 nt, Artificial Sequence
  Synthetic
ggaggcaaaaggcgauuguc

SEQ ID NO: 1133 - RNA, 20 nt, Artificial Sequence
  Synthetic
gucuggagucuccgaagcua

SEQ ID NO: 1134 - RNA, 20 nt, Artificial Sequence
  Synthetic
ggagucuccgaagcuaagga

SEQ ID NO: 1135 - RNA, 20 nt, Artificial Sequence
  Synthetic
gagucuccgaagcuaaggaa

SEQ ID NO: 1136 - RNA, 20 nt, Artificial Sequence
  Synthetic
gaagggaucuuugagcugcc

SEQ ID NO: 1137 - RNA, 20 nt, Artificial Sequence
  Synthetic
gggaucuuugagcugccugg

SEQ ID NO: 1138 - RNA, 20 nt, Artificial Sequence
  Synthetic
cugccuggaggccgcguagc

SEQ ID NO: 1139 - RNA, 20 nt, Artificial Sequence
  Synthetic
cgaguacacguucuccgugu

SEQ ID NO: 1140 - RNA, 20 nt, Artificial Sequence
  Synthetic
gaguacacguucuccguguu

SEQ ID NO: 1141 - RNA, 20 nt, Artificial Sequence
  Synthetic
guucuccguguugggcaucg

SEQ ID NO: 1142 - RNA, 20 nt, Artificial Sequence
  Synthetic
uccguguugggcaucgcggc

SEQ ID NO: 1143 - RNA, 20 nt, Artificial Sequence
  Synthetic
ccguguugggcaucgcggcc

SEQ ID NO: 1144 - RNA, 20 nt, Artificial Sequence
  Synthetic
cguguugggcaucgcggccg

SEQ ID NO: 1145 - RNA, 20 nt, Artificial Sequence
  Synthetic
guguugggcaucgcggccgg

SEQ ID NO: 1146 - RNA, 20 nt, Artificial Sequence
  Synthetic
ugggcaucgcggccgggggc

SEQ ID NO: 1147 - RNA, 20 nt, Artificial Sequence
  Synthetic
gagcuugaugcgcuuagaga

SEQ ID NO: 1148 - RNA, 20 nt, Artificial Sequence
  Synthetic
agcuugaugcgcuuagagaa

SEQ ID NO: 1149 - RNA, 20 nt, Artificial Sequence
  Synthetic
gcuugaugcgcuuagagaag

SEQ ID NO: 1150 - RNA, 20 nt, Artificial Sequence
  Synthetic
agagaaggggcucagcgagc

SEQ ID NO: 1151 - RNA, 20 nt, Artificial Sequence
  Synthetic
gagaaggggcucagcgagcu

SEQ ID NO: 1152 - RNA, 20 nt, Artificial Sequence
  Synthetic
agaaggggcucagcgagcug

SEQ ID NO: 1153 - RNA, 20 nt, Artificial Sequence
  Synthetic
gcugcccagcagcagcuuuu

SEQ ID NO: 1154 - RNA, 20 nt, Artificial Sequence
  Synthetic
ccagcagcagcuuuuuggac

SEQ ID NO: 1155 - RNA, 20 nt, Artificial Sequence
  Synthetic
cuuuuuggacaggccccccg

SEQ ID NO: 1156 - RNA, 20 nt, Artificial Sequence
  Synthetic
ccccccgaggccgacucgcc

SEQ ID NO: 1157 - RNA, 20 nt, Artificial Sequence
  Synthetic
cccccgaggccgacucgccc

SEQ ID NO: 1158 - RNA, 20 nt, Artificial Sequence
  Synthetic
ccccgaggccgacucgcccg

SEQ ID NO: 1159 - RNA, 20 nt, Artificial Sequence
  Synthetic
acucgcccggggagcagccg

SEQ ID NO: 1160 - RNA, 20 nt, Artificial Sequence
  Synthetic
uaacagugccaucgucuaug

SEQ ID NO: 1161 - RNA, 20 nt, Artificial Sequence
  Synthetic
gucuaugcgguccgacucgc

SEQ ID NO: 1162 - RNA, 20 nt, Artificial Sequence
  Synthetic
cuucgucgcaagugucccug

SEQ ID NO: 1163 - RNA, 20 nt, Artificial Sequence
  Synthetic
gcaagugucccuguggcccu

SEQ ID NO: 1164 - RNA, 20 nt, Artificial Sequence
  Synthetic
gucccuguggcccucggccu

SEQ ID NO: 1165 - RNA, 20 nt, Artificial Sequence
  Synthetic
uguggcccucggccucggcc

SEQ ID NO: 1166 - RNA, 20 nt, Artificial Sequence
  Synthetic
ggcccucggccucggccagg

SEQ ID NO: 1167 - RNA, 20 nt, Artificial Sequence
  Synthetic
cgcgcuuaugcuucucgccc

SEQ ID NO: 1168 - RNA, 20 nt, Artificial Sequence
  Synthetic
uaugcuucucgcccaggacc

SEQ ID NO: 1169 - RNA, 20 nt, Artificial Sequence
  Synthetic
gcuucucgcccaggaccugg

SEQ ID NO: 1170 - RNA, 20 nt, Artificial Sequence
  Synthetic
cucgcccaggaccuggugga

SEQ ID NO: 1171 - RNA, 20 nt, Artificial Sequence
  Synthetic
ggccucgcugaagugcugca

SEQ ID NO: 1172 - RNA, 20 nt, Artificial Sequence
  Synthetic
caccaugcccugcaugacgu

SEQ ID NO: 1173 - RNA, 20 nt, Artificial Sequence
  Synthetic
accaugcccugcaugacguc

SEQ ID NO: 1174 - RNA, 20 nt, Artificial Sequence
  Synthetic
ugcccugcaugacgucgggc

SEQ ID NO: 1175 - RNA, 20 nt, Artificial Sequence
  Synthetic
gcccugcaugacgucgggca

SEQ ID NO: 1176 - RNA, 20 nt, Artificial Sequence
  Synthetic
gcaugacgucgggcagggcg

SEQ ID NO: 1177 - RNA, 20 nt, Artificial Sequence
  Synthetic
cgccccgcgagcuguucucg

SEQ ID NO: 1178 - RNA, 20 nt, Artificial Sequence
  Synthetic
cccgcgagcuguucucgugg

SEQ ID NO: 1179 - RNA, 20 nt, Artificial Sequence
  Synthetic
cgugguggcgcgccgccucc

SEQ ID NO: 1180 - RNA, 17 nt, Artificial Sequence
  Synthetic
ggaggaagaggaggagg

SEQ ID NO: 1181 - RNA, 17 nt, Artificial Sequence
  Synthetic
ggaggaggaggagcuga

SEQ ID NO: 1182 - RNA, 17 nt, Artificial Sequence
  Synthetic
agcugacggagagcgag

SEQ ID NO: 1183 - RNA, 17 nt, Artificial Sequence
  Synthetic
gcugacggagagcgaga

SEQ ID NO: 1184 - RNA, 17 nt, Artificial Sequence
  Synthetic
gacggagagcgagaggg

SEQ ID NO: 1185 - RNA, 17 nt, Artificial Sequence
  Synthetic
agcgagaggguggacua

SEQ ID NO: 1186 - RNA, 17 nt, Artificial Sequence
  Synthetic
aggguggacuacggcuu

SEQ ID NO: 1187 - RNA, 17 nt, Artificial Sequence
  Synthetic
ggguggacuacggcuuc

SEQ ID NO: 1188 - RNA, 17 nt, Artificial Sequence
  Synthetic
cggcuucgggcugagcc

SEQ ID NO: 1189 - RNA, 17 nt, Artificial Sequence
  Synthetic
cuucgggcugagccugg

SEQ ID NO: 1190 - RNA, 17 nt, Artificial Sequence
  Synthetic
cgggcugagccuggagg

SEQ ID NO: 1191 - RNA, 17 nt, Artificial Sequence
  Synthetic
accacgagaacagcucg

SEQ ID NO: 1192 - RNA, 17 nt, Artificial Sequence
  Synthetic
ccacgagaacagcucgc

SEQ ID NO: 1193 - RNA, 17 nt, Artificial Sequence
  Synthetic
cacgagaacagcucgcg

SEQ ID NO: 1194 - RNA, 17 nt, Artificial Sequence
  Synthetic
gaacagcucgcggggcg

SEQ ID NO: 1195 - RNA, 17 nt, Artificial Sequence
  Synthetic
cucgcggggcgcggucg

SEQ ID NO: 1196 - RNA, 17 nt, Artificial Sequence
  Synthetic
ucgcggggcgcggucgu

SEQ ID NO: 1197 - RNA, 17 nt, Artificial Sequence
  Synthetic
gggcgcggucgugggcg

SEQ ID NO: 1198 - RNA, 17 nt, Artificial Sequence
  Synthetic
ggcgcggucgugggcgu

SEQ ID NO: 1199 - RNA, 17 nt, Artificial Sequence
  Synthetic
ccugcccgacgucaugc

SEQ ID NO: 1200 - RNA, 17 nt, Artificial Sequence
  Synthetic
cugcccgacgucaugca

SEQ ID NO: 1201 - RNA, 17 nt, Artificial Sequence
  Synthetic
cgacgucaugcagggca

SEQ ID NO: 1202 - RNA, 17 nt, Artificial Sequence
  Synthetic
caugcagcacuucagcg

SEQ ID NO: 1203 - RNA, 17 nt, Artificial Sequence
  Synthetic
cagcgaggccuuccacc

SEQ ID NO: 1204 - RNA, 17 nt, Artificial Sequence
  Synthetic
ggccuuccaccaggucc

SEQ ID NO: 1205 - RNA, 17 nt, Artificial Sequence
  Synthetic
gccuuccaccagguccu

SEQ ID NO: 1206 - RNA, 17 nt, Artificial Sequence
  Synthetic
ggcgagaagcauaagcg

SEQ ID NO: 1207 - RNA, 17 nt, Artificial Sequence
  Synthetic
gcauaagcgcggccacc

SEQ ID NO: 1208 - RNA, 17 nt, Artificial Sequence
  Synthetic
gcgcggccaccuggccg

SEQ ID NO: 1209 - RNA, 17 nt, Artificial Sequence
  Synthetic
ccaccuggccgaggccg

SEQ ID NO: 1210 - RNA, 17 nt, Artificial Sequence
  Synthetic
caccuggccgaggccga

SEQ ID NO: 1211 - RNA, 17 nt, Artificial Sequence
  Synthetic
ccgaggccgagggccac

SEQ ID NO: 1212 - RNA, 17 nt, Artificial Sequence
  Synthetic
cgaggccgagggccaca

SEQ ID NO: 1213 - RNA, 17 nt, Artificial Sequence
  Synthetic
cacuugcgacgaagacu

SEQ ID NO: 1214 - RNA, 17 nt, Artificial Sequence
  Synthetic
uugcgacgaagacucgg

SEQ ID NO: 1215 - RNA, 17 nt, Artificial Sequence
  Synthetic
gacgaagacucgguggc

SEQ ID NO: 1216 - RNA, 17 nt, Artificial Sequence
  Synthetic
cucgguggccggcgagu

SEQ ID NO: 1217 - RNA, 17 nt, Artificial Sequence
  Synthetic
ucggaccgcauagacga

SEQ ID NO: 1218 - RNA, 17 nt, Artificial Sequence
  Synthetic
gacgauggcacuguuaa

SEQ ID NO: 1219 - RNA, 17 nt, Artificial Sequence
  Synthetic
ggcacuguuaauggccg

SEQ ID NO: 1220 - RNA, 17 nt, Artificial Sequence
  Synthetic
uggccgcggcugcuccc

SEQ ID NO: 1221 - RNA, 17 nt, Artificial Sequence
  Synthetic
ggccgcggcugcucccc

SEQ ID NO: 1222 - RNA, 17 nt, Artificial Sequence
  Synthetic
cugcuccccgggcgagu

SEQ ID NO: 1223 - RNA, 17 nt, Artificial Sequence
  Synthetic
cccgggcgagucggccu

SEQ ID NO: 1224 - RNA, 17 nt, Artificial Sequence
  Synthetic
ccgggcgagucggccuc

SEQ ID NO: 1225 - RNA, 17 nt, Artificial Sequence
  Synthetic
cgggcgagucggccucg

SEQ ID NO: 1226 - RNA, 17 nt, Artificial Sequence
  Synthetic
gggcgagucggccucgg

SEQ ID NO: 1227 - RNA, 17 nt, Artificial Sequence
  Synthetic
ggcgagucggccucggg

SEQ ID NO: 1228 - RNA, 17 nt, Artificial Sequence
  Synthetic
guccaaaaagcugcugc

SEQ ID NO: 1229 - RNA, 17 nt, Artificial Sequence
  Synthetic
uccaaaaagcugcugcu

SEQ ID NO: 1230 - RNA, 17 nt, Artificial Sequence
  Synthetic
gcgcaucaagcucgaga

SEQ ID NO: 1231 - RNA, 17 nt, Artificial Sequence
  Synthetic
ggaguucgaccugcccc

SEQ ID NO: 1232 - RNA, 17 nt, Artificial Sequence
  Synthetic
ggccgcgaugcccaaca

SEQ ID NO: 1233 - RNA, 17 nt, Artificial Sequence
  Synthetic
agaacguguacucgcag

SEQ ID NO: 1234 - RNA, 17 nt, Artificial Sequence
  Synthetic
uacucgcaguggcucgc

SEQ ID NO: 1235 - RNA, 17 nt, Artificial Sequence
  Synthetic
guggcucgccggcuacg

SEQ ID NO: 1236 - RNA, 17 nt, Artificial Sequence
  Synthetic
ccggcuacgcggccucc

SEQ ID NO: 1237 - RNA, 17 nt, Artificial Sequence
  Synthetic
gaucccuuccuuagcuu

SEQ ID NO: 1238 - RNA, 17 nt, Artificial Sequence
  Synthetic
gccuuuugccuccucgu

SEQ ID NO: 1239 - RNA, 17 nt, Artificial Sequence
  Synthetic
cucgucggagcacuccu

SEQ ID NO: 1240 - RNA, 17 nt, Artificial Sequence
  Synthetic
gagcacuccucggagaa

SEQ ID NO: 1241 - RNA, 17 nt, Artificial Sequence
  Synthetic
agcacuccucggagaac

SEQ ID NO: 1242 - RNA, 17 nt, Artificial Sequence
  Synthetic
cgcuucuccacaccgcc

SEQ ID NO: 1243 - RNA, 17 nt, Artificial Sequence
  Synthetic
gcuucuccacaccgccc

SEQ ID NO: 1244 - RNA, 17 nt, Artificial Sequence
  Synthetic
cuucuccacaccgcccg

SEQ ID NO: 1245 - RNA, 17 nt, Artificial Sequence
  Synthetic
cacaccgcccggggagc

SEQ ID NO: 1246 - RNA, 17 nt, Artificial Sequence
  Synthetic
ccgcccggggagcugga

SEQ ID NO: 1247 - RNA, 17 nt, Artificial Sequence
  Synthetic
cccggggagcuggacgg

SEQ ID NO: 1248 - RNA, 17 nt, Artificial Sequence
  Synthetic
ccggggagcuggacgga

SEQ ID NO: 1249 - RNA, 17 nt, Artificial Sequence
  Synthetic
gcuggacggagggaucu

SEQ ID NO: 1250 - RNA, 17 nt, Artificial Sequence
  Synthetic
cuggacggagggaucuc

SEQ ID NO: 1251 - RNA, 17 nt, Artificial Sequence
  Synthetic
uggacggagggaucucg

SEQ ID NO: 1252 - RNA, 17 nt, Artificial Sequence
  Synthetic
gggaucucggggcgcag

SEQ ID NO: 1253 - RNA, 17 nt, Artificial Sequence
  Synthetic
cucggggcgcagcggca

SEQ ID NO: 1254 - RNA, 17 nt, Artificial Sequence
  Synthetic
ucggggcgcagcggcac

SEQ ID NO: 1255 - RNA, 17 nt, Artificial Sequence
  Synthetic
cgcagcggcacgggaag

SEQ ID NO: 1256 - RNA, 17 nt, Artificial Sequence
  Synthetic
agcggcacgggaagugg

SEQ ID NO: 1257 - RNA, 17 nt, Artificial Sequence
  Synthetic
gcggcacgggaagugga

SEQ ID NO: 1258 - RNA, 17 nt, Artificial Sequence
  Synthetic
agcacgccccauauuag

SEQ ID NO: 1259 - RNA, 17 nt, Artificial Sequence
  Synthetic
gccccauauuagugguc

SEQ ID NO: 1260 - RNA, 17 nt, Artificial Sequence
  Synthetic
ccccauauuaguggucc

SEQ ID NO: 1261 - RNA, 17 nt, Artificial Sequence
  Synthetic
uauuagugguccgggcc

SEQ ID NO: 1262 - RNA, 17 nt, Artificial Sequence
  Synthetic
auuagugguccgggccc

SEQ ID NO: 1263 - RNA, 17 nt, Artificial Sequence
  Synthetic
gugguccgggcccgggc

SEQ ID NO: 1264 - RNA, 17 nt, Artificial Sequence
  Synthetic
caggcccagcucaaaag

SEQ ID NO: 1265 - RNA, 17 nt, Artificial Sequence
  Synthetic
aggcccagcucaaaaga

SEQ ID NO: 1266 - RNA, 17 nt, Artificial Sequence
  Synthetic
ucugcccucuuuugagc

SEQ ID NO: 1267 - RNA, 17 nt, Artificial Sequence
  Synthetic
cugcccucuuuugagcu

SEQ ID NO: 1268 - RNA, 17 nt, Artificial Sequence
  Synthetic
uuugagcugggccugcc

SEQ ID NO: 1269 - RNA, 17 nt, Artificial Sequence
  Synthetic
uugagcugggccugccc

SEQ ID NO: 1270 - RNA, 17 nt, Artificial Sequence
  Synthetic
cugggccugcccgggcc

SEQ ID NO: 1271 - RNA, 17 nt, Artificial Sequence
  Synthetic
ggcccggaccacuaaua

SEQ ID NO: 1272 - RNA, 17 nt, Artificial Sequence
  Synthetic
gcccggaccacuaauau

SEQ ID NO: 1273 - RNA, 17 nt, Artificial Sequence
  Synthetic
cccggaccacuaauaug

SEQ ID NO: 1274 - RNA, 17 nt, Artificial Sequence
  Synthetic
cccuccguccagcuccc

SEQ ID NO: 1275 - RNA, 17 nt, Artificial Sequence
  Synthetic
ccuccguccagcucccc

SEQ ID NO: 1276 - RNA, 17 nt, Artificial Sequence
  Synthetic
ccguccagcuccccggg

SEQ ID NO: 1277 - RNA, 17 nt, Artificial Sequence
  Synthetic
cagcuccccgggcggug

SEQ ID NO: 1278 - RNA, 17 nt, Artificial Sequence
  Synthetic
caaacucccguucuccg

SEQ ID NO: 1279 - RNA, 17 nt, Artificial Sequence
  Synthetic
cgaggagugcuccgacg

SEQ ID NO: 1280 - RNA, 17 nt, Artificial Sequence
  Synthetic
ggagugcuccgacgagg

SEQ ID NO: 1281 - RNA, 17 nt, Artificial Sequence
  Synthetic
uccgacgaggaggcaaa

SEQ ID NO: 1282 - RNA, 17 nt, Artificial Sequence
  Synthetic
ggcaaaaggcgauuguc

SEQ ID NO: 1283 - RNA, 17 nt, Artificial Sequence
  Synthetic
uggagucuccgaagcua

SEQ ID NO: 1284 - RNA, 17 nt, Artificial Sequence
  Synthetic
gucuccgaagcuaagga

SEQ ID NO: 1285 - RNA, 17 nt, Artificial Sequence
  Synthetic
ucuccgaagcuaaggaa

SEQ ID NO: 1286 - RNA, 17 nt, Artificial Sequence
  Synthetic
gggaucuuugagcugcc

SEQ ID NO: 1287 - RNA, 17 nt, Artificial Sequence
  Synthetic
aucuuugagcugccugg

SEQ ID NO: 1288 - RNA, 17 nt, Artificial Sequence
  Synthetic
ccuggaggccgcguagc

SEQ ID NO: 1289 - RNA, 17 nt, Artificial Sequence
  Synthetic
guacacguucuccgugu

SEQ ID NO: 1290 - RNA, 17 nt, Artificial Sequence
  Synthetic
uacacguucuccguguu

SEQ ID NO: 1291 - RNA, 17 nt, Artificial Sequence
  Synthetic
cuccguguugggcaucg

SEQ ID NO: 1292 - RNA, 17 nt, Artificial Sequence
  Synthetic
guguugggcaucgcggc

SEQ ID NO: 1293 - RNA, 17 nt, Artificial Sequence
  Synthetic
uguugggcaucgcggcc

SEQ ID NO: 1294 - RNA, 17 nt, Artificial Sequence
  Synthetic
guugggcaucgcggccg

SEQ ID NO: 1295 - RNA, 17 nt, Artificial Sequence
  Synthetic
uugggcaucgcggccgg

SEQ ID NO: 1296 - RNA, 17 nt, Artificial Sequence
  Synthetic
gcaucgcggccgggggc

SEQ ID NO: 1297 - RNA, 17 nt, Artificial Sequence
  Synthetic
cuugaugcgcuuagaga

SEQ ID NO: 1298 - RNA, 17 nt, Artificial Sequence
  Synthetic
uugaugcgcuuagagaa

SEQ ID NO: 1299 - RNA, 17 nt, Artificial Sequence
  Synthetic
ugaugcgcuuagagaag

SEQ ID NO: 1300 - RNA, 17 nt, Artificial Sequence
  Synthetic
gaaggggcucagcgagc

SEQ ID NO: 1301 - RNA, 17 nt, Artificial Sequence
  Synthetic
aaggggcucagcgagcu

SEQ ID NO: 1302 - RNA, 17 nt, Artificial Sequence
  Synthetic
aggggcucagcgagcug

SEQ ID NO: 1303 - RNA, 17 nt, Artificial Sequence
  Synthetic
gcccagcagcagcuuuu

SEQ ID NO: 1304 - RNA, 17 nt, Artificial Sequence
  Synthetic
gcagcagcuuuuuggac

SEQ ID NO: 1305 - RNA, 17 nt, Artificial Sequence
  Synthetic
uuuggacaggccccccg

SEQ ID NO: 1306 - RNA, 17 nt, Artificial Sequence
  Synthetic
cccgaggccgacucgcc

SEQ ID NO: 1307 - RNA, 17 nt, Artificial Sequence
  Synthetic
ccgaggccgacucgccc

SEQ ID NO: 1308 - RNA, 17 nt, Artificial Sequence
  Synthetic
cgaggccgacucgcccg

SEQ ID NO: 1309 - RNA, 17 nt, Artificial Sequence
  Synthetic
cgcccggggagcagccg

SEQ ID NO: 1310 - RNA, 17 nt, Artificial Sequence
  Synthetic
cagugccaucgucuaug

SEQ ID NO: 1311 - RNA, 17 nt, Artificial Sequence
  Synthetic
uaugcgguccgacucgc

SEQ ID NO: 1312 - RNA, 17 nt, Artificial Sequence
  Synthetic
cgucgcaagugucccug

SEQ ID NO: 1313 - RNA, 17 nt, Artificial Sequence
  Synthetic
agugucccuguggcccu

SEQ ID NO: 1314 - RNA, 17 nt, Artificial Sequence
  Synthetic
ccuguggcccucggccu

SEQ ID NO: 1315 - RNA, 17 nt, Artificial Sequence
  Synthetic
ggcccucggccucggcc

SEQ ID NO: 1316 - RNA, 17 nt, Artificial Sequence
  Synthetic
ccucggccucggccagg

SEQ ID NO: 1317 - RNA, 17 nt, Artificial Sequence
  Synthetic
gcuuaugcuucucgccc

SEQ ID NO: 1318 - RNA, 17 nt, Artificial Sequence
  Synthetic
gcuucucgcccaggacc

SEQ ID NO: 1319 - RNA, 17 nt, Artificial Sequence
  Synthetic
ucucgcccaggaccugg

SEQ ID NO: 1320 - RNA, 17 nt, Artificial Sequence
  Synthetic
gcccaggaccuggugga

SEQ ID NO: 1321 - RNA, 17 nt, Artificial Sequence
  Synthetic
cucgcugaagugcugca

SEQ ID NO: 1322 - RNA, 17 nt, Artificial Sequence
  Synthetic
caugcccugcaugacgu

SEQ ID NO: 1323 - RNA, 17 nt, Artificial Sequence
  Synthetic
augcccugcaugacguc

SEQ ID NO: 1324 - RNA, 17 nt, Artificial Sequence
  Synthetic
ccugcaugacgucgggc

SEQ ID NO: 1325 - RNA, 17 nt, Artificial Sequence
  Synthetic
cugcaugacgucgggca

SEQ ID NO: 1326 - RNA, 17 nt, Artificial Sequence
  Synthetic
ugacgucgggcagggcg

SEQ ID NO: 1327 - RNA, 17 nt, Artificial Sequence
  Synthetic
cccgcgagcuguucucg

SEQ ID NO: 1328 - RNA, 17 nt, Artificial Sequence
  Synthetic
gcgagcuguucucgugg

SEQ ID NO: 1329 - RNA, 17 nt, Artificial Sequence
  Synthetic
gguggcgcgccgccucc

SEQ ID NO: 1330 - RNA, 20 nt, Artificial Sequence
  Synthetic
cccagagagcucaagaugug

SEQ ID NO: 1331 - RNA, 20 nt, Artificial Sequence
  Synthetic
ucaagauguguggcaguuuu

SEQ ID NO: 1332 - RNA, 20 nt, Artificial Sequence
  Synthetic
gauguguggcaguuuucgga

SEQ ID NO: 1333 - RNA, 20 nt, Artificial Sequence
  Synthetic
gccacacaucuugagcucuc

SEQ ID NO: 1334 - RNA, 20 nt, Artificial Sequence
  Synthetic
ccacacaucuugagcucucu

SEQ ID NO: 1335 - RNA, 20 nt, Artificial Sequence
  Synthetic
ucucuggguacuacgccgaa

SEQ ID NO: 1336 - RNA, 20 nt, Artificial Sequence
  Synthetic
cucuggguacuacgccgaau

SEQ ID NO: 1337 - RNA, 20 nt, Artificial Sequence
  Synthetic
ucuggguacuacgccgaaug

SEQ ID NO: 1338 - RNA, 20 nt, Artificial Sequence
  Synthetic
cuggguacuacgccgaaugg

SEQ ID NO: 1339 - RNA, 17 nt, Artificial Sequence
  Synthetic
cuucacacacccccauu

SEQ ID NO: 1340 - RNA, 17 nt, Artificial Sequence
  Synthetic
agagagcucaagaugug

SEQ ID NO: 1341 - RNA, 17 nt, Artificial Sequence
  Synthetic
agauguguggcaguuuu

SEQ ID NO: 1342 - RNA, 17 nt, Artificial Sequence
  Synthetic
guguggcaguuuucgga

SEQ ID NO: 1343 - RNA, 17 nt, Artificial Sequence
  Synthetic
acacaucuugagcucuc

SEQ ID NO: 1344 - RNA, 17 nt, Artificial Sequence
  Synthetic
cacaucuugagcucucu

SEQ ID NO: 1345 - RNA, 17 nt, Artificial Sequence
  Synthetic
cuggguacuacgccgaa

SEQ ID NO: 1346 - RNA, 17 nt, Artificial Sequence
  Synthetic
uggguacuacgccgaau

SEQ ID NO: 1347 - RNA, 17 nt, Artificial Sequence
  Synthetic
ggguacuacgccgaaug

SEQ ID NO: 1348 - RNA, 17 nt, Artificial Sequence
  Synthetic
gguacuacgccgaaugg

SEQ ID NO: 1349 - RNA, 20 nt, Artificial Sequence
  Synthetic
aaaccccagcacuuaagcaa

SEQ ID NO: 1350 - RNA, 20 nt, Artificial Sequence
  Synthetic
aaccccagcacuuaagcaaa

SEQ ID NO: 1351 - RNA, 20 nt, Artificial Sequence
  Synthetic
accccagcacuuaagcaaac

SEQ ID NO: 1352 - RNA, 17 nt, Artificial Sequence
  Synthetic
ccccagcacuuaagcaa

SEQ ID NO: 1353 - RNA, 17 nt, Artificial Sequence
  Synthetic
cccagcacuuaagcaaa

SEQ ID NO: 1354 - RNA, 17 nt, Artificial Sequence
  Synthetic
ccagcacuuaagcaaac

SEQ ID NO: 1355 - RNA, 20 nt, Artificial Sequence
  Synthetic
ugggguuugccuugcuugcg

SEQ ID NO: 1356 - RNA, 20 nt, Artificial Sequence
  Synthetic
auucccguuugcuuaagugc

SEQ ID NO: 1357 - RNA, 20 nt, Artificial Sequence
  Synthetic
aauucccguuugcuuaagug

SEQ ID NO: 1358 - RNA, 17 nt, Artificial Sequence
  Synthetic
gguuugccuugcuugcg

SEQ ID NO: 1359 - RNA, 17 nt, Artificial Sequence
  Synthetic
cccguuugcuuaagugc

SEQ ID NO: 1360 - RNA, 17 nt, Artificial Sequence
  Synthetic
ucccguuugcuuaagug

SEQ ID NO: 1361 - RNA, 20 nt, Artificial Sequence
  Synthetic
ugaagccauucuuacagaug

SEQ ID NO: 1362 - RNA, 20 nt, Artificial Sequence
  Synthetic
augaaccagaccacggcccg

SEQ ID NO: 1363 - RNA, 20 nt, Artificial Sequence
  Synthetic
ugaaccagaccacggcccgu

SEQ ID NO: 1364 - RNA, 20 nt, Artificial Sequence
  Synthetic
gaaccagaccacggcccguu

SEQ ID NO: 1365 - RNA, 20 nt, Artificial Sequence
  Synthetic
ccacggcccguugggagcuc

SEQ ID NO: 1366 - RNA, 20 nt, Artificial Sequence
  Synthetic
cggcccguugggagcuccag

SEQ ID NO: 1367 - RNA, 20 nt, Artificial Sequence
  Synthetic
ggcccguugggagcuccaga

SEQ ID NO: 1368 - RNA, 20 nt, Artificial Sequence
  Synthetic
gcccguugggagcuccagaa

SEQ ID NO: 1369 - RNA, 20 nt, Artificial Sequence
  Synthetic
ggaucaugaccuccucaccu

SEQ ID NO: 1370 - RNA, 20 nt, Artificial Sequence
  Synthetic
ucaccugugggcagugccag

SEQ ID NO: 1371 - RNA, 20 nt, Artificial Sequence
  Synthetic
agugccagaugaacuuccca

SEQ ID NO: 1372 - RNA, 20 nt, Artificial Sequence
  Synthetic
gugccagaugaacuucccau

SEQ ID NO: 1373 - RNA, 20 nt, Artificial Sequence
  Synthetic
ugccagaugaacuucccauu

SEQ ID NO: 1374 - RNA, 20 nt, Artificial Sequence
  Synthetic
gccagaugaacuucccauug

SEQ ID NO: 1375 - RNA, 20 nt, Artificial Sequence
  Synthetic
gggggacauucuuauuuuua

SEQ ID NO: 1376 - RNA, 20 nt, Artificial Sequence
  Synthetic
cuuauuuuuaucgagcacaa

SEQ ID NO: 1377 - RNA, 20 nt, Artificial Sequence
  Synthetic
uuauuuuuaucgagcacaaa

SEQ ID NO: 1378 - RNA, 20 nt, Artificial Sequence
  Synthetic
augcaauggcagccucugcu

SEQ ID NO: 1379 - RNA, 20 nt, Artificial Sequence
  Synthetic
gccucugcuuagaaaaagcu

SEQ ID NO: 1380 - RNA, 20 nt, Artificial Sequence
  Synthetic
gccaccuuccccuucaccaa

SEQ ID NO: 1381 - RNA, 20 nt, Artificial Sequence
  Synthetic
cuuccccuucaccaaucgag

SEQ ID NO: 1382 - RNA, 20 nt, Artificial Sequence
  Synthetic
ugaaaaaagcauccaauccc

SEQ ID NO: 1383 - RNA, 20 nt, Artificial Sequence
  Synthetic
gaaaaaagcauccaaucccg

SEQ ID NO: 1384 - RNA, 20 nt, Artificial Sequence
  Synthetic
gguuggcauccaggucacgc

SEQ ID NO: 1385 - RNA, 20 nt, Artificial Sequence
  Synthetic
uuggcauccaggucacgcca

SEQ ID NO: 1386 - RNA, 20 nt, Artificial Sequence
  Synthetic
gauuguuuaucaacgucauc

SEQ ID NO: 1387 - RNA, 20 nt, Artificial Sequence
  Synthetic
uuguuuaucaacgucaucua

SEQ ID NO: 1388 - RNA, 20 nt, Artificial Sequence
  Synthetic
uguuuaucaacgucaucuag

SEQ ID NO: 1389 - RNA, 20 nt, Artificial Sequence
  Synthetic
cuagaggaauuugccccaaa

SEQ ID NO: 1390 - RNA, 20 nt, Artificial Sequence
  Synthetic
uagaggaauuugccccaaac

SEQ ID NO: 1391 - RNA, 17 nt, Artificial Sequence
  Synthetic
agccauucuuacagaug

SEQ ID NO: 1392 - RNA, 17 nt, Artificial Sequence
  Synthetic
aaccagaccacggcccg

SEQ ID NO: 1393 - RNA, 17 nt, Artificial Sequence
  Synthetic
accagaccacggcccgu

SEQ ID NO: 1394 - RNA, 17 nt, Artificial Sequence
  Synthetic
ccagaccacggcccguu

SEQ ID NO: 1395 - RNA, 17 nt, Artificial Sequence
  Synthetic
cggcccguugggagcuc

SEQ ID NO: 1396 - RNA, 17 nt, Artificial Sequence
  Synthetic
cccguugggagcuccag

SEQ ID NO: 1397 - RNA, 17 nt, Artificial Sequence
  Synthetic
ccguugggagcuccaga

SEQ ID NO: 1398 - RNA, 17 nt, Artificial Sequence
  Synthetic
cguugggagcuccagaa

SEQ ID NO: 1399 - RNA, 17 nt, Artificial Sequence
  Synthetic
ucaugaccuccucaccu

SEQ ID NO: 1400 - RNA, 17 nt, Artificial Sequence
  Synthetic
ccugugggcagugccag

SEQ ID NO: 1401 - RNA, 17 nt, Artificial Sequence
  Synthetic
gccagaugaacuuccca

SEQ ID NO: 1402 - RNA, 17 nt, Artificial Sequence
  Synthetic
ccagaugaacuucccau

SEQ ID NO: 1403 - RNA, 17 nt, Artificial Sequence
  Synthetic
cagaugaacuucccauu

SEQ ID NO: 1404 - RNA, 17 nt, Artificial Sequence
  Synthetic
agaugaacuucccauug

SEQ ID NO: 1405 - RNA, 17 nt, Artificial Sequence
  Synthetic
ggacauucuuauuuuua

SEQ ID NO: 1406 - RNA, 17 nt, Artificial Sequence
  Synthetic
auuuuuaucgagcacaa

SEQ ID NO: 1407 - RNA, 17 nt, Artificial Sequence
  Synthetic
uuuuuaucgagcacaaa

SEQ ID NO: 1408 - RNA, 17 nt, Artificial Sequence
  Synthetic
caauggcagccucugcu

SEQ ID NO: 1409 - RNA, 17 nt, Artificial Sequence
  Synthetic
ucugcuuagaaaaagcu

SEQ ID NO: 1410 - RNA, 17 nt, Artificial Sequence
  Synthetic
accuuccccuucaccaa

SEQ ID NO: 1411 - RNA, 17 nt, Artificial Sequence
  Synthetic
ccccuucaccaaucgag

SEQ ID NO: 1412 - RNA, 17 nt, Artificial Sequence
  Synthetic
aaaaagcauccaauccc

SEQ ID NO: 1413 - RNA, 17 nt, Artificial Sequence
  Synthetic
aaaagcauccaaucccg

SEQ ID NO: 1414 - RNA, 17 nt, Artificial Sequence
  Synthetic
uggcauccaggucacgc

SEQ ID NO: 1415 - RNA, 17 nt, Artificial Sequence
  Synthetic
gcauccaggucacgcca

SEQ ID NO: 1416 - RNA, 17 nt, Artificial Sequence
  Synthetic
uguuuaucaacgucauc

SEQ ID NO: 1417 - RNA, 17 nt, Artificial Sequence
  Synthetic
uuuaucaacgucaucua

SEQ ID NO: 1418 - RNA, 17 nt, Artificial Sequence
  Synthetic
uuaucaacgucaucuag

SEQ ID NO: 1419 - RNA, 17 nt, Artificial Sequence
  Synthetic
gaggaauuugccccaaa

SEQ ID NO: 1420 - RNA, 17 nt, Artificial Sequence
  Synthetic
aggaauuugccccaaac

SEQ ID NO: 1421 - RNA, 20 nt, Artificial Sequence
  Synthetic
ucaucuguaagaauggcuuc

SEQ ID NO: 1422 - RNA, 20 nt, Artificial Sequence
  Synthetic
uggucugguucaucaucugu

SEQ ID NO: 1423 - RNA, 20 nt, Artificial Sequence
  Synthetic
auccccuucuggagcuccca

SEQ ID NO: 1424 - RNA, 20 nt, Artificial Sequence
  Synthetic
aggaggucaugauccccuuc

SEQ ID NO: 1425 - RNA, 20 nt, Artificial Sequence
  Synthetic
gaggaggucaugauccccuu

SEQ ID NO: 1426 - RNA, 20 nt, Artificial Sequence
  Synthetic
ucuggcacugcccacaggug

SEQ ID NO: 1427 - RNA, 20 nt, Artificial Sequence
  Synthetic
aucuggcacugcccacaggu

SEQ ID NO: 1428 - RNA, 20 nt, Artificial Sequence
  Synthetic
ucaucuggcacugcccacag

SEQ ID NO: 1429 - RNA, 20 nt, Artificial Sequence
  Synthetic
aaauaagaaugucccccaau

SEQ ID NO: 1430 - RNA, 20 nt, Artificial Sequence
  Synthetic
aaaauaagaaugucccccaa

SEQ ID NO: 1431 - RNA, 20 nt, Artificial Sequence
  Synthetic
aaaaauaagaauguccccca

SEQ ID NO: 1432 - RNA, 20 nt, Artificial Sequence
  Synthetic
cguuugugcucgauaaaaau

SEQ ID NO: 1433 - RNA, 20 nt, Artificial Sequence
  Synthetic
uauccacagcuuuuucuaag

SEQ ID NO: 1434 - RNA, 20 nt, Artificial Sequence
  Synthetic
uuucaucucgauuggugaag

SEQ ID NO: 1435 - RNA, 20 nt, Artificial Sequence
  Synthetic
uuuucaucucgauuggugaa

SEQ ID NO: 1436 - RNA, 20 nt, Artificial Sequence
  Synthetic
uuuuucaucucgauugguga

SEQ ID NO: 1437 - RNA, 20 nt, Artificial Sequence
  Synthetic
uuuuuucaucucgauuggug

SEQ ID NO: 1438 - RNA, 20 nt, Artificial Sequence
  Synthetic
ugcuuuuuucaucucgauug

SEQ ID NO: 1439 - RNA, 20 nt, Artificial Sequence
  Synthetic
ggaugccaaccuccacggga

SEQ ID NO: 1440 - RNA, 20 nt, Artificial Sequence
  Synthetic
gaccuggaugccaaccucca

SEQ ID NO: 1441 - RNA, 20 nt, Artificial Sequence
  Synthetic
ugaccuggaugccaaccucc

SEQ ID NO: 1442 - RNA, 20 nt, Artificial Sequence
  Synthetic
ucgucauccucuggcgugac

SEQ ID NO: 1443 - RNA, 20 nt, Artificial Sequence
  Synthetic
cugcuauguguuccuguuug

SEQ ID NO: 1444 - RNA, 20 nt, Artificial Sequence
  Synthetic
cugcuauguguuccuguuug

SEQ ID NO: 1445 - RNA, 17 nt, Artificial Sequence
  Synthetic
ucuguaagaauggcuuc

SEQ ID NO: 1446 - RNA, 17 nt, Artificial Sequence
  Synthetic
ucugguucaucaucugu

SEQ ID NO: 1447 - RNA, 17 nt, Artificial Sequence
  Synthetic
cccuucuggagcuccca

SEQ ID NO: 1448 - RNA, 17 nt, Artificial Sequence
  Synthetic
aggucaugauccccuuc

SEQ ID NO: 1449 - RNA, 17 nt, Artificial Sequence
  Synthetic
gaggucaugauccccuu

SEQ ID NO: 1450 - RNA, 17 nt, Artificial Sequence
  Synthetic
ggcacugcccacaggug

SEQ ID NO: 1451 - RNA, 17 nt, Artificial Sequence
  Synthetic
uggcacugcccacaggu

SEQ ID NO: 1452 - RNA, 17 nt, Artificial Sequence
  Synthetic
ucuggcacugcccacag

SEQ ID NO: 1453 - RNA, 17 nt, Artificial Sequence
  Synthetic
uaagaaugucccccaau

SEQ ID NO: 1454 - RNA, 17 nt, Artificial Sequence
  Synthetic
auaagaaugucccccaa

SEQ ID NO: 1455 - RNA, 17 nt, Artificial Sequence
  Synthetic
aauaagaauguccccca

SEQ ID NO: 1456 - RNA, 17 nt, Artificial Sequence
  Synthetic
uugugcucgauaaaaau

SEQ ID NO: 1457 - RNA, 17 nt, Artificial Sequence
  Synthetic
ccacagcuuuuucuaag

SEQ ID NO: 1458 - RNA, 17 nt, Artificial Sequence
  Synthetic
caucucgauuggugaag

SEQ ID NO: 1459 - RNA, 17 nt, Artificial Sequence
  Synthetic
ucaucucgauuggugaa

SEQ ID NO: 1460 - RNA, 17 nt, Artificial Sequence
  Synthetic
uucaucucgauugguga

SEQ ID NO: 1461 - RNA, 17 nt, Artificial Sequence
  Synthetic
uuucaucucgauuggug

SEQ ID NO: 1462 - RNA, 17 nt, Artificial Sequence
  Synthetic
uuuuuucaucucgauug

SEQ ID NO: 1463 - RNA, 17 nt, Artificial Sequence
  Synthetic
ugccaaccuccacggga

SEQ ID NO: 1464 - RNA, 17 nt, Artificial Sequence
  Synthetic
cuggaugccaaccucca

SEQ ID NO: 1465 - RNA, 17 nt, Artificial Sequence
  Synthetic
ccuggaugccaaccucc

SEQ ID NO: 1466 - RNA, 17 nt, Artificial Sequence
  Synthetic
ucauccucuggcgugac

SEQ ID NO: 1467 - RNA, 17 nt, Artificial Sequence
  Synthetic
ugcuauguguuccuguu

SEQ ID NO: 1468 - RNA, 17 nt, Artificial Sequence
  Synthetic
cugcuauguguuccugu

SEQ ID NO: 1469 - RNA, 20 nt, Artificial Sequence
  Synthetic
cuccuccccucguucugcac

SEQ ID NO: 1470 - RNA, 20 nt, Artificial Sequence
  Synthetic
uccuccccucguucugcaca

SEQ ID NO: 1471 - RNA, 20 nt, Artificial Sequence
  Synthetic
uggagcucuaauccccacgc

SEQ ID NO: 1472 - RNA, 20 nt, Artificial Sequence
  Synthetic
ggagcucuaauccccacgcc

SEQ ID NO: 1473 - RNA, 20 nt, Artificial Sequence
  Synthetic
cucuaauccccacgccuggg

SEQ ID NO: 1474 - RNA, 20 nt, Artificial Sequence
  Synthetic
ccccacgccugggaugagug

SEQ ID NO: 1475 - RNA, 20 nt, Artificial Sequence
  Synthetic
ugagugcagaauaugccccg

SEQ ID NO: 1476 - RNA, 17 nt, Artificial Sequence
  Synthetic
cuccccucguucugcac

SEQ ID NO: 1477 - RNA, 17 nt, Artificial Sequence
  Synthetic
uccccucguucugcaca

SEQ ID NO: 1478 - RNA, 17 nt, Artificial Sequence
  Synthetic
agcucuaauccccacgc

SEQ ID NO: 1479 - RNA, 17 nt, Artificial Sequence
  Synthetic
gcucuaauccccacgcc

SEQ ID NO: 1480 - RNA, 17 nt, Artificial Sequence
  Synthetic
uaauccccacgccuggg

SEQ ID NO: 1481 - RNA, 17 nt, Artificial Sequence
  Synthetic
cacgccugggaugagug

SEQ ID NO: 1482 - RNA, 17 nt, Artificial Sequence
  Synthetic
gugcagaauaugccccg

SEQ ID NO: 1483 - RNA, 20 nt, Artificial Sequence
  Synthetic
gaggagaggccccuccagug

SEQ ID NO: 1484 - RNA, 20 nt, Artificial Sequence
  Synthetic
caugugcagaacgaggggag

SEQ ID NO: 1485 - RNA, 20 nt, Artificial Sequence
  Synthetic
uccaugugcagaacgagggg

SEQ ID NO: 1486 - RNA, 20 nt, Artificial Sequence
  Synthetic
cuccaugugcagaacgaggg

SEQ ID NO: 1487 - RNA, 20 nt, Artificial Sequence
  Synthetic
agcuccaugugcagaacgag

SEQ ID NO: 1488 - RNA, 20 nt, Artificial Sequence
  Synthetic
gagcuccaugugcagaacga

SEQ ID NO: 1489 - RNA, 20 nt, Artificial Sequence
  Synthetic
agagcuccaugugcagaacg

SEQ ID NO: 1490 - RNA, 20 nt, Artificial Sequence
  Synthetic
uagagcuccaugugcagaac

SEQ ID NO: 1491 - RNA, 20 nt, Artificial Sequence
  Synthetic
auuagagcuccaugugcaga

SEQ ID NO: 1492 - RNA, 20 nt, Artificial Sequence
  Synthetic
ggggauuagagcuccaugug

SEQ ID NO: 1493 - RNA, 20 nt, Artificial Sequence
  Synthetic
cucaucccaggcguggggau

SEQ ID NO: 1494 - RNA, 20 nt, Artificial Sequence
  Synthetic
ucugcacucaucccaggcgu

SEQ ID NO: 1495 - RNA, 20 nt, Artificial Sequence
  Synthetic
uucugcacucaucccaggcg

SEQ ID NO: 1496 - RNA, 20 nt, Artificial Sequence
  Synthetic
auucugcacucaucccaggc

SEQ ID NO: 1497 - RNA, 17 nt, Artificial Sequence
  Synthetic
gagaggccccuccagug

SEQ ID NO: 1498 - RNA, 17 nt, Artificial Sequence
  Synthetic
gugcagaacgaggggag

SEQ ID NO: 1499 - RNA, 17 nt, Artificial Sequence
  Synthetic
augugcagaacgagggg

SEQ ID NO: 1500 - RNA, 17 nt, Artificial Sequence
  Synthetic
caugugcagaacgaggg

SEQ ID NO: 1501 - RNA, 17 nt, Artificial Sequence
  Synthetic
uccaugugcagaacgag

SEQ ID NO: 1502 - RNA, 17 nt, Artificial Sequence
  Synthetic
cuccaugugcagaacga

SEQ ID NO: 1503 - RNA, 17 nt, Artificial Sequence
  Synthetic
gcuccaugugcagaacg

SEQ ID NO: 1504 - RNA, 17 nt, Artificial Sequence
  Synthetic
agcuccaugugcagaac

SEQ ID NO: 1505 - RNA, 17 nt, Artificial Sequence
  Synthetic
agagcuccaugugcaga

SEQ ID NO: 1506 - RNA, 17 nt, Artificial Sequence
  Synthetic
gauuagagcuccaugug

SEQ ID NO: 1507 - RNA, 17 nt, Artificial Sequence
  Synthetic
aucccaggcguggggau

SEQ ID NO: 1508 - RNA, 17 nt, Artificial Sequence
  Synthetic
gcacucaucccaggcgu

SEQ ID NO: 1509 - RNA, 17 nt, Artificial Sequence
  Synthetic
ugcacucaucccaggcg

SEQ ID NO: 1510 - RNA, 17 nt, Artificial Sequence
  Synthetic
cugcacucaucccaggc

SEQ ID NO: 1511 - RNA, 20 nt, Artificial Sequence
  Synthetic
gguuucucuugcaacacgca

SEQ ID NO: 1512 - RNA, 20 nt, Artificial Sequence
  Synthetic
gcaacacgcacagaacacuc

SEQ ID NO: 1513 - RNA, 20 nt, Artificial Sequence
  Synthetic
gcacagaacacucauggauu

SEQ ID NO: 1514 - RNA, 20 nt, Artificial Sequence
  Synthetic
ucauggauuaagaaucuacu

SEQ ID NO: 1515 - RNA, 20 nt, Artificial Sequence
  Synthetic
auuaagaaucuacuuagaaa

SEQ ID NO: 1516 - RNA, 20 nt, Artificial Sequence
  Synthetic
aaucuacuuagaaagcgaac

SEQ ID NO: 1517 - RNA, 20 nt, Artificial Sequence
  Synthetic
aucuacuuagaaagcgaaca

SEQ ID NO: 1518 - RNA, 20 nt, Artificial Sequence
  Synthetic
cacggaaguccccugacccc

SEQ ID NO: 1519 - RNA, 20 nt, Artificial Sequence
  Synthetic
cccgcggguugguaucccuu

SEQ ID NO: 1520 - RNA, 20 nt, Artificial Sequence
  Synthetic
uaucccuucaggacuaggug

SEQ ID NO: 1521 - RNA, 20 nt, Artificial Sequence
  Synthetic
uccuucccagccaccucucc

SEQ ID NO: 1522 - RNA, 20 nt, Artificial Sequence
  Synthetic
ccuucccagccaccucucca

SEQ ID NO: 1523 - RNA, 20 nt, Artificial Sequence
  Synthetic
aauaaccccuuuaaccugcu

SEQ ID NO: 1524 - RNA, 20 nt, Artificial Sequence
  Synthetic
cuuuaaccugcuaagaauac

SEQ ID NO: 1525 - RNA, 20 nt, Artificial Sequence
  Synthetic
uaagaauaccaggaucagua

SEQ ID NO: 1526 - RNA, 20 nt, Artificial Sequence
  Synthetic
agaauaccaggaucaguauc

SEQ ID NO: 1527 - RNA, 20 nt, Artificial Sequence
  Synthetic
aauaccaggaucaguaucga

SEQ ID NO: 1528 - RNA, 20 nt, Artificial Sequence
  Synthetic
gagagaggcuuccggccugg

SEQ ID NO: 1529 - RNA, 20 nt, Artificial Sequence
  Synthetic
agaggcuuccggccuggcag

SEQ ID NO: 1530 - RNA, 20 nt, Artificial Sequence
  Synthetic
ccccccuguuuaguccacca

SEQ ID NO: 1531 - RNA, 20 nt, Artificial Sequence
  Synthetic
guccaccaccgagacaucac

SEQ ID NO: 1532 - RNA, 20 nt, Artificial Sequence
  Synthetic
ucacuuggacccccaccgca

SEQ ID NO: 1533 - RNA, 20 nt, Artificial Sequence
  Synthetic
acccccaccgcauagagcgc

SEQ ID NO: 1534 - RNA, 20 nt, Artificial Sequence
  Synthetic
cccccaccgcauagagcgcc

SEQ ID NO: 1535 - RNA, 20 nt, Artificial Sequence
  Synthetic
ccccaccgcauagagcgccu

SEQ ID NO: 1536 - RNA, 20 nt, Artificial Sequence
  Synthetic
accgcauagagcgccugggg

SEQ ID NO: 1537 - RNA, 20 nt, Artificial Sequence
  Synthetic
ccgcauagagcgccuggggg

SEQ ID NO: 1538 - RNA, 20 nt, Artificial Sequence
  Synthetic
cauagagcgccugggggcgg

SEQ ID NO: 1539 - RNA, 20 nt, Artificial Sequence
  Synthetic
uggcccuggccacccaucac

SEQ ID NO: 1540 - RNA, 20 nt, Artificial Sequence
  Synthetic
caucacccgagugccuuuga

SEQ ID NO: 1541 - RNA, 20 nt, Artificial Sequence
  Synthetic
ccuuugacagggugcugcgg

SEQ ID NO: 1542 - RNA, 20 nt, Artificial Sequence
  Synthetic
ugcgguugaauccaauggcu

SEQ ID NO: 1543 - RNA, 20 nt, Artificial Sequence
  Synthetic
gcgguugaauccaauggcua

SEQ ID NO: 1544 - RNA, 20 nt, Artificial Sequence
  Synthetic
uggcuauggagccucccgcc

SEQ ID NO: 1545 - RNA, 20 nt, Artificial Sequence
  Synthetic
ccucccgccauggauuucuc

SEQ ID NO: 1546 - RNA, 20 nt, Artificial Sequence
  Synthetic
cucccgccauggauuucucu

SEQ ID NO: 1547 - RNA, 20 nt, Artificial Sequence
  Synthetic
auggauuucucuaggagacu

SEQ ID NO: 1548 - RNA, 20 nt, Artificial Sequence
  Synthetic
ggauuucucuaggagacuua

SEQ ID NO: 1549 - RNA, 20 nt, Artificial Sequence
  Synthetic
uaggagacuuagagagcugg

SEQ ID NO: 1550 - RNA, 20 nt, Artificial Sequence
  Synthetic
aggagacuuagagagcuggc

SEQ ID NO: 1551 - RNA, 20 nt, Artificial Sequence
  Synthetic
ggagacuuagagagcuggca

SEQ ID NO: 1552 - RNA, 20 nt, Artificial Sequence
  Synthetic
cccggucaaguccaagucau

SEQ ID NO: 1553 - RNA, 20 nt, Artificial Sequence
  Synthetic
gcggcaagacguucaaauuu

SEQ ID NO: 1554 - RNA, 20 nt, Artificial Sequence
  Synthetic
uggugcaccggcgcagccac

SEQ ID NO: 1555 - RNA, 20 nt, Artificial Sequence
  Synthetic
gcaccggcgcagccacacgg

SEQ ID NO: 1556 - RNA, 20 nt, Artificial Sequence
  Synthetic
accggcgcagccacacgggc

SEQ ID NO: 1557 - RNA, 20 nt, Artificial Sequence
  Synthetic
cgugcacccaggccagcaag

SEQ ID NO: 1558 - RNA, 20 nt, Artificial Sequence
  Synthetic
ccagcaagcugaagcgccac

SEQ ID NO: 1559 - RNA, 20 nt, Artificial Sequence
  Synthetic
gucucuccaccgccagcucc

SEQ ID NO: 1560 - RNA, 20 nt, Artificial Sequence
  Synthetic
ucucuccaccgccagcuccc

SEQ ID NO: 1561 - RNA, 20 nt, Artificial Sequence
  Synthetic
aacccggcaccagcgacuug

SEQ ID NO: 1562 - RNA, 20 nt, Artificial Sequence
  Synthetic
aguccgugguggccaaguuc

SEQ ID NO: 1563 - RNA, 20 nt, Artificial Sequence
  Synthetic
cgugguggccaaguucaaga

SEQ ID NO: 1564 - RNA, 20 nt, Artificial Sequence
  Synthetic
ugguggccaaguucaagagc

SEQ ID NO: 1565 - RNA, 20 nt, Artificial Sequence
  Synthetic
agaacgaccccaaccugauc

SEQ ID NO: 1566 - RNA, 20 nt, Artificial Sequence
  Synthetic
gaacgaccccaaccugaucc

SEQ ID NO: 1567 - RNA, 20 nt, Artificial Sequence
  Synthetic
acgaccccaaccugaucccg

SEQ ID NO: 1568 - RNA, 20 nt, Artificial Sequence
  Synthetic
ccccaaccugaucccggaga

SEQ ID NO: 1569 - RNA, 20 nt, Artificial Sequence
  Synthetic
cccaaccugaucccggagaa

SEQ ID NO: 1570 - RNA, 20 nt, Artificial Sequence
  Synthetic
ccaaccugaucccggagaac

SEQ ID NO: 1571 - RNA, 20 nt, Artificial Sequence
  Synthetic
ccugaucccggagaacgggg

SEQ ID NO: 1572 - RNA, 20 nt, Artificial Sequence
  Synthetic
ugaucccggagaacggggac

SEQ ID NO: 1573 - RNA, 20 nt, Artificial Sequence
  Synthetic
gaucccggagaacggggacg

SEQ ID NO: 1574 - RNA, 20 nt, Artificial Sequence
  Synthetic
ucccggagaacggggacgag

SEQ ID NO: 1575 - RNA, 20 nt, Artificial Sequence
  Synthetic
cccggagaacggggacgagg

SEQ ID NO: 1576 - RNA, 20 nt, Artificial Sequence
  Synthetic
ggagaacggggacgaggagg

SEQ ID NO: 1577 - RNA, 20 nt, Artificial Sequence
  Synthetic
agaacggggacgaggaggaa

SEQ ID NO: 1578 - RNA, 20 nt, Artificial Sequence
  Synthetic
gaacggggacgaggaggaag

SEQ ID NO: 1579 - RNA, 20 nt, Artificial Sequence
  Synthetic
acggggacgaggaggaagag

SEQ ID NO: 1580 - RNA, 20 nt, Artificial Sequence
  Synthetic
cgaggaggaagaggaggacg

SEQ ID NO: 1581 - RNA, 20 nt, Artificial Sequence
  Synthetic
aggaggaagaggaggacgac

SEQ ID NO: 1582 - RNA, 20 nt, Artificial Sequence
  Synthetic
ggaggaagaggaggacgacg

SEQ ID NO: 1583 - RNA, 20 nt, Artificial Sequence
  Synthetic
ggaagaggaggacgacgagg

SEQ ID NO: 1584 - RNA, 20 nt, Artificial Sequence
  Synthetic
aagaggaggacgacgaggaa

SEQ ID NO: 1585 - RNA, 20 nt, Artificial Sequence
  Synthetic
agaggaggacgacgaggaag

SEQ ID NO: 1586 - RNA, 20 nt, Artificial Sequence
  Synthetic
ggaggacgacgaggaagagg

SEQ ID NO: 1587 - RNA, 20 nt, Artificial Sequence
  Synthetic
ggacgacgaggaagaggaag

SEQ ID NO: 1588 - RNA, 20 nt, Artificial Sequence
  Synthetic
acgacgaggaagaggaagaa

SEQ ID NO: 1589 - RNA, 20 nt, Artificial Sequence
  Synthetic
cgacgaggaagaggaagaag

SEQ ID NO: 1590 - RNA, 20 nt, Artificial Sequence
  Synthetic
acgaggaagaggaagaagag

SEQ ID NO: 1591 - RNA, 20 nt, Artificial Sequence
  Synthetic
cgaggaagaggaagaagagg

SEQ ID NO: 1592 - RNA, 20 nt, Artificial Sequence
  Synthetic
ggaagaggaagaagaggagg

SEQ ID NO: 1593 - RNA, 20 nt, Artificial Sequence
  Synthetic
aagaggaagaagaggaggaa

SEQ ID NO: 1594 - RNA, 20 nt, Artificial Sequence
  Synthetic
agaggaagaagaggaggaag

SEQ ID NO: 1595 - RNA, 20 nt, Artificial Sequence
  Synthetic
aggaagaagaggaggaagag

SEQ ID NO: 1596 - RNA, 20 nt, Artificial Sequence
  Synthetic
ggaagaagaggaggaagagg

SEQ ID NO: 1597 - RNA, 20 nt, Artificial Sequence
  Synthetic
aagaagaggaggaagaggag

SEQ ID NO: 1598 - RNA, 20 nt, Artificial Sequence
  Synthetic
agaagaggaggaagaggagg

SEQ ID NO: 1599 - RNA, 20 nt, Artificial Sequence
  Synthetic
aagaggaggaagaggaggag

SEQ ID NO: 1600 - RNA, 20 nt, Artificial Sequence
  Synthetic
agaggaggaagaggaggagg

SEQ ID NO: 1601 - RNA, 20 nt, Artificial Sequence
  Synthetic
aagaggaggaggaggagcug

SEQ ID NO: 1602 - RNA, 20 nt, Artificial Sequence
  Synthetic
agaggaggaggaggagcuga

SEQ ID NO: 1603 - RNA, 20 nt, Artificial Sequence
  Synthetic
aggaggaggaggagcugacg

SEQ ID NO: 1604 - RNA, 20 nt, Artificial Sequence
  Synthetic
ggaggaggagcugacggaga

SEQ ID NO: 1605 - RNA, 20 nt, Artificial Sequence
  Synthetic
aggaggagcugacggagagc

SEQ ID NO: 1606 - RNA, 20 nt, Artificial Sequence
  Synthetic
gaggagcugacggagagcga

SEQ ID NO: 1607 - RNA, 20 nt, Artificial Sequence
  Synthetic
agcugacggagagcgagagg

SEQ ID NO: 1608 - RNA, 20 nt, Artificial Sequence
  Synthetic
cgagaggguggacuacggcu

SEQ ID NO: 1609 - RNA, 20 nt, Artificial Sequence
  Synthetic
ggguggacuacggcuucggg

SEQ ID NO: 1610 - RNA, 20 nt, Artificial Sequence
  Synthetic
acuacggcuucgggcugagc

SEQ ID NO: 1611 - RNA, 20 nt, Artificial Sequence
  Synthetic
cuacggcuucgggcugagcc

SEQ ID NO: 1612 - RNA, 20 nt, Artificial Sequence
  Synthetic
ccuggaggcggcgcgccacc

SEQ ID NO: 1613 - RNA, 20 nt, Artificial Sequence
  Synthetic
uggaggcggcgcgccaccac

SEQ ID NO: 1614 - RNA, 20 nt, Artificial Sequence
  Synthetic
cgccaccacgagaacagcuc

SEQ ID NO: 1615 - RNA, 20 nt, Artificial Sequence
  Synthetic
gccaccacgagaacagcucg

SEQ ID NO: 1616 - RNA, 20 nt, Artificial Sequence
  Synthetic
acagcucgcggggcgcgguc

SEQ ID NO: 1617 - RNA, 20 nt, Artificial Sequence
  Synthetic
cgcggggcgcggucgugggc

SEQ ID NO: 1618 - RNA, 20 nt, Artificial Sequence
  Synthetic
cgcggucgugggcgugggcg

SEQ ID NO: 1619 - RNA, 20 nt, Artificial Sequence
  Synthetic
cggucgugggcgugggcgac

SEQ ID NO: 1620 - RNA, 20 nt, Artificial Sequence
  Synthetic
gcgcccugcccgacgucaug

SEQ ID NO: 1621 - RNA, 20 nt, Artificial Sequence
  Synthetic
cagcuccaugcagcacuuca

SEQ ID NO: 1622 - RNA, 20 nt, Artificial Sequence
  Synthetic
gcgaggccuuccaccagguc

SEQ ID NO: 1623 - RNA, 20 nt, Artificial Sequence
  Synthetic
ggccuuccaccagguccugg

SEQ ID NO: 1624 - RNA, 20 nt, Artificial Sequence
  Synthetic
ccuuccaccagguccugggc

SEQ ID NO: 1625 - RNA, 20 nt, Artificial Sequence
  Synthetic
gcauaagcgcggccaccugg

SEQ ID NO: 1626 - RNA, 20 nt, Artificial Sequence
  Synthetic
gcgcggccaccuggccgagg

SEQ ID NO: 1627 - RNA, 20 nt, Artificial Sequence
  Synthetic
gcggccaccuggccgaggcc

SEQ ID NO: 1628 - RNA, 20 nt, Artificial Sequence
  Synthetic
cuggccgaggccgagggcca

SEQ ID NO: 1629 - RNA, 20 nt, Artificial Sequence
  Synthetic
uggccgaggccgagggccac

SEQ ID NO: 1630 - RNA, 20 nt, Artificial Sequence
  Synthetic
gggccacagggacacuugcg

SEQ ID NO: 1631 - RNA, 20 nt, Artificial Sequence
  Synthetic
cgacgaagacucgguggccg

SEQ ID NO: 1632 - RNA, 20 nt, Artificial Sequence
  Synthetic
aagacucgguggccggcgag

SEQ ID NO: 1633 - RNA, 20 nt, Artificial Sequence
  Synthetic
uuaauggccgcggcugcucc

SEQ ID NO: 1634 - RNA, 20 nt, Artificial Sequence
  Synthetic
uggccgcggcugcuccccgg

SEQ ID NO: 1635 - RNA, 20 nt, Artificial Sequence
  Synthetic
gcuccccgggcgagucggcc

SEQ ID NO: 1636 - RNA, 20 nt, Artificial Sequence
  Synthetic
cuccccgggcgagucggccu

SEQ ID NO: 1637 - RNA, 20 nt, Artificial Sequence
  Synthetic
uccccgggcgagucggccuc

SEQ ID NO: 1638 - RNA, 20 nt, Artificial Sequence
  Synthetic
ccccgggcgagucggccucg

SEQ ID NO: 1639 - RNA, 20 nt, Artificial Sequence
  Synthetic
gccuguccaaaaagcugcug

SEQ ID NO: 1640 - RNA, 20 nt, Artificial Sequence
  Synthetic
ugcugggcagccccagcucg

SEQ ID NO: 1641 - RNA, 20 nt, Artificial Sequence
  Synthetic
cuucucuaagcgcaucaagc

SEQ ID NO: 1642 - RNA, 20 nt, Artificial Sequence
  Synthetic
ucucuaagcgcaucaagcuc

SEQ ID NO: 1643 - RNA, 20 nt, Artificial Sequence
  Synthetic
cuaagcgcaucaagcucgag

SEQ ID NO: 1644 - RNA, 20 nt, Artificial Sequence
  Synthetic
uaagcgcaucaagcucgaga

SEQ ID NO: 1645 - RNA, 20 nt, Artificial Sequence
  Synthetic
ccccggccgcgaugcccaac

SEQ ID NO: 1646 - RNA, 20 nt, Artificial Sequence
  Synthetic
cccggccgcgaugcccaaca

SEQ ID NO: 1647 - RNA, 20 nt, Artificial Sequence
  Synthetic
cggccgcgaugcccaacacg

SEQ ID NO: 1648 - RNA, 20 nt, Artificial Sequence
  Synthetic
caaagaucccuuccuuagcu

SEQ ID NO: 1649 - RNA, 20 nt, Artificial Sequence
  Synthetic
aaagaucccuuccuuagcuu

SEQ ID NO: 1650 - RNA, 20 nt, Artificial Sequence
  Synthetic
aaucgccuuuugccuccucg

SEQ ID NO: 1651 - RNA, 20 nt, Artificial Sequence
  Synthetic
aucgccuuuugccuccucgu

SEQ ID NO: 1652 - RNA, 20 nt, Artificial Sequence
  Synthetic
ccuccucgucggagcacucc

SEQ ID NO: 1653 - RNA, 20 nt, Artificial Sequence
  Synthetic
cuccucgucggagcacuccu

SEQ ID NO: 1654 - RNA, 20 nt, Artificial Sequence
  Synthetic
ccucgucggagcacuccucg

SEQ ID NO: 1655 - RNA, 20 nt, Artificial Sequence
  Synthetic
gucggagcacuccucggaga

SEQ ID NO: 1656 - RNA, 20 nt, Artificial Sequence
  Synthetic
ucggagcacuccucggagaa

SEQ ID NO: 1657 - RNA, 20 nt, Artificial Sequence
  Synthetic
cggagcacuccucggagaac

SEQ ID NO: 1658 - RNA, 20 nt, Artificial Sequence
  Synthetic
uuugcgcuucuccacaccgc

SEQ ID NO: 1659 - RNA, 20 nt, Artificial Sequence
  Synthetic
uugcgcuucuccacaccgcc

SEQ ID NO: 1660 - RNA, 20 nt, Artificial Sequence
  Synthetic
ugcgcuucuccacaccgccc

SEQ ID NO: 1661 - RNA, 20 nt, Artificial Sequence
  Synthetic
gcgcuucuccacaccgcccg

SEQ ID NO: 1662 - RNA, 20 nt, Artificial Sequence
  Synthetic
ucuccacaccgcccggggag

SEQ ID NO: 1663 - RNA, 20 nt, Artificial Sequence
  Synthetic
cacaccgcccggggagcugg

SEQ ID NO: 1664 - RNA, 20 nt, Artificial Sequence
  Synthetic
acaccgcccggggagcugga

SEQ ID NO: 1665 - RNA, 20 nt, Artificial Sequence
  Synthetic
accgcccggggagcuggacg

SEQ ID NO: 1666 - RNA, 20 nt, Artificial Sequence
  Synthetic
ccgcccggggagcuggacgg

SEQ ID NO: 1667 - RNA, 20 nt, Artificial Sequence
  Synthetic
gggagcuggacggagggauc

SEQ ID NO: 1668 - RNA, 20 nt, Artificial Sequence
  Synthetic
ggagcuggacggagggaucu

SEQ ID NO: 1669 - RNA, 20 nt, Artificial Sequence
  Synthetic
ggaucucggggcgcagcggc

SEQ ID NO: 1670 - RNA, 20 nt, Artificial Sequence
  Synthetic
gaucucggggcgcagcggca

SEQ ID NO: 1671 - RNA, 20 nt, Artificial Sequence
  Synthetic
aucucggggcgcagcggcac

SEQ ID NO: 1672 - RNA, 20 nt, Artificial Sequence
  Synthetic
ggggcgcagcggcacgggaa

SEQ ID NO: 1673 - RNA, 20 nt, Artificial Sequence
  Synthetic
gggcgcagcggcacgggaag

SEQ ID NO: 1674 - RNA, 20 nt, Artificial Sequence
  Synthetic
gcgcagcggcacgggaagug

SEQ ID NO: 1675 - RNA, 20 nt, Artificial Sequence
  Synthetic
cgcagcggcacgggaagugg

SEQ ID NO: 1676 - RNA, 20 nt, Artificial Sequence
  Synthetic
gcagcggcacgggaagugga

SEQ ID NO: 1677 - RNA, 20 nt, Artificial Sequence
  Synthetic
gcacgccccauauuaguggu

SEQ ID NO: 1678 - RNA, 20 nt, Artificial Sequence
  Synthetic
cccauauuagugguccgggc

SEQ ID NO: 1679 - RNA, 20 nt, Artificial Sequence
  Synthetic
cccgggcaggcccagcucaa

SEQ ID NO: 1680 - RNA, 20 nt, Artificial Sequence
  Synthetic
cgggcaggcccagcucaaaa

SEQ ID NO: 1681 - RNA, 17 nt, Artificial Sequence
  Synthetic
uucucuugcaacacgca

SEQ ID NO: 1682 - RNA, 17 nt, Artificial Sequence
  Synthetic
acacgcacagaacacuc

SEQ ID NO: 1683 - RNA, 17 nt, Artificial Sequence
  Synthetic
cagaacacucauggauu

SEQ ID NO: 1684 - RNA, 17 nt, Artificial Sequence
  Synthetic
uggauuaagaaucuacu

SEQ ID NO: 1685 - RNA, 17 nt, Artificial Sequence
  Synthetic
aagaaucuacuuagaaa

SEQ ID NO: 1686 - RNA, 17 nt, Artificial Sequence
  Synthetic
cuacuuagaaagcgaac

SEQ ID NO: 1687 - RNA, 17 nt, Artificial Sequence
  Synthetic
uacuuagaaagcgaaca

SEQ ID NO: 1688 - RNA, 17 nt, Artificial Sequence
  Synthetic
ggaaguccccugacccc

SEQ ID NO: 1689 - RNA, 17 nt, Artificial Sequence
  Synthetic
gcggguugguaucccuu

SEQ ID NO: 1690 - RNA, 17 nt, Artificial Sequence
  Synthetic
cccuucaggacuaggug

SEQ ID NO: 1691 - RNA, 17 nt, Artificial Sequence
  Synthetic
uucccagccaccucucc

SEQ ID NO: 1692 - RNA, 17 nt, Artificial Sequence
  Synthetic
ucccagccaccucucca

SEQ ID NO: 1693 - RNA, 17 nt, Artificial Sequence
  Synthetic
aaccccuuuaaccugcu

SEQ ID NO: 1694 - RNA, 17 nt, Artificial Sequence
  Synthetic
uaaccugcuaagaauac

SEQ ID NO: 1695 - RNA, 17 nt, Artificial Sequence
  Synthetic
gaauaccaggaucagua

SEQ ID NO: 1696 - RNA, 17 nt, Artificial Sequence
  Synthetic
auaccaggaucaguauc

SEQ ID NO: 1697 - RNA, 17 nt, Artificial Sequence
  Synthetic
accaggaucaguaucga

SEQ ID NO: 1698 - RNA, 17 nt, Artificial Sequence
  Synthetic
agaggcuuccggccugg

SEQ ID NO: 1699 - RNA, 17 nt, Artificial Sequence
  Synthetic
ggcuuccggccuggcag

SEQ ID NO: 1700 - RNA, 17 nt, Artificial Sequence
  Synthetic
cccuguuuaguccacca

SEQ ID NO: 1701 - RNA, 17 nt, Artificial Sequence
  Synthetic
caccaccgagacaucac

SEQ ID NO: 1702 - RNA, 17 nt, Artificial Sequence
  Synthetic
cuuggacccccaccgca

SEQ ID NO: 1703 - RNA, 17 nt, Artificial Sequence
  Synthetic
cccaccgcauagagcgc

SEQ ID NO: 1704 - RNA, 17 nt, Artificial Sequence
  Synthetic
ccaccgcauagagcgcc

SEQ ID NO: 1705 - RNA, 17 nt, Artificial Sequence
  Synthetic
caccgcauagagcgccu

SEQ ID NO: 1706 - RNA, 17 nt, Artificial Sequence
  Synthetic
gcauagagcgccugggg

SEQ ID NO: 1707 - RNA, 17 nt, Artificial Sequence
  Synthetic
cauagagcgccuggggg

SEQ ID NO: 1708 - RNA, 17 nt, Artificial Sequence
  Synthetic
agagcgccugggggcgg

SEQ ID NO: 1709 - RNA, 17 nt, Artificial Sequence
  Synthetic
cccuggccacccaucac

SEQ ID NO: 1710 - RNA, 17 nt, Artificial Sequence
  Synthetic
cacccgagugccuuuga

SEQ ID NO: 1711 - RNA, 17 nt, Artificial Sequence
  Synthetic
uugacagggugcugcgg

SEQ ID NO: 1712 - RNA, 17 nt, Artificial Sequence
  Synthetic
gguugaauccaauggcu

SEQ ID NO: 1713 - RNA, 17 nt, Artificial Sequence
  Synthetic
guugaauccaauggcua

SEQ ID NO: 1714 - RNA, 17 nt, Artificial Sequence
  Synthetic
cuauggagccucccgcc

SEQ ID NO: 1715 - RNA, 17 nt, Artificial Sequence
  Synthetic
cccgccauggauuucuc

SEQ ID NO: 1716 - RNA, 17 nt, Artificial Sequence
  Synthetic
ccgccauggauuucucu

SEQ ID NO: 1717 - RNA, 17 nt, Artificial Sequence
  Synthetic
gauuucucuaggagacu

SEQ ID NO: 1718 - RNA, 17 nt, Artificial Sequence
  Synthetic
uuucucuaggagacuua

SEQ ID NO: 1719 - RNA, 17 nt, Artificial Sequence
  Synthetic
gagacuuagagagcugg

SEQ ID NO: 1720 - RNA, 17 nt, Artificial Sequence
  Synthetic
agacuuagagagcuggc

SEQ ID NO: 1721 - RNA, 17 nt, Artificial Sequence
  Synthetic
gacuuagagagcuggca

SEQ ID NO: 1722 - RNA, 17 nt, Artificial Sequence
  Synthetic
ggucaaguccaagucau

SEQ ID NO: 1723 - RNA, 17 nt, Artificial Sequence
  Synthetic
gcaagacguucaaauuu

SEQ ID NO: 1724 - RNA, 17 nt, Artificial Sequence
  Synthetic
ugcaccggcgcagccac

SEQ ID NO: 1725 - RNA, 17 nt, Artificial Sequence
  Synthetic
ccggcgcagccacacgg

SEQ ID NO: 1726 - RNA, 17 nt, Artificial Sequence
  Synthetic
ggcgcagccacacgggc

SEQ ID NO: 1727 - RNA, 17 nt, Artificial Sequence
  Synthetic
gcacccaggccagcaag

SEQ ID NO: 1728 - RNA, 17 nt, Artificial Sequence
  Synthetic
gcaagcugaagcgccac

SEQ ID NO: 1729 - RNA, 17 nt, Artificial Sequence
  Synthetic
ucuccaccgccagcucc

SEQ ID NO: 1730 - RNA, 17 nt, Artificial Sequence
  Synthetic
cuccaccgccagcuccc

SEQ ID NO: 1731 - RNA, 17 nt, Artificial Sequence
  Synthetic
ccggcaccagcgacuug

SEQ ID NO: 1732 - RNA, 17 nt, Artificial Sequence
  Synthetic
ccgugguggccaaguuc

SEQ ID NO: 1733 - RNA, 17 nt, Artificial Sequence
  Synthetic
gguggccaaguucaaga

SEQ ID NO: 1734 - RNA, 17 nt, Artificial Sequence
  Synthetic
uggccaaguucaagagc

SEQ ID NO: 1735 - RNA, 17 nt, Artificial Sequence
  Synthetic
acgaccccaaccugauc

SEQ ID NO: 1736 - RNA, 17 nt, Artificial Sequence
  Synthetic
cgaccccaaccugaucc

SEQ ID NO: 1737 - RNA, 17 nt, Artificial Sequence
  Synthetic
accccaaccugaucccg

SEQ ID NO: 1738 - RNA, 17 nt, Artificial Sequence
  Synthetic
caaccugaucccggaga

SEQ ID NO: 1739 - RNA, 17 nt, Artificial Sequence
  Synthetic
aaccugaucccggagaa

SEQ ID NO: 1740 - RNA, 17 nt, Artificial Sequence
  Synthetic
accugaucccggagaac

SEQ ID NO: 1741 - RNA, 17 nt, Artificial Sequence
  Synthetic
gaucccggagaacgggg

SEQ ID NO: 1742 - RNA, 17 nt, Artificial Sequence
  Synthetic
ucccggagaacggggac

SEQ ID NO: 1743 - RNA, 17 nt, Artificial Sequence
  Synthetic
cccggagaacggggacg

SEQ ID NO: 1744 - RNA, 17 nt, Artificial Sequence
  Synthetic
cggagaacggggacgag

SEQ ID NO: 1745 - RNA, 17 nt, Artificial Sequence
  Synthetic
ggagaacggggacgagg

SEQ ID NO: 1746 - RNA, 17 nt, Artificial Sequence
  Synthetic
gaacggggacgaggagg

SEQ ID NO: 1747 - RNA, 17 nt, Artificial Sequence
  Synthetic
acggggacgaggaggaa

SEQ ID NO: 1748 - RNA, 17 nt, Artificial Sequence
  Synthetic
cggggacgaggaggaag

SEQ ID NO: 1749 - RNA, 17 nt, Artificial Sequence
  Synthetic
gggacgaggaggaagag

SEQ ID NO: 1750 - RNA, 17 nt, Artificial Sequence
  Synthetic
ggaggaagaggaggacg

SEQ ID NO: 1751 - RNA, 17 nt, Artificial Sequence
  Synthetic
aggaagaggaggacgac

SEQ ID NO: 1752 - RNA, 17 nt, Artificial Sequence
  Synthetic
ggaagaggaggacgacg

SEQ ID NO: 1753 - RNA, 17 nt, Artificial Sequence
  Synthetic
agaggaggacgacgagg

SEQ ID NO: 1754 - RNA, 17 nt, Artificial Sequence
  Synthetic
aggaggacgacgaggaa

SEQ ID NO: 1755 - RNA, 17 nt, Artificial Sequence
  Synthetic
ggaggacgacgaggaag

SEQ ID NO: 1756 - RNA, 17 nt, Artificial Sequence
  Synthetic
ggacgacgaggaagagg

SEQ ID NO: 1757 - RNA, 17 nt, Artificial Sequence
  Synthetic
cgacgaggaagaggaag

SEQ ID NO: 1758 - RNA, 17 nt, Artificial Sequence
  Synthetic
acgaggaagaggaagaa

SEQ ID NO: 1759 - RNA, 17 nt, Artificial Sequence
  Synthetic
cgaggaagaggaagaag

SEQ ID NO: 1760 - RNA, 17 nt, Artificial Sequence
  Synthetic
aggaagaggaagaagag

SEQ ID NO: 1761 - RNA, 17 nt, Artificial Sequence
  Synthetic
ggaagaggaagaagagg

SEQ ID NO: 1762 - RNA, 17 nt, Artificial Sequence
  Synthetic
agaggaagaagaggagg

SEQ ID NO: 1763 - RNA, 17 nt, Artificial Sequence
  Synthetic
aggaagaagaggaggaa

SEQ ID NO: 1764 - RNA, 17 nt, Artificial Sequence
  Synthetic
ggaagaagaggaggaag

SEQ ID NO: 1765 - RNA, 17 nt, Artificial Sequence
  Synthetic
aagaagaggaggaagag

SEQ ID NO: 1766 - RNA, 17 nt, Artificial Sequence
  Synthetic
agaagaggaggaagagg

SEQ ID NO: 1767 - RNA, 17 nt, Artificial Sequence
  Synthetic
aagaggaggaagaggag

SEQ ID NO: 1768 - RNA, 17 nt, Artificial Sequence
  Synthetic
agaggaggaagaggagg

SEQ ID NO: 1769 - RNA, 17 nt, Artificial Sequence
  Synthetic
aggaggaagaggaggag

SEQ ID NO: 1770 - RNA, 17 nt, Artificial Sequence
  Synthetic
ggaggaagaggaggagg

SEQ ID NO: 1771 - RNA, 17 nt, Artificial Sequence
  Synthetic
aggaggaggaggagcug

SEQ ID NO: 1772 - RNA, 17 nt, Artificial Sequence
  Synthetic
ggaggaggaggagcuga

SEQ ID NO: 1773 - RNA, 17 nt, Artificial Sequence
  Synthetic
aggaggaggagcugacg

SEQ ID NO: 1774 - RNA, 17 nt, Artificial Sequence
  Synthetic
ggaggagcugacggaga

SEQ ID NO: 1775 - RNA, 17 nt, Artificial Sequence
  Synthetic
aggagcugacggagagc

SEQ ID NO: 1776 - RNA, 17 nt, Artificial Sequence
  Synthetic
gagcugacggagagcga

SEQ ID NO: 1777 - RNA, 17 nt, Artificial Sequence
  Synthetic
ugacggagagcgagagg

SEQ ID NO: 1778 - RNA, 17 nt, Artificial Sequence
  Synthetic
gaggguggacuacggcu

SEQ ID NO: 1779 - RNA, 17 nt, Artificial Sequence
  Synthetic
uggacuacggcuucggg

SEQ ID NO: 1780 - RNA, 17 nt, Artificial Sequence
  Synthetic
acggcuucgggcugagc

SEQ ID NO: 1781 - RNA, 17 nt, Artificial Sequence
  Synthetic
cggcuucgggcugagcc

SEQ ID NO: 1782 - RNA, 17 nt, Artificial Sequence
  Synthetic
ggaggcggcgcgccacc

SEQ ID NO: 1783 - RNA, 17 nt, Artificial Sequence
  Synthetic
aggcggcgcgccaccac

SEQ ID NO: 1784 - RNA, 17 nt, Artificial Sequence
  Synthetic
caccacgagaacagcuc

SEQ ID NO: 1785 - RNA, 17 nt, Artificial Sequence
  Synthetic
accacgagaacagcucg

SEQ ID NO: 1786 - RNA, 17 nt, Artificial Sequence
  Synthetic
gcucgcggggcgcgguc

SEQ ID NO: 1787 - RNA, 17 nt, Artificial Sequence
  Synthetic
ggggcgcggucgugggc

SEQ ID NO: 1788 - RNA, 17 nt, Artificial Sequence
  Synthetic
ggucgugggcgugggcg

SEQ ID NO: 1789 - RNA, 17 nt, Artificial Sequence
  Synthetic
ucgugggcgugggcgac

SEQ ID NO: 1790 - RNA, 17 nt, Artificial Sequence
  Synthetic
cccugcccgacgucaug

SEQ ID NO: 1791 - RNA, 17 nt, Artificial Sequence
  Synthetic
cuccaugcagcacuuca

SEQ ID NO: 1792 - RNA, 17 nt, Artificial Sequence
  Synthetic
aggccuuccaccagguc

SEQ ID NO: 1793 - RNA, 17 nt, Artificial Sequence
  Synthetic
cuuccaccagguccugg

SEQ ID NO: 1794 - RNA, 17 nt, Artificial Sequence
  Synthetic
uccaccagguccugggc

SEQ ID NO: 1795 - RNA, 17 nt, Artificial Sequence
  Synthetic
uaagcgcggccaccugg

SEQ ID NO: 1796 - RNA, 17 nt, Artificial Sequence
  Synthetic
cggccaccuggccgagg

SEQ ID NO: 1797 - RNA, 17 nt, Artificial Sequence
  Synthetic
gccaccuggccgaggcc

SEQ ID NO: 1798 - RNA, 17 nt, Artificial Sequence
  Synthetic
gccgaggccgagggcca

SEQ ID NO: 1799 - RNA, 17 nt, Artificial Sequence
  Synthetic
ccgaggccgagggccac

SEQ ID NO: 1800 - RNA, 17 nt, Artificial Sequence
  Synthetic
ccacagggacacuugcg

SEQ ID NO: 1801 - RNA, 17 nt, Artificial Sequence
  Synthetic
cgaagacucgguggccg

SEQ ID NO: 1802 - RNA, 17 nt, Artificial Sequence
  Synthetic
acucgguggccggcgag

SEQ ID NO: 1803 - RNA, 17 nt, Artificial Sequence
  Synthetic
auggccgcggcugcucc

SEQ ID NO: 1804 - RNA, 17 nt, Artificial Sequence
  Synthetic
ccgcggcugcuccccgg

SEQ ID NO: 1805 - RNA, 17 nt, Artificial Sequence
  Synthetic
ccccgggcgagucggcc

SEQ ID NO: 1806 - RNA, 17 nt, Artificial Sequence
  Synthetic
cccgggcgagucggccu

SEQ ID NO: 1807 - RNA, 17 nt, Artificial Sequence
  Synthetic
ccgggcgagucggccuc

SEQ ID NO: 1808 - RNA, 17 nt, Artificial Sequence
  Synthetic
cgggcgagucggccucg

SEQ ID NO: 1809 - RNA, 17 nt, Artificial Sequence
  Synthetic
uguccaaaaagcugcug

SEQ ID NO: 1810 - RNA, 17 nt, Artificial Sequence
  Synthetic
ugggcagccccagcucg

SEQ ID NO: 1811 - RNA, 17 nt, Artificial Sequence
  Synthetic
cucuaagcgcaucaagc

SEQ ID NO: 1812 - RNA, 17 nt, Artificial Sequence
  Synthetic
cuaagcgcaucaagcuc

SEQ ID NO: 1813 - RNA, 17 nt, Artificial Sequence
  Synthetic
agcgcaucaagcucgag

SEQ ID NO: 1814 - RNA, 17 nt, Artificial Sequence
  Synthetic
gcgcaucaagcucgaga

SEQ ID NO: 1815 - RNA, 17 nt, Artificial Sequence
  Synthetic
cggccgcgaugcccaac

SEQ ID NO: 1816 - RNA, 17 nt, Artificial Sequence
  Synthetic
ggccgcgaugcccaaca

SEQ ID NO: 1817 - RNA, 17 nt, Artificial Sequence
  Synthetic
ccgcgaugcccaacacg

SEQ ID NO: 1818 - RNA, 17 nt, Artificial Sequence
  Synthetic
agaucccuuccuuagcu

SEQ ID NO: 1819 - RNA, 17 nt, Artificial Sequence
  Synthetic
gaucccuuccuuagcuu

SEQ ID NO: 1820 - RNA, 17 nt, Artificial Sequence
  Synthetic
cgccuuuugccuccucg

SEQ ID NO: 1821 - RNA, 17 nt, Artificial Sequence
  Synthetic
gccuuuugccuccucgu

SEQ ID NO: 1822 - RNA, 17 nt, Artificial Sequence
  Synthetic
ccucgucggagcacucc

SEQ ID NO: 1823 - RNA, 17 nt, Artificial Sequence
  Synthetic
cucgucggagcacuccu

SEQ ID NO: 1824 - RNA, 17 nt, Artificial Sequence
  Synthetic
cgucggagcacuccucg

SEQ ID NO: 1825 - RNA, 17 nt, Artificial Sequence
  Synthetic
ggagcacuccucggaga

SEQ ID NO: 1826 - RNA, 17 nt, Artificial Sequence
  Synthetic
gagcacuccucggagaa

SEQ ID NO: 1827 - RNA, 17 nt, Artificial Sequence
  Synthetic
agcacuccucggagaac

SEQ ID NO: 1828 - RNA, 17 nt, Artificial Sequence
  Synthetic
gcgcuucuccacaccgc

SEQ ID NO: 1829 - RNA, 17 nt, Artificial Sequence
  Synthetic
cgcuucuccacaccgcc

SEQ ID NO: 1830 - RNA, 17 nt, Artificial Sequence
  Synthetic
gcuucuccacaccgccc

SEQ ID NO: 1831 - RNA, 17 nt, Artificial Sequence
  Synthetic
cuucuccacaccgcccg

SEQ ID NO: 1832 - RNA, 17 nt, Artificial Sequence
  Synthetic
ccacaccgcccggggag

SEQ ID NO: 1833 - RNA, 17 nt, Artificial Sequence
  Synthetic
accgcccggggagcugg

SEQ ID NO: 1834 - RNA, 17 nt, Artificial Sequence
  Synthetic
ccgcccggggagcugga

SEQ ID NO: 1835 - RNA, 17 nt, Artificial Sequence
  Synthetic
gcccggggagcuggacg

SEQ ID NO: 1836 - RNA, 17 nt, Artificial Sequence
  Synthetic
cccggggagcuggacgg

SEQ ID NO: 1837 - RNA, 17 nt, Artificial Sequence
  Synthetic
agcuggacggagggauc

SEQ ID NO: 1838 - RNA, 17 nt, Artificial Sequence
  Synthetic
gcuggacggagggaucu

SEQ ID NO: 1839 - RNA, 17 nt, Artificial Sequence
  Synthetic
ucucggggcgcagcggc

SEQ ID NO: 1840 - RNA, 17 nt, Artificial Sequence
  Synthetic
cucggggcgcagcggca

SEQ ID NO: 1841 - RNA, 17 nt, Artificial Sequence
  Synthetic
ucggggcgcagcggcac

SEQ ID NO: 1842 - RNA, 17 nt, Artificial Sequence
  Synthetic
gcgcagcggcacgggaa

SEQ ID NO: 1843 - RNA, 17 nt, Artificial Sequence
  Synthetic
cgcagcggcacgggaag

SEQ ID NO: 1844 - RNA, 17 nt, Artificial Sequence
  Synthetic
cagcggcacgggaagug

SEQ ID NO: 1845 - RNA, 17 nt, Artificial Sequence
  Synthetic
agcggcacgggaagugg

SEQ ID NO: 1846 - RNA, 17 nt, Artificial Sequence
  Synthetic
gcggcacgggaagugga

SEQ ID NO: 1847 - RNA, 17 nt, Artificial Sequence
  Synthetic
cgccccauauuaguggu

SEQ ID NO: 1848 - RNA, 17 nt, Artificial Sequence
  Synthetic
auauuagugguccgggc

SEQ ID NO: 1849 - RNA, 17 nt, Artificial Sequence
  Synthetic
gggcaggcccagcucaa

SEQ ID NO: 1850 - RNA, 17 nt, Artificial Sequence
  Synthetic
gcaggcccagcucaaaa

SEQ ID NO: 1851 - RNA, 20 nt, Artificial Sequence
  Synthetic
aaguuguacauguguagcug

SEQ ID NO: 1852 - RNA, 20 nt, Artificial Sequence
  Synthetic
gcaagagaaaccaugcacug

SEQ ID NO: 1853 - RNA, 20 nt, Artificial Sequence
  Synthetic
guguucugugcguguugcaa

SEQ ID NO: 1854 - RNA, 20 nt, Artificial Sequence
  Synthetic
gaguguucugugcguguugc

SEQ ID NO: 1855 - RNA, 20 nt, Artificial Sequence
  Synthetic
ucuaaguagauucuuaaucc

SEQ ID NO: 1856 - RNA, 20 nt, Artificial Sequence
  Synthetic
gauaccaacccgcgggguca

SEQ ID NO: 1857 - RNA, 20 nt, Artificial Sequence
  Synthetic
ggauaccaacccgcgggguc

SEQ ID NO: 1858 - RNA, 20 nt, Artificial Sequence
  Synthetic
gggauaccaacccgcggggu

SEQ ID NO: 1859 - RNA, 20 nt, Artificial Sequence
  Synthetic
ccugaagggauaccaacccg

SEQ ID NO: 1860 - RNA, 20 nt, Artificial Sequence
  Synthetic
uccugaagggauaccaaccc

SEQ ID NO: 1861 - RNA, 20 nt, Artificial Sequence
  Synthetic
cauucugcaccuaguccuga

SEQ ID NO: 1862 - RNA, 20 nt, Artificial Sequence
  Synthetic
acauucugcaccuaguccug

SEQ ID NO: 1863 - RNA, 20 nt, Artificial Sequence
  Synthetic
aggacauucugcaccuaguc

SEQ ID NO: 1864 - RNA, 20 nt, Artificial Sequence
  Synthetic
cccauggagagguggcuggg

SEQ ID NO: 1865 - RNA, 20 nt, Artificial Sequence
  Synthetic
aaucccauggagagguggcu

SEQ ID NO: 1866 - RNA, 20 nt, Artificial Sequence
  Synthetic
gaaucccauggagagguggc

SEQ ID NO: 1867 - RNA, 20 nt, Artificial Sequence
  Synthetic
ugaaucccauggagaggugg

SEQ ID NO: 1868 - RNA, 20 nt, Artificial Sequence
  Synthetic
ucugcaauaugaaucccaug

SEQ ID NO: 1869 - RNA, 20 nt, Artificial Sequence
  Synthetic
ugucugcaauaugaauccca

SEQ ID NO: 1870 - RNA, 20 nt, Artificial Sequence
  Synthetic
uugucugcaauaugaauccc

SEQ ID NO: 1871 - RNA, 20 nt, Artificial Sequence
  Synthetic
aagggguuauugucugcaau

SEQ ID NO: 1872 - RNA, 20 nt, Artificial Sequence
  Synthetic
ugguauucuuagcagguuaa

SEQ ID NO: 1873 - RNA, 20 nt, Artificial Sequence
  Synthetic
cugguauucuuagcagguua

SEQ ID NO: 1874 - RNA, 20 nt, Artificial Sequence
  Synthetic
aaagcgcccuucugccaggc

SEQ ID NO: 1875 - RNA, 20 nt, Artificial Sequence
  Synthetic
gaaagcgcccuucugccagg

SEQ ID NO: 1876 - RNA, 20 nt, Artificial Sequence
  Synthetic
cuaaacagggggggaguggg

SEQ ID NO: 1877 - RNA, 20 nt, Artificial Sequence
  Synthetic
acuaaacagggggggagugg

SEQ ID NO: 1878 - RNA, 20 nt, Artificial Sequence
  Synthetic
guggacuaaacaggggggga

SEQ ID NO: 1879 - RNA, 20 nt, Artificial Sequence
  Synthetic
ggugguggacuaaacagggg

SEQ ID NO: 1880 - RNA, 20 nt, Artificial Sequence
  Synthetic
cggugguggacuaaacaggg

SEQ ID NO: 1881 - RNA, 20 nt, Artificial Sequence
  Synthetic
ucggugguggacuaaacagg

SEQ ID NO: 1882 - RNA, 20 nt, Artificial Sequence
  Synthetic
cucggugguggacuaaacag

SEQ ID NO: 1883 - RNA, 20 nt, Artificial Sequence
  Synthetic
ucucggugguggacuaaaca

SEQ ID NO: 1884 - RNA, 20 nt, Artificial Sequence
  Synthetic
gucucggugguggacuaaac

SEQ ID NO: 1885 - RNA, 20 nt, Artificial Sequence
  Synthetic
ugucucggugguggacuaaa

SEQ ID NO: 1886 - RNA, 20 nt, Artificial Sequence
  Synthetic
guccaagugaugucucggug

SEQ ID NO: 1887 - RNA, 20 nt, Artificial Sequence
  Synthetic
ccccaggcgcucuaugcggu

SEQ ID NO: 1888 - RNA, 20 nt, Artificial Sequence
  Synthetic
cccccaggcgcucuaugcgg

SEQ ID NO: 1889 - RNA, 20 nt, Artificial Sequence
  Synthetic
gcccccaggcgcucuaugcg

SEQ ID NO: 1890 - RNA, 20 nt, Artificial Sequence
  Synthetic
gcacucgggugauggguggc

SEQ ID NO: 1891 - RNA, 20 nt, Artificial Sequence
  Synthetic
cugucaaaggcacucgggug

SEQ ID NO: 1892 - RNA, 20 nt, Artificial Sequence
  Synthetic
cagcacccugucaaaggcac

SEQ ID NO: 1893 - RNA, 20 nt, Artificial Sequence
  Synthetic
ggcgggaggcuccauagcca

SEQ ID NO: 1894 - RNA, 20 nt, Artificial Sequence
  Synthetic
cuccuagagaaauccauggc

SEQ ID NO: 1895 - RNA, 20 nt, Artificial Sequence
  Synthetic
ucuccuagagaaauccaugg

SEQ ID NO: 1896 - RNA, 20 nt, Artificial Sequence
  Synthetic
gucuccuagagaaauccaug

SEQ ID NO: 1897 - RNA, 20 nt, Artificial Sequence
  Synthetic
ccagcucucuaagucuccua

SEQ ID NO: 1898 - RNA, 20 nt, Artificial Sequence
  Synthetic
ugccagcucucuaagucucc

SEQ ID NO: 1899 - RNA, 20 nt, Artificial Sequence
  Synthetic
gggccggccuggggacagcg

SEQ ID NO: 1900 - RNA, 20 nt, Artificial Sequence
  Synthetic
gcauagggcugggccggccu

SEQ ID NO: 1901 - RNA, 20 nt, Artificial Sequence
  Synthetic
ugcauagggcugggccggcc

SEQ ID NO: 1902 - RNA, 20 nt, Artificial Sequence
  Synthetic
uugcauagggcugggccggc

SEQ ID NO: 1903 - RNA, 20 nt, Artificial Sequence
  Synthetic
gcaguaaccuuugcauaggg

SEQ ID NO: 1904 - RNA, 20 nt, Artificial Sequence
  Synthetic
ugguugcaguaaccuuugca

SEQ ID NO: 1905 - RNA, 20 nt, Artificial Sequence
  Synthetic
agggcggcuugcuaccuggc

SEQ ID NO: 1906 - RNA, 20 nt, Artificial Sequence
  Synthetic
aagggcggcuugcuaccugg

SEQ ID NO: 1907 - RNA, 20 nt, Artificial Sequence
  Synthetic
ggagggggggcgucgccagg

SEQ ID NO: 1908 - RNA, 20 nt, Artificial Sequence
  Synthetic
gagggagggggggcgucgcc

SEQ ID NO: 1909 - RNA, 20 nt, Artificial Sequence
  Synthetic
ggagggagggggggcgucgc

SEQ ID NO: 1910 - RNA, 20 nt, Artificial Sequence
  Synthetic
cggauugcagaggagggagg

SEQ ID NO: 1911 - RNA, 20 nt, Artificial Sequence
  Synthetic
gcggauugcagaggagggag

SEQ ID NO: 1912 - RNA, 20 nt, Artificial Sequence
  Synthetic
ggcggauugcagaggaggga

SEQ ID NO: 1913 - RNA, 20 nt, Artificial Sequence
  Synthetic
gggcggauugcagaggaggg

SEQ ID NO: 1914 - RNA, 20 nt, Artificial Sequence
  Synthetic
ggggcggauugcagaggagg

SEQ ID NO: 1915 - RNA, 20 nt, Artificial Sequence
  Synthetic
gaggggcggauugcagagga

SEQ ID NO: 1916 - RNA, 20 nt, Artificial Sequence
  Synthetic
ggaggggcggauugcagagg

SEQ ID NO: 1917 - RNA, 20 nt, Artificial Sequence
  Synthetic
aggaggggcggauugcagag

SEQ ID NO: 1918 - RNA, 20 nt, Artificial Sequence
  Synthetic
ggaggaggggcggauugcag

SEQ ID NO: 1919 - RNA, 20 nt, Artificial Sequence
  Synthetic
gggaggaggggcggauugca

SEQ ID NO: 1920 - RNA, 20 nt, Artificial Sequence
  Synthetic
gagggaggaggggcggauug

SEQ ID NO: 1921 - RNA, 20 nt, Artificial Sequence
  Synthetic
ggggcugggagggaggaggg

SEQ ID NO: 1922 - RNA, 20 nt, Artificial Sequence
  Synthetic
accgggggcugggagggagg

SEQ ID NO: 1923 - RNA, 20 nt, Artificial Sequence
  Synthetic
gaccgggggcugggagggag

SEQ ID NO: 1924 - RNA, 20 nt, Artificial Sequence
  Synthetic
uugaccgggggcugggaggg

SEQ ID NO: 1925 - RNA, 20 nt, Artificial Sequence
  Synthetic
cuugaccgggggcugggagg

SEQ ID NO: 1926 - RNA, 20 nt, Artificial Sequence
  Synthetic
gacuugaccgggggcuggga

SEQ ID NO: 1927 - RNA, 20 nt, Artificial Sequence
  Synthetic
ggacuugaccgggggcuggg

SEQ ID NO: 1928 - RNA, 20 nt, Artificial Sequence
  Synthetic
uggacuugaccgggggcugg

SEQ ID NO: 1929 - RNA, 20 nt, Artificial Sequence
  Synthetic
cuuggacuugaccgggggcu

SEQ ID NO: 1930 - RNA, 20 nt, Artificial Sequence
  Synthetic
acuuggacuugaccgggggc

SEQ ID NO: 1931 - RNA, 20 nt, Artificial Sequence
  Synthetic
gacuuggacuugaccggggg

SEQ ID NO: 1932 - RNA, 20 nt, Artificial Sequence
  Synthetic
cgcaugacuuggacuugacc

SEQ ID NO: 1933 - RNA, 20 nt, Artificial Sequence
  Synthetic
ucgcaugacuuggacuugac

SEQ ID NO: 1934 - RNA, 20 nt, Artificial Sequence
  Synthetic
cucgcaugacuuggacuuga

SEQ ID NO: 1935 - RNA, 20 nt, Artificial Sequence
  Synthetic
ugccgcagaacucgcaugac

SEQ ID NO: 1936 - RNA, 20 nt, Artificial Sequence
  Synthetic
gaaauuugaacgucuugccg

SEQ ID NO: 1937 - RNA, 20 nt, Artificial Sequence
  Synthetic
ccaccagguugcucugaaau

SEQ ID NO: 1938 - RNA, 20 nt, Artificial Sequence
  Synthetic
cggugcaccaccagguugcu

SEQ ID NO: 1939 - RNA, 20 nt, Artificial Sequence
  Synthetic
ggucgcacagguugcacuug

SEQ ID NO: 1940 - RNA, 20 nt, Artificial Sequence
  Synthetic
uggcgcuucagcuugcuggc

SEQ ID NO: 1941 - RNA, 20 nt, Artificial Sequence
  Synthetic
cgucggacuugaccgucaug

SEQ ID NO: 1942 - RNA, 20 nt, Artificial Sequence
  Synthetic
ucgucggacuugaccgucau

SEQ ID NO: 1943 - RNA, 20 nt, Artificial Sequence
  Synthetic
gucgucggacuugaccguca

SEQ ID NO: 1944 - RNA, 20 nt, Artificial Sequence
  Synthetic
cgucgucggacuugaccguc

SEQ ID NO: 1945 - RNA, 20 nt, Artificial Sequence
  Synthetic
uggcgguggagagaccgucg

SEQ ID NO: 1946 - RNA, 20 nt, Artificial Sequence
  Synthetic
guuccggggagcuggcggug

SEQ ID NO: 1947 - RNA, 20 nt, Artificial Sequence
  Synthetic
ggguuccggggagcuggcgg

SEQ ID NO: 1948 - RNA, 20 nt, Artificial Sequence
  Synthetic
cggguuccggggagcuggcg

SEQ ID NO: 1949 - RNA, 20 nt, Artificial Sequence
  Synthetic
gucgcuggugccggguuccg

SEQ ID NO: 1950 - RNA, 20 nt, Artificial Sequence
  Synthetic
agucgcuggugccggguucc

SEQ ID NO: 1951 - RNA, 20 nt, Artificial Sequence
  Synthetic
aagucgcuggugccggguuc

SEQ ID NO: 1952 - RNA, 20 nt, Artificial Sequence
  Synthetic
caagucgcuggugccggguu

SEQ ID NO: 1953 - RNA, 20 nt, Artificial Sequence
  Synthetic
ugcccaccaagucgcuggug

SEQ ID NO: 1954 - RNA, 20 nt, Artificial Sequence
  Synthetic
ugaacuuggccaccacggac

SEQ ID NO: 1955 - RNA, 20 nt, Artificial Sequence
  Synthetic
cgcucuugaacuuggccacc

SEQ ID NO: 1956 - RNA, 20 nt, Artificial Sequence
  Synthetic
gguuggggucguucucgcuc

SEQ ID NO: 1957 - RNA, 20 nt, Artificial Sequence
  Synthetic
cccguucuccgggaucaggu

SEQ ID NO: 1958 - RNA, 20 nt, Artificial Sequence
  Synthetic
ccccguucuccgggaucagg

SEQ ID NO: 1959 - RNA, 20 nt, Artificial Sequence
  Synthetic
uccuccucguccccguucuc

SEQ ID NO: 1960 - RNA, 20 nt, Artificial Sequence
  Synthetic
uuccuccucguccccguucu

SEQ ID NO: 1961 - RNA, 20 nt, Artificial Sequence
  Synthetic
gcgccgccuccaggcucagc

SEQ ID NO: 1962 - RNA, 20 nt, Artificial Sequence
  Synthetic
cacgcccacgaccgcgcccc

SEQ ID NO: 1963 - RNA, 20 nt, Artificial Sequence
  Synthetic
augcccugcaugacgucggg

SEQ ID NO: 1964 - RNA, 20 nt, Artificial Sequence
  Synthetic
gcaccaugcccugcaugacg

SEQ ID NO: 1965 - RNA, 20 nt, Artificial Sequence
  Synthetic
cgcugaagugcugcauggag

SEQ ID NO: 1966 - RNA, 20 nt, Artificial Sequence
  Synthetic
ggccucgcugaagugcugca

SEQ ID NO: 1967 - RNA, 20 nt, Artificial Sequence
  Synthetic
aggccucgcugaagugcugc

SEQ ID NO: 1968 - RNA, 20 nt, Artificial Sequence
  Synthetic
ggaccugguggaaggccucg

SEQ ID NO: 1969 - RNA, 20 nt, Artificial Sequence
  Synthetic
gcuucucgcccaggaccugg

SEQ ID NO: 1970 - RNA, 20 nt, Artificial Sequence
  Synthetic
ugcuucucgcccaggaccug

SEQ ID NO: 1971 - RNA, 20 nt, Artificial Sequence
  Synthetic
ccgcgcuuaugcuucucgcc

SEQ ID NO: 1972 - RNA, 20 nt, Artificial Sequence
  Synthetic
gcgguccgacucgccggcca

SEQ ID NO: 1973 - RNA, 20 nt, Artificial Sequence
  Synthetic
ccccgaggccgacucgcccg

SEQ ID NO: 1974 - RNA, 20 nt, Artificial Sequence
  Synthetic
cccccgaggccgacucgccc

SEQ ID NO: 1975 - RNA, 20 nt, Artificial Sequence
  Synthetic
ccccccgaggccgacucgcc

SEQ ID NO: 1976 - RNA, 20 nt, Artificial Sequence
  Synthetic
gccccccgaggccgacucgc

SEQ ID NO: 1977 - RNA, 20 nt, Artificial Sequence
  Synthetic
cagcuuuuuggacaggcccc

SEQ ID NO: 1978 - RNA, 20 nt, Artificial Sequence
  Synthetic
ggcugcccagcagcagcuuu

SEQ ID NO: 1979 - RNA, 20 nt, Artificial Sequence
  Synthetic
agagaaggggcucagcgagc

SEQ ID NO: 1980 - RNA, 20 nt, Artificial Sequence
  Synthetic
uagagaaggggcucagcgag

SEQ ID NO: 1981 - RNA, 20 nt, Artificial Sequence
  Synthetic
gcgcuuagagaaggggcuca

SEQ ID NO: 1982 - RNA, 20 nt, Artificial Sequence
  Synthetic
gagcuugaugcgcuuagaga

SEQ ID NO: 1983 - RNA, 20 nt, Artificial Sequence
  Synthetic
cgagcuugaugcgcuuagag

SEQ ID NO: 1984 - RNA, 20 nt, Artificial Sequence
  Synthetic
ucucgagcuugaugcgcuua

SEQ ID NO: 1985 - RNA, 20 nt, Artificial Sequence
  Synthetic
cuucucgagcuugaugcgcu

SEQ ID NO: 1986 - RNA, 20 nt, Artificial Sequence
  Synthetic
ggggcaggucgaacuccuuc

SEQ ID NO: 1987 - RNA, 20 nt, Artificial Sequence
  Synthetic
gcaucgcggccgggggcagg

SEQ ID NO: 1988 - RNA, 20 nt, Artificial Sequence
  Synthetic
ccguguugggcaucgcggcc

SEQ ID NO: 1989 - RNA, 20 nt, Artificial Sequence
  Synthetic
uccguguugggcaucgcggc

SEQ ID NO: 1990 - RNA, 20 nt, Artificial Sequence
  Synthetic
cuccguguugggcaucgcgg

SEQ ID NO: 1991 - RNA, 20 nt, Artificial Sequence
  Synthetic
gcgaguacacguucuccgug

SEQ ID NO: 1992 - RNA, 20 nt, Artificial Sequence
  Synthetic
cgcguagccggcgagccacu

SEQ ID NO: 1993 - RNA, 20 nt, Artificial Sequence
  Synthetic
gccuggaggccgcguagccg

SEQ ID NO: 1994 - RNA, 20 nt, Artificial Sequence
  Synthetic
gaagggaucuuugagcugcc

SEQ ID NO: 1995 - RNA, 20 nt, Artificial Sequence
  Synthetic
ggaagggaucuuugagcugc

SEQ ID NO: 1996 - RNA, 20 nt, Artificial Sequence
  Synthetic
cgaagcuaaggaagggaucu

SEQ ID NO: 1997 - RNA, 20 nt, Artificial Sequence
  Synthetic
ggagucuccgaagcuaagga

SEQ ID NO: 1998 - RNA, 20 nt, Artificial Sequence
  Synthetic
uggagucuccgaagcuaagg

SEQ ID NO: 1999 - RNA, 20 nt, Artificial Sequence
  Synthetic
gucuggagucuccgaagcua

SEQ ID NO: 2000 - RNA, 20 nt, Artificial Sequence
  Synthetic
ugucuggagucuccgaagcu

SEQ ID NO: 2001 - RNA, 20 nt, Artificial Sequence
  Synthetic
aaggcgauugucuggagucu

SEQ ID NO: 2002 - RNA, 20 nt, Artificial Sequence
  Synthetic
ggaggcaaaaggcgauuguc

SEQ ID NO: 2003 - RNA, 20 nt, Artificial Sequence
  Synthetic
aggaggcaaaaggcgauugu

SEQ ID NO: 2004 - RNA, 20 nt, Artificial Sequence
  Synthetic
cuccgaggagugcuccgacg

SEQ ID NO: 2005 - RNA, 20 nt, Artificial Sequence
  Synthetic
ucuccgaggagugcuccgac

SEQ ID NO: 2006 - RNA, 20 nt, Artificial Sequence
  Synthetic
guucuccgaggagugcuccg

SEQ ID NO: 2007 - RNA, 20 nt, Artificial Sequence
  Synthetic
gcgcaaacucccguucuccg

SEQ ID NO: 2008 - RNA, 20 nt, Artificial Sequence
  Synthetic
agcgcaaacucccguucucc

SEQ ID NO: 2009 - RNA, 20 nt, Artificial Sequence
  Synthetic
gaagcgcaaacucccguucu

SEQ ID NO: 2010 - RNA, 20 nt, Artificial Sequence
  Synthetic
ccagcuccccgggcggugug

SEQ ID NO: 2011 - RNA, 20 nt, Artificial Sequence
  Synthetic
guccagcuccccgggcggug

SEQ ID NO: 2012 - RNA, 20 nt, Artificial Sequence
  Synthetic
cguccagcuccccgggcggu

SEQ ID NO: 2013 - RNA, 20 nt, Artificial Sequence
  Synthetic
agaucccuccguccagcucc

SEQ ID NO: 2014 - RNA, 20 nt, Artificial Sequence
  Synthetic
acuucccgugccgcugcgcc

SEQ ID NO: 2015 - RNA, 20 nt, Artificial Sequence
  Synthetic
ccgggcccggaccacuaaua

SEQ ID NO: 2016 - RNA, 20 nt, Artificial Sequence
  Synthetic
cccgggcccggaccacuaau

SEQ ID NO: 2017 - RNA, 20 nt, Artificial Sequence
  Synthetic
ugagcugggccugcccgggc

SEQ ID NO: 2018 - RNA, 20 nt, Artificial Sequence
  Synthetic
cucuuuugagcugggccugc

SEQ ID NO: 2019 - RNA, 20 nt, Artificial Sequence
  Synthetic
ugcgucugcccucuuuugag

SEQ ID NO: 2020 - RNA, 20 nt, Artificial Sequence
  Synthetic
gucgcugcgucugcccucuu

SEQ ID NO: 2021 - RNA, 17 nt, Artificial Sequence
  Synthetic
uuguacauguguagcug

SEQ ID NO: 2022 - RNA, 17 nt, Artificial Sequence
  Synthetic
agagaaaccaugcacug

SEQ ID NO: 2023 - RNA, 17 nt, Artificial Sequence
  Synthetic
uucugugcguguugcaa

SEQ ID NO: 2024 - RNA, 17 nt, Artificial Sequence
  Synthetic
uguucugugcguguugc

SEQ ID NO: 2025 - RNA, 17 nt, Artificial Sequence
  Synthetic
aaguagauucuuaaucc

SEQ ID NO: 2026 - RNA, 17 nt, Artificial Sequence
  Synthetic
accaacccgcgggguca

SEQ ID NO: 2027 - RNA, 17 nt, Artificial Sequence
  Synthetic
uaccaacccgcgggguc

SEQ ID NO: 2028 - RNA, 17 nt, Artificial Sequence
  Synthetic
auaccaacccgcggggu

SEQ ID NO: 2029 - RNA, 17 nt, Artificial Sequence
  Synthetic
gaagggauaccaacccg

SEQ ID NO: 2030 - RNA, 17 nt, Artificial Sequence
  Synthetic
ugaagggauaccaaccc

SEQ ID NO: 2031 - RNA, 17 nt, Artificial Sequence
  Synthetic
ucugcaccuaguccuga

SEQ ID NO: 2032 - RNA, 17 nt, Artificial Sequence
  Synthetic
uucugcaccuaguccug

SEQ ID NO: 2033 - RNA, 17 nt, Artificial Sequence
  Synthetic
acauucugcaccuaguc

SEQ ID NO: 2034 - RNA, 17 nt, Artificial Sequence
  Synthetic
auggagagguggcuggg

SEQ ID NO: 2035 - RNA, 17 nt, Artificial Sequence
  Synthetic
cccauggagagguggcu

SEQ ID NO: 2036 - RNA, 17 nt, Artificial Sequence
  Synthetic
ucccauggagagguggc

SEQ ID NO: 2037 - RNA, 17 nt, Artificial Sequence
  Synthetic
aucccauggagaggugg

SEQ ID NO: 2038 - RNA, 17 nt, Artificial Sequence
  Synthetic
gcaauaugaaucccaug

SEQ ID NO: 2039 - RNA, 17 nt, Artificial Sequence
  Synthetic
cugcaauaugaauccca

SEQ ID NO: 2040 - RNA, 17 nt, Artificial Sequence
  Synthetic
ucugcaauaugaauccc

SEQ ID NO: 2041 - RNA, 17 nt, Artificial Sequence
  Synthetic
ggguuauugucugcaau

SEQ ID NO: 2042 - RNA, 17 nt, Artificial Sequence
  Synthetic
uauucuuagcagguuaa

SEQ ID NO: 2043 - RNA, 17 nt, Artificial Sequence
  Synthetic
guauucuuagcagguua

SEQ ID NO: 2044 - RNA, 17 nt, Artificial Sequence
  Synthetic
gcgcccuucugccaggc

SEQ ID NO: 2045 - RNA, 17 nt, Artificial Sequence
  Synthetic
agcgcccuucugccagg

SEQ ID NO: 2046 - RNA, 17 nt, Artificial Sequence
  Synthetic
aacagggggggaguggg

SEQ ID NO: 2047 - RNA, 17 nt, Artificial Sequence
  Synthetic
aaacagggggggagugg

SEQ ID NO: 2048 - RNA, 17 nt, Artificial Sequence
  Synthetic
gacuaaacaggggggga

SEQ ID NO: 2049 - RNA, 17 nt, Artificial Sequence
  Synthetic
gguggacuaaacagggg

SEQ ID NO: 2050 - RNA, 17 nt, Artificial Sequence
  Synthetic
ugguggacuaaacaggg

SEQ ID NO: 2051 - RNA, 17 nt, Artificial Sequence
  Synthetic
gugguggacuaaacagg

SEQ ID NO: 2052 - RNA, 17 nt, Artificial Sequence
  Synthetic
ggugguggacuaaacag

SEQ ID NO: 2053 - RNA, 17 nt, Artificial Sequence
  Synthetic
cggugguggacuaaaca

SEQ ID NO: 2054 - RNA, 17 nt, Artificial Sequence
  Synthetic
ucggugguggacuaaac

SEQ ID NO: 2055 - RNA, 17 nt, Artificial Sequence
  Synthetic
cucggugguggacuaaa

SEQ ID NO: 2056 - RNA, 17 nt, Artificial Sequence
  Synthetic
caagugaugucucggug

SEQ ID NO: 2057 - RNA, 17 nt, Artificial Sequence
  Synthetic
caggcgcucuaugcggu

SEQ ID NO: 2058 - RNA, 17 nt, Artificial Sequence
  Synthetic
ccaggcgcucuaugcgg

SEQ ID NO: 2059 - RNA, 17 nt, Artificial Sequence
  Synthetic
cccaggcgcucuaugcg

SEQ ID NO: 2060 - RNA, 17 nt, Artificial Sequence
  Synthetic
cucgggugauggguggc

SEQ ID NO: 2061 - RNA, 17 nt, Artificial Sequence
  Synthetic
ucaaaggcacucgggug

SEQ ID NO: 2062 - RNA, 17 nt, Artificial Sequence
  Synthetic
cacccugucaaaggcac

SEQ ID NO: 2063 - RNA, 17 nt, Artificial Sequence
  Synthetic
gggaggcuccauagcca

SEQ ID NO: 2064 - RNA, 17 nt, Artificial Sequence
  Synthetic
cuagagaaauccauggc

SEQ ID NO: 2065 - RNA, 17 nt, Artificial Sequence
  Synthetic
ccuagagaaauccaugg

SEQ ID NO: 2066 - RNA, 17 nt, Artificial Sequence
  Synthetic
uccuagagaaauccaug

SEQ ID NO: 2067 - RNA, 17 nt, Artificial Sequence
  Synthetic
gcucucuaagucuccua

SEQ ID NO: 2068 - RNA, 17 nt, Artificial Sequence
  Synthetic
cagcucucuaagucucc

SEQ ID NO: 2069 - RNA, 17 nt, Artificial Sequence
  Synthetic
ccggccuggggacagcg

SEQ ID NO: 2070 - RNA, 17 nt, Artificial Sequence
  Synthetic
uagggcugggccggccu

SEQ ID NO: 2071 - RNA, 17 nt, Artificial Sequence
  Synthetic
auagggcugggccggcc

SEQ ID NO: 2072 - RNA, 17 nt, Artificial Sequence
  Synthetic
cauagggcugggccggc

SEQ ID NO: 2073 - RNA, 17 nt, Artificial Sequence
  Synthetic
guaaccuuugcauaggg

SEQ ID NO: 2074 - RNA, 17 nt, Artificial Sequence
  Synthetic
uugcaguaaccuuugca

SEQ ID NO: 2075 - RNA, 17 nt, Artificial Sequence
  Synthetic
gcggcuugcuaccuggc

SEQ ID NO: 2076 - RNA, 17 nt, Artificial Sequence
  Synthetic
ggcggcuugcuaccugg

SEQ ID NO: 2077 - RNA, 17 nt, Artificial Sequence
  Synthetic
gggggggcgucgccagg

SEQ ID NO: 2078 - RNA, 17 nt, Artificial Sequence
  Synthetic
ggagggggggcgucgcc

SEQ ID NO: 2079 - RNA, 17 nt, Artificial Sequence
  Synthetic
gggagggggggcgucgc

SEQ ID NO: 2080 - RNA, 17 nt, Artificial Sequence
  Synthetic
auugcagaggagggagg

SEQ ID NO: 2081 - RNA, 17 nt, Artificial Sequence
  Synthetic
gauugcagaggagggag

SEQ ID NO: 2082 - RNA, 17 nt, Artificial Sequence
  Synthetic
ggauugcagaggaggga

SEQ ID NO: 2083 - RNA, 17 nt, Artificial Sequence
  Synthetic
cggauugcagaggaggg

SEQ ID NO: 2084 - RNA, 17 nt, Artificial Sequence
  Synthetic
gcggauugcagaggagg

SEQ ID NO: 2085 - RNA, 17 nt, Artificial Sequence
  Synthetic
gggcggauugcagagga

SEQ ID NO: 2086 - RNA, 17 nt, Artificial Sequence
  Synthetic
ggggcggauugcagagg

SEQ ID NO: 2087 - RNA, 17 nt, Artificial Sequence
  Synthetic
aggggcggauugcagag

SEQ ID NO: 2088 - RNA, 17 nt, Artificial Sequence
  Synthetic
ggaggggcggauugcag

SEQ ID NO: 2089 - RNA, 17 nt, Artificial Sequence
  Synthetic
aggaggggcggauugca

SEQ ID NO: 2090 - RNA, 17 nt, Artificial Sequence
  Synthetic
ggaggaggggcggauug

SEQ ID NO: 2091 - RNA, 17 nt, Artificial Sequence
  Synthetic
gcugggagggaggaggg

SEQ ID NO: 2092 - RNA, 17 nt, Artificial Sequence
  Synthetic
gggggcugggagggagg

SEQ ID NO: 2093 - RNA, 17 nt, Artificial Sequence
  Synthetic
cgggggcugggagggag

SEQ ID NO: 2094 - RNA, 17 nt, Artificial Sequence
  Synthetic
accgggggcugggaggg

SEQ ID NO: 2095 - RNA, 17 nt, Artificial Sequence
  Synthetic
gaccgggggcugggagg

SEQ ID NO: 2096 - RNA, 17 nt, Artificial Sequence
  Synthetic
uugaccgggggcuggga

SEQ ID NO: 2097 - RNA, 17 nt, Artificial Sequence
  Synthetic
cuugaccgggggcuggg

SEQ ID NO: 2098 - RNA, 17 nt, Artificial Sequence
  Synthetic
acuugaccgggggcugg

SEQ ID NO: 2099 - RNA, 17 nt, Artificial Sequence
  Synthetic
ggacuugaccgggggcu

SEQ ID NO: 2100 - RNA, 17 nt, Artificial Sequence
  Synthetic
uggacuugaccgggggc

SEQ ID NO: 2101 - RNA, 17 nt, Artificial Sequence
  Synthetic
uuggacuugaccggggg

SEQ ID NO: 2102 - RNA, 17 nt, Artificial Sequence
  Synthetic
augacuuggacuugacc

SEQ ID NO: 2103 - RNA, 17 nt, Artificial Sequence
  Synthetic
caugacuuggacuugac

SEQ ID NO: 2104 - RNA, 17 nt, Artificial Sequence
  Synthetic
gcaugacuuggacuuga

SEQ ID NO: 2105 - RNA, 17 nt, Artificial Sequence
  Synthetic
cgcagaacucgcaugac

SEQ ID NO: 2106 - RNA, 17 nt, Artificial Sequence
  Synthetic
auuugaacgucuugccg

SEQ ID NO: 2107 - RNA, 17 nt, Artificial Sequence
  Synthetic
ccagguugcucugaaau

SEQ ID NO: 2108 - RNA, 17 nt, Artificial Sequence
  Synthetic
ugcaccaccagguugcu

SEQ ID NO: 2109 - RNA, 17 nt, Artificial Sequence
  Synthetic
cgcacagguugcacuug

SEQ ID NO: 2110 - RNA, 17 nt, Artificial Sequence
  Synthetic
cgcuucagcuugcuggc

SEQ ID NO: 2111 - RNA, 17 nt, Artificial Sequence
  Synthetic
cggacuugaccgucaug

SEQ ID NO: 2112 - RNA, 17 nt, Artificial Sequence
  Synthetic
ucggacuugaccgucau

SEQ ID NO: 2113 - RNA, 17 nt, Artificial Sequence
  Synthetic
gucggacuugaccguca

SEQ ID NO: 2114 - RNA, 17 nt, Artificial Sequence
  Synthetic
cgucggacuugaccguc

SEQ ID NO: 2115 - RNA, 17 nt, Artificial Sequence
  Synthetic
cgguggagagaccgucg

SEQ ID NO: 2116 - RNA, 17 nt, Artificial Sequence
  Synthetic
ccggggagcuggcggug

SEQ ID NO: 2117 - RNA, 17 nt, Artificial Sequence
  Synthetic
uuccggggagcuggcgg

SEQ ID NO: 2118 - RNA, 17 nt, Artificial Sequence
  Synthetic
guuccggggagcuggcg

SEQ ID NO: 2119 - RNA, 17 nt, Artificial Sequence
  Synthetic
gcuggugccggguuccg

SEQ ID NO: 2120 - RNA, 17 nt, Artificial Sequence
  Synthetic
cgcuggugccggguucc

SEQ ID NO: 2121 - RNA, 17 nt, Artificial Sequence
  Synthetic
ucgcuggugccggguuc

SEQ ID NO: 2122 - RNA, 17 nt, Artificial Sequence
  Synthetic
gucgcuggugccggguu

SEQ ID NO: 2123 - RNA, 17 nt, Artificial Sequence
  Synthetic
ccaccaagucgcuggug

SEQ ID NO: 2124 - RNA, 17 nt, Artificial Sequence
  Synthetic
acuuggccaccacggac

SEQ ID NO: 2125 - RNA, 17 nt, Artificial Sequence
  Synthetic
ucuugaacuuggccacc

SEQ ID NO: 2126 - RNA, 17 nt, Artificial Sequence
  Synthetic
uggggucguucucgcuc

SEQ ID NO: 2127 - RNA, 17 nt, Artificial Sequence
  Synthetic
guucuccgggaucaggu

SEQ ID NO: 2128 - RNA, 17 nt, Artificial Sequence
  Synthetic
cguucuccgggaucagg

SEQ ID NO: 2129 - RNA, 17 nt, Artificial Sequence
  Synthetic
uccucguccccguucuc

SEQ ID NO: 2130 - RNA, 17 nt, Artificial Sequence
  Synthetic
cuccucguccccguucu

SEQ ID NO: 2131 - RNA, 17 nt, Artificial Sequence
  Synthetic
ccgccuccaggcucagc

SEQ ID NO: 2132 - RNA, 17 nt, Artificial Sequence
  Synthetic
gcccacgaccgcgcccc

SEQ ID NO: 2133 - RNA, 17 nt, Artificial Sequence
  Synthetic
cccugcaugacgucggg

SEQ ID NO: 2134 - RNA, 17 nt, Artificial Sequence
  Synthetic
ccaugcccugcaugacg

SEQ ID NO: 2135 - RNA, 17 nt, Artificial Sequence
  Synthetic
ugaagugcugcauggag

SEQ ID NO: 2136 - RNA, 17 nt, Artificial Sequence
  Synthetic
cucgcugaagugcugca

SEQ ID NO: 2137 - RNA, 17 nt, Artificial Sequence
  Synthetic
ccucgcugaagugcugc

SEQ ID NO: 2138 - RNA, 17 nt, Artificial Sequence
  Synthetic
ccugguggaaggccucg

SEQ ID NO: 2139 - RNA, 17 nt, Artificial Sequence
  Synthetic
ucucgcccaggaccugg

SEQ ID NO: 2140 - RNA, 17 nt, Artificial Sequence
  Synthetic
uucucgcccaggaccug

SEQ ID NO: 2141 - RNA, 17 nt, Artificial Sequence
  Synthetic
cgcuuaugcuucucgcc

SEQ ID NO: 2142 - RNA, 17 nt, Artificial Sequence
  Synthetic
guccgacucgccggcca

SEQ ID NO: 2143 - RNA, 17 nt, Artificial Sequence
  Synthetic
cgaggccgacucgcccg

SEQ ID NO: 2144 - RNA, 17 nt, Artificial Sequence
  Synthetic
ccgaggccgacucgccc

SEQ ID NO: 2145 - RNA, 17 nt, Artificial Sequence
  Synthetic
cccgaggccgacucgcc

SEQ ID NO: 2146 - RNA, 17 nt, Artificial Sequence
  Synthetic
ccccgaggccgacucgc

SEQ ID NO: 2147 - RNA, 17 nt, Artificial Sequence
  Synthetic
cuuuuuggacaggcccc

SEQ ID NO: 2148 - RNA, 17 nt, Artificial Sequence
  Synthetic
ugcccagcagcagcuuu

SEQ ID NO: 2149 - RNA, 17 nt, Artificial Sequence
  Synthetic
gaaggggcucagcgagc

SEQ ID NO: 2150 - RNA, 17 nt, Artificial Sequence
  Synthetic
agaaggggcucagcgag

SEQ ID NO: 2151 - RNA, 17 nt, Artificial Sequence
  Synthetic
cuuagagaaggggcuca

SEQ ID NO: 2152 - RNA, 17 nt, Artificial Sequence
  Synthetic
cuugaugcgcuuagaga

SEQ ID NO: 2153 - RNA, 17 nt, Artificial Sequence
  Synthetic
gcuugaugcgcuuagag

SEQ ID NO: 2154 - RNA, 17 nt, Artificial Sequence
  Synthetic
cgagcuugaugcgcuua

SEQ ID NO: 2155 - RNA, 17 nt, Artificial Sequence
  Synthetic
cucgagcuugaugcgcu

SEQ ID NO: 2156 - RNA, 17 nt, Artificial Sequence
  Synthetic
gcaggucgaacuccuuc

SEQ ID NO: 2157 - RNA, 17 nt, Artificial Sequence
  Synthetic
ucgcggccgggggcagg

SEQ ID NO: 2158 - RNA, 17 nt, Artificial Sequence
  Synthetic
uguugggcaucgcggcc

SEQ ID NO: 2159 - RNA, 17 nt, Artificial Sequence
  Synthetic
guguugggcaucgcggc

SEQ ID NO: 2160 - RNA, 17 nt, Artificial Sequence
  Synthetic
cguguugggcaucgcgg

SEQ ID NO: 2161 - RNA, 17 nt, Artificial Sequence
  Synthetic
aguacacguucuccgug

SEQ ID NO: 2162 - RNA, 17 nt, Artificial Sequence
  Synthetic
guagccggcgagccacu

SEQ ID NO: 2163 - RNA, 17 nt, Artificial Sequence
  Synthetic
uggaggccgcguagccg

SEQ ID NO: 2164 - RNA, 17 nt, Artificial Sequence
  Synthetic
gggaucuuugagcugcc

SEQ ID NO: 2165 - RNA, 17 nt, Artificial Sequence
  Synthetic
agggaucuuugagcugc

SEQ ID NO: 2166 - RNA, 17 nt, Artificial Sequence
  Synthetic
agcuaaggaagggaucu

SEQ ID NO: 2167 - RNA, 17 nt, Artificial Sequence
  Synthetic
gucuccgaagcuaagga

SEQ ID NO: 2168 - RNA, 17 nt, Artificial Sequence
  Synthetic
agucuccgaagcuaagg

SEQ ID NO: 2169 - RNA, 17 nt, Artificial Sequence
  Synthetic
uggagucuccgaagcua

SEQ ID NO: 2170 - RNA, 17 nt, Artificial Sequence
  Synthetic
cuggagucuccgaagcu

SEQ ID NO: 2171 - RNA, 17 nt, Artificial Sequence
  Synthetic
gcgauugucuggagucu

SEQ ID NO: 2172 - RNA, 17 nt, Artificial Sequence
  Synthetic
ggcaaaaggcgauuguc

SEQ ID NO: 2173 - RNA, 17 nt, Artificial Sequence
  Synthetic
aggcaaaaggcgauugu

SEQ ID NO: 2174 - RNA, 17 nt, Artificial Sequence
  Synthetic
cgaggagugcuccgacg

SEQ ID NO: 2175 - RNA, 17 nt, Artificial Sequence
  Synthetic
ccgaggagugcuccgac

SEQ ID NO: 2176 - RNA, 17 nt, Artificial Sequence
  Synthetic
cuccgaggagugcuccg

SEQ ID NO: 2177 - RNA, 17 nt, Artificial Sequence
  Synthetic
caaacucccguucuccg

SEQ ID NO: 2178 - RNA, 17 nt, Artificial Sequence
  Synthetic
gcaaacucccguucucc

SEQ ID NO: 2179 - RNA, 17 nt, Artificial Sequence
  Synthetic
gcgcaaacucccguucu

SEQ ID NO: 2180 - RNA, 17 nt, Artificial Sequence
  Synthetic
gcuccccgggcggugug

SEQ ID NO: 2181 - RNA, 17 nt, Artificial Sequence
  Synthetic
cagcuccccgggcggug

SEQ ID NO: 2182 - RNA, 17 nt, Artificial Sequence
  Synthetic
ccagcuccccgggcggu

SEQ ID NO: 2183 - RNA, 17 nt, Artificial Sequence
  Synthetic
ucccuccguccagcucc

SEQ ID NO: 2184 - RNA, 17 nt, Artificial Sequence
  Synthetic
ucccgugccgcugcgcc

SEQ ID NO: 2185 - RNA, 17 nt, Artificial Sequence
  Synthetic
ggcccggaccacuaaua

SEQ ID NO: 2186 - RNA, 17 nt, Artificial Sequence
  Synthetic
gggcccggaccacuaau

SEQ ID NO: 2187 - RNA, 17 nt, Artificial Sequence
  Synthetic
gcugggccugcccgggc

SEQ ID NO: 2188 - RNA, 17 nt, Artificial Sequence
  Synthetic
uuuugagcugggccugc

SEQ ID NO: 2189 - RNA, 17 nt, Artificial Sequence
  Synthetic
gucugcccucuuuugag

SEQ ID NO: 2190 - RNA, 17 nt, Artificial Sequence
  Synthetic
gcugcgucugcccucuu

SEQ ID NO: 2191 - RNA, 20 nt, Artificial Sequence
  Synthetic
cccccauucggcguaguacc

SEQ ID NO: 2192 - RNA, 20 nt, Artificial Sequence
  Synthetic
cccauucggcguaguaccca

SEQ ID NO: 2193 - RNA, 20 nt, Artificial Sequence
  Synthetic
cucaagauguguggcaguuu

SEQ ID NO: 2194 - RNA, 20 nt, Artificial Sequence
  Synthetic
agauguguggcaguuuucgg

SEQ ID NO: 2195 - RNA, 20 nt, Artificial Sequence
  Synthetic
gauguguggcaguuuucgga

SEQ ID NO: 2196 - RNA, 20 nt, Artificial Sequence
  Synthetic
ggcaguuuucggauggaagc

SEQ ID NO: 2197 - RNA, 20 nt, Artificial Sequence
  Synthetic
caguuuucggauggaagcuc

SEQ ID NO: 2198 - RNA, 17 nt, Artificial Sequence
  Synthetic
ccauucggcguaguacc

SEQ ID NO: 2199 - RNA, 17 nt, Artificial Sequence
  Synthetic
auucggcguaguaccca

SEQ ID NO: 2200 - RNA, 17 nt, Artificial Sequence
  Synthetic
aagauguguggcaguuu

SEQ ID NO: 2201 - RNA, 17 nt, Artificial Sequence
  Synthetic
uguguggcaguuuucgg

SEQ ID NO: 2202 - RNA, 17 nt, Artificial Sequence
  Synthetic
guguggcaguuuucgga

SEQ ID NO: 2203 - RNA, 17 nt, Artificial Sequence
  Synthetic
aguuuucggauggaagc

SEQ ID NO: 2204 - RNA, 17 nt, Artificial Sequence
  Synthetic
uuuucggauggaagcuc

SEQ ID NO: 2205 - RNA, 20 nt, Artificial Sequence
  Synthetic
acgccgaaugggggugugug

SEQ ID NO: 2206 - RNA, 20 nt, Artificial Sequence
  Synthetic
acuacgccgaaugggggugu

SEQ ID NO: 2207 - RNA, 20 nt, Artificial Sequence
  Synthetic
cucuggguacuacgccgaau

SEQ ID NO: 2208 - RNA, 20 nt, Artificial Sequence
  Synthetic
ucucuggguacuacgccgaa

SEQ ID NO: 2209 - RNA, 20 nt, Artificial Sequence
  Synthetic
cucucuggguacuacgccga

SEQ ID NO: 2210 - RNA, 20 nt, Artificial Sequence
  Synthetic
ugagcucucuggguacuacg

SEQ ID NO: 2211 - RNA, 20 nt, Artificial Sequence
  Synthetic
ugccacacaucuugagcucu

SEQ ID NO: 2212 - RNA, 20 nt, Artificial Sequence
  Synthetic
uccgaaaacugccacacauc

SEQ ID NO: 2213 - RNA, 20 nt, Artificial Sequence
  Synthetic
aagggcucucgagcuuccau

SEQ ID NO: 2214 - RNA, 17 nt, Artificial Sequence
  Synthetic
ccgaaugggggugugug

SEQ ID NO: 2215 - RNA, 17 nt, Artificial Sequence
  Synthetic
acgccgaaugggggugu

SEQ ID NO: 2216 - RNA, 17 nt, Artificial Sequence
  Synthetic
uggguacuacgccgaau

SEQ ID NO: 2217 - RNA, 17 nt, Artificial Sequence
  Synthetic
cuggguacuacgccgaa

SEQ ID NO: 2218 - RNA, 17 nt, Artificial Sequence
  Synthetic
ucuggguacuacgccga

SEQ ID NO: 2219 - RNA, 17 nt, Artificial Sequence
  Synthetic
gcucucuggguacuacg

SEQ ID NO: 2220 - RNA, 17 nt, Artificial Sequence
  Synthetic
cacacaucuugagcucu

SEQ ID NO: 2221 - RNA, 17 nt, Artificial Sequence
  Synthetic
gaaaacugccacacauc

SEQ ID NO: 2222 - RNA, 17 nt, Artificial Sequence
  Synthetic
ggcucucgagcuuccau

SEQ ID NO: 2223 - RNA, 20 nt, Artificial Sequence
  Synthetic
auccaggucacgccagagga

SEQ ID NO: 2224 - RNA, 20 nt, Artificial Sequence
  Synthetic
ugcaacacgcacagaacacu

SEQ ID NO: 2225 - RNA, 20 nt, Artificial Sequence
  Synthetic
uccuucccagccaccucucc

SEQ ID NO: 2226 - RNA, 20 nt, Artificial Sequence
  Synthetic
auggcuauggagccucccgc

SEQ ID NO: 2227 - RNA, 17 nt, Artificial Sequence
  Synthetic
caggucacgccagagga

SEQ ID NO: 2228 - RNA, 17 nt, Artificial Sequence
  Synthetic
aacacgcacagaacacu

SEQ ID NO: 2229 - RNA, 17 nt, Artificial Sequence
  Synthetic
uucccagccaccucucc

SEQ ID NO: 2230 - RNA, 17 nt, Artificial Sequence
  Synthetic
gcuauggagccucccgc

SEQ ID NO: 2231 - RNA, 20 nt, Artificial Sequence
  Synthetic
ugaaaaaagcauccaauccc

SEQ ID NO: 2232 - RNA, 20 nt, Artificial Sequence
  Synthetic
ggagguuggcauccagguca

SEQ ID NO: 2233 - RNA, 20 nt, Artificial Sequence
  Synthetic
cgccugggaugagugcagaa

SEQ ID NO: 2234 - RNA, 20 nt, Artificial Sequence
  Synthetic
uagaaagcgaacacggaagu

SEQ ID NO: 2235 - RNA, 20 nt, Artificial Sequence
  Synthetic
ggcuauggagccucccgcca

SEQ ID NO: 2236 - RNA, 20 nt, Artificial Sequence
  Synthetic
ccuccucccucccagccccc

SEQ ID NO: 2237 - RNA, 20 nt, Artificial Sequence
  Synthetic
cccaugacggucaaguccga

SEQ ID NO: 2238 - RNA, 20 nt, Artificial Sequence
  Synthetic
uuugccuccucgucggagca

SEQ ID NO: 2239 - RNA, 17 nt, Artificial Sequence
  Synthetic
ugaaaaaagcauccaau

SEQ ID NO: 2240 - RNA, 17 nt, Artificial Sequence
  Synthetic
ggagguuggcauccagg

SEQ ID NO: 2241 - RNA, 17 nt, Artificial Sequence
  Synthetic
cgccugggaugagugca

SEQ ID NO: 2242 - RNA, 17 nt, Artificial Sequence
  Synthetic
uagaaagcgaacacgga

SEQ ID NO: 2243 - RNA, 17 nt, Artificial Sequence
  Synthetic
ggcuauggagccucccg

SEQ ID NO: 2244 - RNA, 17 nt, Artificial Sequence
  Synthetic
ccuccucccucccagcc

SEQ ID NO: 2245 - RNA, 17 nt, Artificial Sequence
  Synthetic
cccaugacggucaaguc

SEQ ID NO: 2246 - RNA, 17 nt, Artificial Sequence
  Synthetic
uuugccuccucgucgga

SEQ ID NO: 2247 - RNA, 20 nt, Artificial Sequence
  Synthetic
ucuucuccuugcugccucug

SEQ ID NO: 2248 - RNA, 20 nt, Artificial Sequence
  Synthetic
uccuugcugccucugagguu

SEQ ID NO: 2249 - RNA, 20 nt, Artificial Sequence
  Synthetic
ugcugccucugagguucggu

SEQ ID NO: 2250 - RNA, 20 nt, Artificial Sequence
  Synthetic
gcugccucugagguucgguc

SEQ ID NO: 2251 - RNA, 20 nt, Artificial Sequence
  Synthetic
gccucugagguucggucggg

SEQ ID NO: 2252 - RNA, 20 nt, Artificial Sequence
  Synthetic
ccucugagguucggucggga

SEQ ID NO: 2253 - RNA, 20 nt, Artificial Sequence
  Synthetic
cucugagguucggucgggag

SEQ ID NO: 2254 - RNA, 20 nt, Artificial Sequence
  Synthetic
ugagguucggucgggagggg

SEQ ID NO: 2255 - RNA, 20 nt, Artificial Sequence
  Synthetic
gagguucggucgggagggga

SEQ ID NO: 2256 - RNA, 20 nt, Artificial Sequence
  Synthetic
cggucgggaggggagggcag

SEQ ID NO: 2257 - RNA, 20 nt, Artificial Sequence
  Synthetic
ggggagggcagcggcaaccc

SEQ ID NO: 2258 - RNA, 20 nt, Artificial Sequence
  Synthetic
gagggcagcggcaacccagg

SEQ ID NO: 2259 - RNA, 20 nt, Artificial Sequence
  Synthetic
caacccaggaggcagcaguc

SEQ ID NO: 2260 - RNA, 20 nt, Artificial Sequence
  Synthetic
aacccaggaggcagcagucc

SEQ ID NO: 2261 - RNA, 20 nt, Artificial Sequence
  Synthetic
cucccucucccgcgugcccc

SEQ ID NO: 2262 - RNA, 20 nt, Artificial Sequence
  Synthetic
cccccggccgccuccucccc

SEQ ID NO: 2263 - RNA, 20 nt, Artificial Sequence
  Synthetic
cggcccuagcuccugcccuu

SEQ ID NO: 2264 - RNA, 20 nt, Artificial Sequence
  Synthetic
cccuagcuccugcccuucgg

SEQ ID NO: 2265 - RNA, 20 nt, Artificial Sequence
  Synthetic
uagcuccugcccuucggcgg

SEQ ID NO: 2266 - RNA, 20 nt, Artificial Sequence
  Synthetic
cuccugcccuucggcggcgg

SEQ ID NO: 2267 - RNA, 20 nt, Artificial Sequence
  Synthetic
cugcccuucggcggcggcgg

SEQ ID NO: 2268 - RNA, 20 nt, Artificial Sequence
  Synthetic
cccuucggcggcggcggcgg

SEQ ID NO: 2269 - RNA, 20 nt, Artificial Sequence
  Synthetic
uucggcggcggcggcggcgg

SEQ ID NO: 2270 - RNA, 20 nt, Artificial Sequence
  Synthetic
cggcggcggcggcggcggcg

SEQ ID NO: 2271 - RNA, 20 nt, Artificial Sequence
  Synthetic
ggcggcggcggcggcggcgc

SEQ ID NO: 2272 - RNA, 20 nt, Artificial Sequence
  Synthetic
ggcggcggcggcggcgcggg

SEQ ID NO: 2273 - RNA, 20 nt, Artificial Sequence
  Synthetic
gcggcggcggcggcgcggga

SEQ ID NO: 2274 - RNA, 20 nt, Artificial Sequence
  Synthetic
ggcgcgggagggcaagcgcg

SEQ ID NO: 2275 - RNA, 20 nt, Artificial Sequence
  Synthetic
ggagggcaagcgcgaggagc

SEQ ID NO: 2276 - RNA, 20 nt, Artificial Sequence
  Synthetic
gcgcgaggagccggcacaaa

SEQ ID NO: 2277 - RNA, 20 nt, Artificial Sequence
  Synthetic
ggagccggcacaaaaggcag

SEQ ID NO: 2278 - RNA, 20 nt, Artificial Sequence
  Synthetic
gagccggcacaaaaggcagc

SEQ ID NO: 2279 - RNA, 20 nt, Artificial Sequence
  Synthetic
gcgggacaaacacccaccuc

SEQ ID NO: 2280 - RNA, 20 nt, Artificial Sequence
  Synthetic
gacaaacacccaccucuggc

SEQ ID NO: 2281 - RNA, 20 nt, Artificial Sequence
  Synthetic
ccaccucuggccggaacaaa

SEQ ID NO: 2282 - RNA, 20 nt, Artificial Sequence
  Synthetic
ccucuggccggaacaaaagg

SEQ ID NO: 2283 - RNA, 20 nt, Artificial Sequence
  Synthetic
ggaacaaaaggcggcagugc

SEQ ID NO: 2284 - RNA, 20 nt, Artificial Sequence
  Synthetic
gccgcgucucccguccuucc

SEQ ID NO: 2285 - RNA, 20 nt, Artificial Sequence
  Synthetic
ucccguccuucccgguccca

SEQ ID NO: 2286 - RNA, 20 nt, Artificial Sequence
  Synthetic
cacggcucuccccgucgccg

SEQ ID NO: 2287 - RNA, 20 nt, Artificial Sequence
  Synthetic
cggccccucucccgacuccg

SEQ ID NO: 2288 - RNA, 20 nt, Artificial Sequence
  Synthetic
ucucccgacuccgcggacuc

SEQ ID NO: 2289 - RNA, 20 nt, Artificial Sequence
  Synthetic
cuccgcggacucaggagcgc

SEQ ID NO: 2290 - RNA, 20 nt, Artificial Sequence
  Synthetic
uccgcggacucaggagcgcc

SEQ ID NO: 2291 - RNA, 20 nt, Artificial Sequence
  Synthetic
ccgcggacucaggagcgccg

SEQ ID NO: 2292 - RNA, 20 nt, Artificial Sequence
  Synthetic
cgcggacucaggagcgccgg

SEQ ID NO: 2293 - RNA, 20 nt, Artificial Sequence
  Synthetic
gugccacuuucucacuauug

SEQ ID NO: 2294 - RNA, 20 nt, Artificial Sequence
  Synthetic
ugccacuuucucacuauugu

SEQ ID NO: 2295 - RNA, 20 nt, Artificial Sequence
  Synthetic
gccacuuucucacuauugug

SEQ ID NO: 2296 - RNA, 20 nt, Artificial Sequence
  Synthetic
acacuugaccgugagcgcgc

SEQ ID NO: 2297 - RNA, 20 nt, Artificial Sequence
  Synthetic
agucucaccucuuuucuccc

SEQ ID NO: 2298 - RNA, 20 nt, Artificial Sequence
  Synthetic
gucucaccucuuuucucccc

SEQ ID NO: 2299 - RNA, 20 nt, Artificial Sequence
  Synthetic
ccuacccccccauuuucuua

SEQ ID NO: 2300 - RNA, 20 nt, Artificial Sequence
  Synthetic
ccccauuuucuuacggugag

SEQ ID NO: 2301 - RNA, 20 nt, Artificial Sequence
  Synthetic
cccauuuucuuacggugagu

SEQ ID NO: 2302 - RNA, 20 nt, Artificial Sequence
  Synthetic
ccccaccagcucccaccccc

SEQ ID NO: 2303 - RNA, 20 nt, Artificial Sequence
  Synthetic
uguucauuauuuugcaaaac

SEQ ID NO: 2304 - RNA, 20 nt, Artificial Sequence
  Synthetic
ucauuauuuugcaaaacugg

SEQ ID NO: 2305 - RNA, 20 nt, Artificial Sequence
  Synthetic
cauuauuuugcaaaacuggc

SEQ ID NO: 2306 - RNA, 20 nt, Artificial Sequence
  Synthetic
auuauuuugcaaaacuggcg

SEQ ID NO: 2307 - RNA, 20 nt, Artificial Sequence
  Synthetic
auuuugcaaaacuggcgggg

SEQ ID NO: 2308 - RNA, 20 nt, Artificial Sequence
  Synthetic
uuuugcaaaacuggcggggc

SEQ ID NO: 2309 - RNA, 20 nt, Artificial Sequence
  Synthetic
uuugcaaaacuggcggggcg

SEQ ID NO: 2310 - RNA, 20 nt, Artificial Sequence
  Synthetic
uugcaaaacuggcggggcgg

SEQ ID NO: 2311 - RNA, 20 nt, Artificial Sequence
  Synthetic
ugcaaaacuggcggggcggg

SEQ ID NO: 2312 - RNA, 20 nt, Artificial Sequence
  Synthetic
gcaaaacuggcggggcgggg

SEQ ID NO: 2313 - RNA, 20 nt, Artificial Sequence
  Synthetic
caaaacuggcggggcggggg

SEQ ID NO: 2314 - RNA, 20 nt, Artificial Sequence
  Synthetic
cuggcggggcggggggggag

SEQ ID NO: 2315 - RNA, 20 nt, Artificial Sequence
  Synthetic
uuucgaaaagagaaauaaag

SEQ ID NO: 2316 - RNA, 20 nt, Artificial Sequence
  Synthetic
cgaaaagagaaauaaagcgg

SEQ ID NO: 2317 - RNA, 20 nt, Artificial Sequence
  Synthetic
agagaaauaaagcggcggaa

SEQ ID NO: 2318 - RNA, 20 nt, Artificial Sequence
  Synthetic
gaaauaaagcggcggaaagg

SEQ ID NO: 2319 - RNA, 20 nt, Artificial Sequence
  Synthetic
agcggcggaaaggaggaaag

SEQ ID NO: 2320 - RNA, 20 nt, Artificial Sequence
  Synthetic
ggcggaaaggaggaaagagg

SEQ ID NO: 2321 - RNA, 20 nt, Artificial Sequence
  Synthetic
uaaaauuaaauaaaauuaaa

SEQ ID NO: 2322 - RNA, 20 nt, Artificial Sequence
  Synthetic
cugucucaaaagugcauaca

SEQ ID NO: 2323 - RNA, 20 nt, Artificial Sequence
  Synthetic
caaaagugcauacacggcaa

SEQ ID NO: 2324 - RNA, 20 nt, Artificial Sequence
  Synthetic
uacacggcaaugguuccaga

SEQ ID NO: 2325 - RNA, 20 nt, Artificial Sequence
  Synthetic
acacggcaaugguuccagau

SEQ ID NO: 2326 - RNA, 20 nt, Artificial Sequence
  Synthetic
caaugguuccagaugggaug

SEQ ID NO: 2327 - RNA, 20 nt, Artificial Sequence
  Synthetic
aaugguuccagaugggauga

SEQ ID NO: 2328 - RNA, 20 nt, Artificial Sequence
  Synthetic
aucucuuuuaccucgacucu

SEQ ID NO: 2329 - RNA, 20 nt, Artificial Sequence
  Synthetic
ucuuuuaccucgacucucgg

SEQ ID NO: 2330 - RNA, 20 nt, Artificial Sequence
  Synthetic
auaauuauuauuacuauuau

SEQ ID NO: 2331 - RNA, 20 nt, Artificial Sequence
  Synthetic
uaauuauuauuacuauuauu

SEQ ID NO: 2332 - RNA, 20 nt, Artificial Sequence
  Synthetic
uaauaaucacgagagcgcgc

SEQ ID NO: 2333 - RNA, 20 nt, Artificial Sequence
  Synthetic
caggacuagaagcaaaagcg

SEQ ID NO: 2334 - RNA, 20 nt, Artificial Sequence
  Synthetic
aggacuagaagcaaaagcga

SEQ ID NO: 2335 - RNA, 20 nt, Artificial Sequence
  Synthetic
ggacuagaagcaaaagcgag

SEQ ID NO: 2336 - RNA, 20 nt, Artificial Sequence
  Synthetic
gacuagaagcaaaagcgagg

SEQ ID NO: 2337 - RNA, 20 nt, Artificial Sequence
  Synthetic
agcaaaagcgagggggagag

SEQ ID NO: 2338 - RNA, 20 nt, Artificial Sequence
  Synthetic
gcaaaagcgagggggagaga

SEQ ID NO: 2339 - RNA, 20 nt, Artificial Sequence
  Synthetic
caaaagcgagggggagagag

SEQ ID NO: 2340 - RNA, 20 nt, Artificial Sequence
  Synthetic
agaaaaaccuccgagagucg

SEQ ID NO: 2341 - RNA, 20 nt, Artificial Sequence
  Synthetic
agucgagguaaaagagauaa

SEQ ID NO: 2342 - RNA, 20 nt, Artificial Sequence
  Synthetic
gucgagguaaaagagauaaa

SEQ ID NO: 2343 - RNA, 20 nt, Artificial Sequence
  Synthetic
ucgagguaaaagagauaaag

SEQ ID NO: 2344 - RNA, 20 nt, Artificial Sequence
  Synthetic
cgagguaaaagagauaaagg

SEQ ID NO: 2345 - RNA, 20 nt, Artificial Sequence
  Synthetic
gaaaaaacccucaucccauc

SEQ ID NO: 2346 - RNA, 20 nt, Artificial Sequence
  Synthetic
cuuuauuucucuuuucgaaa

SEQ ID NO: 2347 - RNA, 20 nt, Artificial Sequence
  Synthetic
caaaauaaugaacaaugcua

SEQ ID NO: 2348 - RNA, 20 nt, Artificial Sequence
  Synthetic
gaacaacucacaugcaaacc

SEQ ID NO: 2349 - RNA, 20 nt, Artificial Sequence
  Synthetic
aacaacucacaugcaaaccu

SEQ ID NO: 2350 - RNA, 20 nt, Artificial Sequence
  Synthetic
acaacucacaugcaaaccug

SEQ ID NO: 2351 - RNA, 20 nt, Artificial Sequence
  Synthetic
caacucacaugcaaaccugg

SEQ ID NO: 2352 - RNA, 20 nt, Artificial Sequence
  Synthetic
cucacaugcaaaccuggggg

SEQ ID NO: 2353 - RNA, 20 nt, Artificial Sequence
  Synthetic
ucacaugcaaaccugggggu

SEQ ID NO: 2354 - RNA, 20 nt, Artificial Sequence
  Synthetic
gcaaaccugggggugggagc

SEQ ID NO: 2355 - RNA, 20 nt, Artificial Sequence
  Synthetic
aaccugggggugggagcugg

SEQ ID NO: 2356 - RNA, 20 nt, Artificial Sequence
  Synthetic
accugggggugggagcuggu

SEQ ID NO: 2357 - RNA, 20 nt, Artificial Sequence
  Synthetic
ccugggggugggagcuggug

SEQ ID NO: 2358 - RNA, 20 nt, Artificial Sequence
  Synthetic
gggugggagcugguggggaa

SEQ ID NO: 2359 - RNA, 20 nt, Artificial Sequence
  Synthetic
ggugggagcugguggggaaa

SEQ ID NO: 2360 - RNA, 20 nt, Artificial Sequence
  Synthetic
gggagcugguggggaaaggg

SEQ ID NO: 2361 - RNA, 20 nt, Artificial Sequence
  Synthetic
ucccacucaccguaagaaaa

SEQ ID NO: 2362 - RNA, 20 nt, Artificial Sequence
  Synthetic
cccacucaccguaagaaaau

SEQ ID NO: 2363 - RNA, 20 nt, Artificial Sequence
  Synthetic
ccacucaccguaagaaaaug

SEQ ID NO: 2364 - RNA, 20 nt, Artificial Sequence
  Synthetic
cacucaccguaagaaaaugg

SEQ ID NO: 2365 - RNA, 20 nt, Artificial Sequence
  Synthetic
acucaccguaagaaaauggg

SEQ ID NO: 2366 - RNA, 20 nt, Artificial Sequence
  Synthetic
cucaccguaagaaaaugggg

SEQ ID NO: 2367 - RNA, 20 nt, Artificial Sequence
  Synthetic
ccguaagaaaaugggggggu

SEQ ID NO: 2368 - RNA, 20 nt, Artificial Sequence
  Synthetic
cguaagaaaaugggggggua

SEQ ID NO: 2369 - RNA, 20 nt, Artificial Sequence
  Synthetic
aagaaaauggggggguaggg

SEQ ID NO: 2370 - RNA, 20 nt, Artificial Sequence
  Synthetic
agaaaauggggggguaggga

SEQ ID NO: 2371 - RNA, 20 nt, Artificial Sequence
  Synthetic
caagucuaaaaaacgauucc

SEQ ID NO: 2372 - RNA, 20 nt, Artificial Sequence
  Synthetic
aagucuaaaaaacgauuccc

SEQ ID NO: 2373 - RNA, 20 nt, Artificial Sequence
  Synthetic
agucuaaaaaacgauucccg

SEQ ID NO: 2374 - RNA, 20 nt, Artificial Sequence
  Synthetic
acgauucccggggagaaaag

SEQ ID NO: 2375 - RNA, 20 nt, Artificial Sequence
  Synthetic
ggggagaaaagaggugagac

SEQ ID NO: 2376 - RNA, 20 nt, Artificial Sequence
  Synthetic
aaagaggugagacuggcuuu

SEQ ID NO: 2377 - RNA, 20 nt, Artificial Sequence
  Synthetic
uuuggacaccagcgcgcuca

SEQ ID NO: 2378 - RNA, 20 nt, Artificial Sequence
  Synthetic
gcucacggucaagugugcag

SEQ ID NO: 2379 - RNA, 20 nt, Artificial Sequence
  Synthetic
cucacggucaagugugcagc

SEQ ID NO: 2380 - RNA, 20 nt, Artificial Sequence
  Synthetic
acggucaagugugcagcggg

SEQ ID NO: 2381 - RNA, 20 nt, Artificial Sequence
  Synthetic
uccccacaauagugagaaag

SEQ ID NO: 2382 - RNA, 20 nt, Artificial Sequence
  Synthetic
auagugagaaaguggcacug

SEQ ID NO: 2383 - RNA, 20 nt, Artificial Sequence
  Synthetic
gagaaaguggcacuguggaa

SEQ ID NO: 2384 - RNA, 20 nt, Artificial Sequence
  Synthetic
agaaaguggcacuguggaaa

SEQ ID NO: 2385 - RNA, 20 nt, Artificial Sequence
  Synthetic
gaaaguggcacuguggaaag

SEQ ID NO: 2386 - RNA, 20 nt, Artificial Sequence
  Synthetic
gcacuguggaaaggggcccc

SEQ ID NO: 2387 - RNA, 20 nt, Artificial Sequence
  Synthetic
ccccggcgcuccugaguccg

SEQ ID NO: 2388 - RNA, 20 nt, Artificial Sequence
  Synthetic
cgcuccugaguccgcggagu

SEQ ID NO: 2389 - RNA, 20 nt, Artificial Sequence
  Synthetic
gcuccugaguccgcggaguc

SEQ ID NO: 2390 - RNA, 20 nt, Artificial Sequence
  Synthetic
ugaguccgcggagucgggag

SEQ ID NO: 2391 - RNA, 20 nt, Artificial Sequence
  Synthetic
gaguccgcggagucgggaga

SEQ ID NO: 2392 - RNA, 20 nt, Artificial Sequence
  Synthetic
aguccgcggagucgggagag

SEQ ID NO: 2393 - RNA, 20 nt, Artificial Sequence
  Synthetic
cggagucgggagaggggccg

SEQ ID NO: 2394 - RNA, 20 nt, Artificial Sequence
  Synthetic
cgggagaggggccgcggcga

SEQ ID NO: 2395 - RNA, 20 nt, Artificial Sequence
  Synthetic
gggagaggggccgcggcgac

SEQ ID NO: 2396 - RNA, 20 nt, Artificial Sequence
  Synthetic
ggagaggggccgcggcgacg

SEQ ID NO: 2397 - RNA, 20 nt, Artificial Sequence
  Synthetic
cgcggcgacggggagagccg

SEQ ID NO: 2398 - RNA, 20 nt, Artificial Sequence
  Synthetic
gcggcgacggggagagccgu

SEQ ID NO: 2399 - RNA, 20 nt, Artificial Sequence
  Synthetic
gacggggagagccgugggac

SEQ ID NO: 2400 - RNA, 20 nt, Artificial Sequence
  Synthetic
acggggagagccgugggacc

SEQ ID NO: 2401 - RNA, 20 nt, Artificial Sequence
  Synthetic
ggagagccgugggaccggga

SEQ ID NO: 2402 - RNA, 20 nt, Artificial Sequence
  Synthetic
agccgugggaccgggaagga

SEQ ID NO: 2403 - RNA, 20 nt, Artificial Sequence
  Synthetic
gccgugggaccgggaaggac

SEQ ID NO: 2404 - RNA, 20 nt, Artificial Sequence
  Synthetic
accgggaaggacgggagacg

SEQ ID NO: 2405 - RNA, 20 nt, Artificial Sequence
  Synthetic
ggaaggacgggagacgcggc

SEQ ID NO: 2406 - RNA, 20 nt, Artificial Sequence
  Synthetic
ggcacugccgccuuuuguuc

SEQ ID NO: 2407 - RNA, 20 nt, Artificial Sequence
  Synthetic
ccgccuuuuguuccggccag

SEQ ID NO: 2408 - RNA, 20 nt, Artificial Sequence
  Synthetic
ccuuuuguuccggccagagg

SEQ ID NO: 2409 - RNA, 20 nt, Artificial Sequence
  Synthetic
cuuuuguuccggccagaggu

SEQ ID NO: 2410 - RNA, 20 nt, Artificial Sequence
  Synthetic
ugucccgcugccuuuugugc

SEQ ID NO: 2411 - RNA, 20 nt, Artificial Sequence
  Synthetic
gccgccgccgccgccgccga

SEQ ID NO: 2412 - RNA, 20 nt, Artificial Sequence
  Synthetic
ccgccgccgccgccgccgaa

SEQ ID NO: 2413 - RNA, 20 nt, Artificial Sequence
  Synthetic
cgccgccgccgccgaagggc

SEQ ID NO: 2414 - RNA, 20 nt, Artificial Sequence
  Synthetic
gccgccgaagggcaggagcu

SEQ ID NO: 2415 - RNA, 20 nt, Artificial Sequence
  Synthetic
ccgccgaagggcaggagcua

SEQ ID NO: 2416 - RNA, 20 nt, Artificial Sequence
  Synthetic
cgaagggcaggagcuagggc

SEQ ID NO: 2417 - RNA, 20 nt, Artificial Sequence
  Synthetic
gaagggcaggagcuagggcc

SEQ ID NO: 2418 - RNA, 20 nt, Artificial Sequence
  Synthetic
aagggcaggagcuagggccg

SEQ ID NO: 2419 - RNA, 20 nt, Artificial Sequence
  Synthetic
agggcaggagcuagggccgg

SEQ ID NO: 2420 - RNA, 20 nt, Artificial Sequence
  Synthetic
gcaggagcuagggccggggg

SEQ ID NO: 2421 - RNA, 20 nt, Artificial Sequence
  Synthetic
ggagcuagggccgggggagg

SEQ ID NO: 2422 - RNA, 20 nt, Artificial Sequence
  Synthetic
gcuagggccgggggaggagg

SEQ ID NO: 2423 - RNA, 20 nt, Artificial Sequence
  Synthetic
gggccgggggaggaggcggc

SEQ ID NO: 2424 - RNA, 20 nt, Artificial Sequence
  Synthetic
ggccgggggaggaggcggcc

SEQ ID NO: 2425 - RNA, 20 nt, Artificial Sequence
  Synthetic
gccgggggaggaggcggccg

SEQ ID NO: 2426 - RNA, 20 nt, Artificial Sequence
  Synthetic
ccgggggaggaggcggccgg

SEQ ID NO: 2427 - RNA, 20 nt, Artificial Sequence
  Synthetic
aggaggcggccgggggcacg

SEQ ID NO: 2428 - RNA, 20 nt, Artificial Sequence
  Synthetic
ggaggcggccgggggcacgc

SEQ ID NO: 2429 - RNA, 20 nt, Artificial Sequence
  Synthetic
cggccgggggcacgcgggag

SEQ ID NO: 2430 - RNA, 20 nt, Artificial Sequence
  Synthetic
ggccgggggcacgcgggaga

SEQ ID NO: 2431 - RNA, 20 nt, Artificial Sequence
  Synthetic
cgggggcacgcgggagaggg

SEQ ID NO: 2432 - RNA, 20 nt, Artificial Sequence
  Synthetic
gggggcacgcgggagaggga

SEQ ID NO: 2433 - RNA, 20 nt, Artificial Sequence
  Synthetic
ggcacgcgggagagggaggg

SEQ ID NO: 2434 - RNA, 20 nt, Artificial Sequence
  Synthetic
gcacgcgggagagggaggga

SEQ ID NO: 2435 - RNA, 20 nt, Artificial Sequence
  Synthetic
ggagagggagggagggagcc

SEQ ID NO: 2436 - RNA, 20 nt, Artificial Sequence
  Synthetic
gagcccggacugcugccucc

SEQ ID NO: 2437 - RNA, 20 nt, Artificial Sequence
  Synthetic
agcccggacugcugccuccu

SEQ ID NO: 2438 - RNA, 20 nt, Artificial Sequence
  Synthetic
cccucccgaccgaaccucag

SEQ ID NO: 2439 - RNA, 20 nt, Artificial Sequence
  Synthetic
accgaaccucagaggcagca

SEQ ID NO: 2440 - RNA, 20 nt, Artificial Sequence
  Synthetic
agaggcagcaaggagaagac

SEQ ID NO: 2441 - RNA, 20 nt, Artificial Sequence
  Synthetic
aaaauaaaauaaauaaaaca

SEQ ID NO: 2442 - RNA, 17 nt, Artificial Sequence
  Synthetic
ucuccuugcugccucug

SEQ ID NO: 2443 - RNA, 17 nt, Artificial Sequence
  Synthetic
uugcugccucugagguu

SEQ ID NO: 2444 - RNA, 17 nt, Artificial Sequence
  Synthetic
ugccucugagguucggu

SEQ ID NO: 2445 - RNA, 17 nt, Artificial Sequence
  Synthetic
gccucugagguucgguc

SEQ ID NO: 2446 - RNA, 17 nt, Artificial Sequence
  Synthetic
ucugagguucggucggg

SEQ ID NO: 2447 - RNA, 17 nt, Artificial Sequence
  Synthetic
cugagguucggucggga

SEQ ID NO: 2448 - RNA, 17 nt, Artificial Sequence
  Synthetic
ugagguucggucgggag

SEQ ID NO: 2449 - RNA, 17 nt, Artificial Sequence
  Synthetic
gguucggucgggagggg

SEQ ID NO: 2450 - RNA, 17 nt, Artificial Sequence
  Synthetic
guucggucgggagggga

SEQ ID NO: 2451 - RNA, 17 nt, Artificial Sequence
  Synthetic
ucgggaggggagggcag

SEQ ID NO: 2452 - RNA, 17 nt, Artificial Sequence
  Synthetic
gagggcagcggcaaccc

SEQ ID NO: 2453 - RNA, 17 nt, Artificial Sequence
  Synthetic
ggcagcggcaacccagg

SEQ ID NO: 2454 - RNA, 17 nt, Artificial Sequence
  Synthetic
cccaggaggcagcaguc

SEQ ID NO: 2455 - RNA, 17 nt, Artificial Sequence
  Synthetic
ccaggaggcagcagucc

SEQ ID NO: 2456 - RNA, 17 nt, Artificial Sequence
  Synthetic
ccucucccgcgugcccc

SEQ ID NO: 2457 - RNA, 17 nt, Artificial Sequence
  Synthetic
ccggccgccuccucccc

SEQ ID NO: 2458 - RNA, 17 nt, Artificial Sequence
  Synthetic
cccuagcuccugcccuu

SEQ ID NO: 2459 - RNA, 17 nt, Artificial Sequence
  Synthetic
uagcuccugcccuucgg

SEQ ID NO: 2460 - RNA, 17 nt, Artificial Sequence
  Synthetic
cuccugcccuucggcgg

SEQ ID NO: 2461 - RNA, 17 nt, Artificial Sequence
  Synthetic
cugcccuucggcggcgg

SEQ ID NO: 2462 - RNA, 17 nt, Artificial Sequence
  Synthetic
cccuucggcggcggcgg

SEQ ID NO: 2463 - RNA, 17 nt, Artificial Sequence
  Synthetic
uucggcggcggcggcgg

SEQ ID NO: 2464 - RNA, 17 nt, Artificial Sequence
  Synthetic
ggcggcggcggcggcgg

SEQ ID NO: 2465 - RNA, 17 nt, Artificial Sequence
  Synthetic
cggcggcggcggcggcg

SEQ ID NO: 2466 - RNA, 17 nt, Artificial Sequence
  Synthetic
ggcggcggcggcggcgc

SEQ ID NO: 2467 - RNA, 17 nt, Artificial Sequence
  Synthetic
ggcggcggcggcgcggg

SEQ ID NO: 2468 - RNA, 17 nt, Artificial Sequence
  Synthetic
gcggcggcggcgcggga

SEQ ID NO: 2469 - RNA, 17 nt, Artificial Sequence
  Synthetic
gcgggagggcaagcgcg

SEQ ID NO: 2470 - RNA, 17 nt, Artificial Sequence
  Synthetic
gggcaagcgcgaggagc

SEQ ID NO: 2471 - RNA, 17 nt, Artificial Sequence
  Synthetic
cgaggagccggcacaaa

SEQ ID NO: 2472 - RNA, 17 nt, Artificial Sequence
  Synthetic
gccggcacaaaaggcag

SEQ ID NO: 2473 - RNA, 17 nt, Artificial Sequence
  Synthetic
ccggcacaaaaggcagc

SEQ ID NO: 2474 - RNA, 17 nt, Artificial Sequence
  Synthetic
ggacaaacacccaccuc

SEQ ID NO: 2475 - RNA, 17 nt, Artificial Sequence
  Synthetic
aaacacccaccucuggc

SEQ ID NO: 2476 - RNA, 17 nt, Artificial Sequence
  Synthetic
ccucuggccggaacaaa

SEQ ID NO: 2477 - RNA, 17 nt, Artificial Sequence
  Synthetic
cuggccggaacaaaagg

SEQ ID NO: 2478 - RNA, 17 nt, Artificial Sequence
  Synthetic
acaaaaggcggcagugc

SEQ ID NO: 2479 - RNA, 17 nt, Artificial Sequence
  Synthetic
gcgucucccguccuucc

SEQ ID NO: 2480 - RNA, 17 nt, Artificial Sequence
  Synthetic
cguccuucccgguccca

SEQ ID NO: 2481 - RNA, 17 nt, Artificial Sequence
  Synthetic
ggcucuccccgucgccg

SEQ ID NO: 2482 - RNA, 17 nt, Artificial Sequence
  Synthetic
ccccucucccgacuccg

SEQ ID NO: 2483 - RNA, 17 nt, Artificial Sequence
  Synthetic
cccgacuccgcggacuc

SEQ ID NO: 2484 - RNA, 17 nt, Artificial Sequence
  Synthetic
cgcggacucaggagcgc

SEQ ID NO: 2485 - RNA, 17 nt, Artificial Sequence
  Synthetic
gcggacucaggagcgcc

SEQ ID NO: 2486 - RNA, 17 nt, Artificial Sequence
  Synthetic
cggacucaggagcgccg

SEQ ID NO: 2487 - RNA, 17 nt, Artificial Sequence
  Synthetic
ggacucaggagcgccgg

SEQ ID NO: 2488 - RNA, 17 nt, Artificial Sequence
  Synthetic
ccacuuucucacuauug

SEQ ID NO: 2489 - RNA, 17 nt, Artificial Sequence
  Synthetic
cacuuucucacuauugu

SEQ ID NO: 2490 - RNA, 17 nt, Artificial Sequence
  Synthetic
acuuucucacuauugug

SEQ ID NO: 2491 - RNA, 17 nt, Artificial Sequence
  Synthetic
cuugaccgugagcgcgc

SEQ ID NO: 2492 - RNA, 17 nt, Artificial Sequence
  Synthetic
cucaccucuuuucuccc

SEQ ID NO: 2493 - RNA, 17 nt, Artificial Sequence
  Synthetic
ucaccucuuuucucccc

SEQ ID NO: 2494 - RNA, 17 nt, Artificial Sequence
  Synthetic
acccccccauuuucuua

SEQ ID NO: 2495 - RNA, 17 nt, Artificial Sequence
  Synthetic
cauuuucuuacggugag

SEQ ID NO: 2496 - RNA, 17 nt, Artificial Sequence
  Synthetic
auuuucuuacggugagu

SEQ ID NO: 2497 - RNA, 17 nt, Artificial Sequence
  Synthetic
caccagcucccaccccc

SEQ ID NO: 2498 - RNA, 17 nt, Artificial Sequence
  Synthetic
ucauuauuuugcaaaac

SEQ ID NO: 2499 - RNA, 17 nt, Artificial Sequence
  Synthetic
uuauuuugcaaaacugg

SEQ ID NO: 2500 - RNA, 17 nt, Artificial Sequence
  Synthetic
uauuuugcaaaacuggc

SEQ ID NO: 2501 - RNA, 17 nt, Artificial Sequence
  Synthetic
auuuugcaaaacuggcg

SEQ ID NO: 2502 - RNA, 17 nt, Artificial Sequence
  Synthetic
uugcaaaacuggcgggg

SEQ ID NO: 2503 - RNA, 17 nt, Artificial Sequence
  Synthetic
ugcaaaacuggcggggc

SEQ ID NO: 2504 - RNA, 17 nt, Artificial Sequence
  Synthetic
gcaaaacuggcggggcg

SEQ ID NO: 2505 - RNA, 17 nt, Artificial Sequence
  Synthetic
caaaacuggcggggcgg

SEQ ID NO: 2506 - RNA, 17 nt, Artificial Sequence
  Synthetic
aaaacuggcggggcggg

SEQ ID NO: 2507 - RNA, 17 nt, Artificial Sequence
  Synthetic
aaacuggcggggcgggg

SEQ ID NO: 2508 - RNA, 17 nt, Artificial Sequence
  Synthetic
aacuggcggggcggggg

SEQ ID NO: 2509 - RNA, 17 nt, Artificial Sequence
  Synthetic
gcggggcggggggggag

SEQ ID NO: 2510 - RNA, 17 nt, Artificial Sequence
  Synthetic
cgaaaagagaaauaaag

SEQ ID NO: 2511 - RNA, 17 nt, Artificial Sequence
  Synthetic
aaagagaaauaaagcgg

SEQ ID NO: 2512 - RNA, 17 nt, Artificial Sequence
  Synthetic
gaaauaaagcggcggaa

SEQ ID NO: 2513 - RNA, 17 nt, Artificial Sequence
  Synthetic
auaaagcggcggaaagg

SEQ ID NO: 2514 - RNA, 17 nt, Artificial Sequence
  Synthetic
ggcggaaaggaggaaag

SEQ ID NO: 2515 - RNA, 17 nt, Artificial Sequence
  Synthetic
ggaaaggaggaaagagg

SEQ ID NO: 2516 - RNA, 17 nt, Artificial Sequence
  Synthetic
aauuaaauaaaauuaaa

SEQ ID NO: 2517 - RNA, 17 nt, Artificial Sequence
  Synthetic
ucucaaaagugcauaca

SEQ ID NO: 2518 - RNA, 17 nt, Artificial Sequence
  Synthetic
aagugcauacacggcaa

SEQ ID NO: 2519 - RNA, 17 nt, Artificial Sequence
  Synthetic
acggcaaugguuccaga

SEQ ID NO: 2520 - RNA, 17 nt, Artificial Sequence
  Synthetic
cggcaaugguuccagau

SEQ ID NO: 2521 - RNA, 17 nt, Artificial Sequence
  Synthetic
ugguuccagaugggaug

SEQ ID NO: 2522 - RNA, 17 nt, Artificial Sequence
  Synthetic
gguuccagaugggauga

SEQ ID NO: 2523 - RNA, 17 nt, Artificial Sequence
  Synthetic
ucuuuuaccucgacucu

SEQ ID NO: 2524 - RNA, 17 nt, Artificial Sequence
  Synthetic
uuuaccucgacucucgg

SEQ ID NO: 2525 - RNA, 17 nt, Artificial Sequence
  Synthetic
auuauuauuacuauuau

SEQ ID NO: 2526 - RNA, 17 nt, Artificial Sequence
  Synthetic
uuauuauuacuauuauu

SEQ ID NO: 2527 - RNA, 17 nt, Artificial Sequence
  Synthetic
uaaucacgagagcgcgc

SEQ ID NO: 2528 - RNA, 17 nt, Artificial Sequence
  Synthetic
gacuagaagcaaaagcg

SEQ ID NO: 2529 - RNA, 17 nt, Artificial Sequence
  Synthetic
acuagaagcaaaagcga

SEQ ID NO: 2530 - RNA, 17 nt, Artificial Sequence
  Synthetic
cuagaagcaaaagcgag

SEQ ID NO: 2531 - RNA, 17 nt, Artificial Sequence
  Synthetic
uagaagcaaaagcgagg

SEQ ID NO: 2532 - RNA, 17 nt, Artificial Sequence
  Synthetic
aaaagcgagggggagag

SEQ ID NO: 2533 - RNA, 17 nt, Artificial Sequence
  Synthetic
aaagcgagggggagaga

SEQ ID NO: 2534 - RNA, 17 nt, Artificial Sequence
  Synthetic
aagcgagggggagagag

SEQ ID NO: 2535 - RNA, 17 nt, Artificial Sequence
  Synthetic
aaaaccuccgagagucg

SEQ ID NO: 2536 - RNA, 17 nt, Artificial Sequence
  Synthetic
cgagguaaaagagauaa

SEQ ID NO: 2537 - RNA, 17 nt, Artificial Sequence
  Synthetic
gagguaaaagagauaaa

SEQ ID NO: 2538 - RNA, 17 nt, Artificial Sequence
  Synthetic
agguaaaagagauaaag

SEQ ID NO: 2539 - RNA, 17 nt, Artificial Sequence
  Synthetic
gguaaaagagauaaagg

SEQ ID NO: 2540 - RNA, 17 nt, Artificial Sequence
  Synthetic
aaaacccucaucccauc

SEQ ID NO: 2541 - RNA, 17 nt, Artificial Sequence
  Synthetic
uauuucucuuuucgaaa

SEQ ID NO: 2542 - RNA, 17 nt, Artificial Sequence
  Synthetic
aauaaugaacaaugcua

SEQ ID NO: 2543 - RNA, 17 nt, Artificial Sequence
  Synthetic
caacucacaugcaaacc

SEQ ID NO: 2544 - RNA, 17 nt, Artificial Sequence
  Synthetic
aacucacaugcaaaccu

SEQ ID NO: 2545 - RNA, 17 nt, Artificial Sequence
  Synthetic
acucacaugcaaaccug

SEQ ID NO: 2546 - RNA, 17 nt, Artificial Sequence
  Synthetic
cucacaugcaaaccugg

SEQ ID NO: 2547 - RNA, 17 nt, Artificial Sequence
  Synthetic
acaugcaaaccuggggg

SEQ ID NO: 2548 - RNA, 17 nt, Artificial Sequence
  Synthetic
caugcaaaccugggggu

SEQ ID NO: 2549 - RNA, 17 nt, Artificial Sequence
  Synthetic
aaccugggggugggagc

SEQ ID NO: 2550 - RNA, 17 nt, Artificial Sequence
  Synthetic
cugggggugggagcugg

SEQ ID NO: 2551 - RNA, 17 nt, Artificial Sequence
  Synthetic
ugggggugggagcuggu

SEQ ID NO: 2552 - RNA, 17 nt, Artificial Sequence
  Synthetic
gggggugggagcuggug

SEQ ID NO: 2553 - RNA, 17 nt, Artificial Sequence
  Synthetic
ugggagcugguggggaa

SEQ ID NO: 2554 - RNA, 17 nt, Artificial Sequence
  Synthetic
gggagcugguggggaaa

SEQ ID NO: 2555 - RNA, 17 nt, Artificial Sequence
  Synthetic
agcugguggggaaaggg

SEQ ID NO: 2556 - RNA, 17 nt, Artificial Sequence
  Synthetic
cacucaccguaagaaaa

SEQ ID NO: 2557 - RNA, 17 nt, Artificial Sequence
  Synthetic
acucaccguaagaaaau

SEQ ID NO: 2558 - RNA, 17 nt, Artificial Sequence
  Synthetic
cucaccguaagaaaaug

SEQ ID NO: 2559 - RNA, 17 nt, Artificial Sequence
  Synthetic
ucaccguaagaaaaugg

SEQ ID NO: 2560 - RNA, 17 nt, Artificial Sequence
  Synthetic
caccguaagaaaauggg

SEQ ID NO: 2561 - RNA, 17 nt, Artificial Sequence
  Synthetic
accguaagaaaaugggg

SEQ ID NO: 2562 - RNA, 17 nt, Artificial Sequence
  Synthetic
uaagaaaaugggggggu

SEQ ID NO: 2563 - RNA, 17 nt, Artificial Sequence
  Synthetic
aagaaaaugggggggua

SEQ ID NO: 2564 - RNA, 17 nt, Artificial Sequence
  Synthetic
aaaauggggggguaggg

SEQ ID NO: 2565 - RNA, 17 nt, Artificial Sequence
  Synthetic
aaauggggggguaggga

SEQ ID NO: 2566 - RNA, 17 nt, Artificial Sequence
  Synthetic
gucuaaaaaacgauucc

SEQ ID NO: 2567 - RNA, 17 nt, Artificial Sequence
  Synthetic
ucuaaaaaacgauuccc

SEQ ID NO: 2568 - RNA, 17 nt, Artificial Sequence
  Synthetic
cuaaaaaacgauucccg

SEQ ID NO: 2569 - RNA, 17 nt, Artificial Sequence
  Synthetic
auucccggggagaaaag

SEQ ID NO: 2570 - RNA, 17 nt, Artificial Sequence
  Synthetic
gagaaaagaggugagac

SEQ ID NO: 2571 - RNA, 17 nt, Artificial Sequence
  Synthetic
gaggugagacuggcuuu

SEQ ID NO: 2572 - RNA, 17 nt, Artificial Sequence
  Synthetic
ggacaccagcgcgcuca

SEQ ID NO: 2573 - RNA, 17 nt, Artificial Sequence
  Synthetic
cacggucaagugugcag

SEQ ID NO: 2574 - RNA, 17 nt, Artificial Sequence
  Synthetic
acggucaagugugcagc

SEQ ID NO: 2575 - RNA, 17 nt, Artificial Sequence
  Synthetic
gucaagugugcagcggg

SEQ ID NO: 2576 - RNA, 17 nt, Artificial Sequence
  Synthetic
ccacaauagugagaaag

SEQ ID NO: 2577 - RNA, 17 nt, Artificial Sequence
  Synthetic
gugagaaaguggcacug

SEQ ID NO: 2578 - RNA, 17 nt, Artificial Sequence
  Synthetic
aaaguggcacuguggaa

SEQ ID NO: 2579 - RNA, 17 nt, Artificial Sequence
  Synthetic
aaguggcacuguggaaa

SEQ ID NO: 2580 - RNA, 17 nt, Artificial Sequence
  Synthetic
aguggcacuguggaaag

SEQ ID NO: 2581 - RNA, 17 nt, Artificial Sequence
  Synthetic
cuguggaaaggggcccc

SEQ ID NO: 2582 - RNA, 17 nt, Artificial Sequence
  Synthetic
cggcgcuccugaguccg

SEQ ID NO: 2583 - RNA, 17 nt, Artificial Sequence
  Synthetic
uccugaguccgcggagu

SEQ ID NO: 2584 - RNA, 17 nt, Artificial Sequence
  Synthetic
ccugaguccgcggaguc

SEQ ID NO: 2585 - RNA, 17 nt, Artificial Sequence
  Synthetic
guccgcggagucgggag

SEQ ID NO: 2586 - RNA, 17 nt, Artificial Sequence
  Synthetic
uccgcggagucgggaga

SEQ ID NO: 2587 - RNA, 17 nt, Artificial Sequence
  Synthetic
ccgcggagucgggagag

SEQ ID NO: 2588 - RNA, 17 nt, Artificial Sequence
  Synthetic
agucgggagaggggccg

SEQ ID NO: 2589 - RNA, 17 nt, Artificial Sequence
  Synthetic
gagaggggccgcggcga

SEQ ID NO: 2590 - RNA, 17 nt, Artificial Sequence
  Synthetic
agaggggccgcggcgac

SEQ ID NO: 2591 - RNA, 17 nt, Artificial Sequence
  Synthetic
gaggggccgcggcgacg

SEQ ID NO: 2592 - RNA, 17 nt, Artificial Sequence
  Synthetic
ggcgacggggagagccg

SEQ ID NO: 2593 - RNA, 17 nt, Artificial Sequence
  Synthetic
gcgacggggagagccgu

SEQ ID NO: 2594 - RNA, 17 nt, Artificial Sequence
  Synthetic
ggggagagccgugggac

SEQ ID NO: 2595 - RNA, 17 nt, Artificial Sequence
  Synthetic
gggagagccgugggacc

SEQ ID NO: 2596 - RNA, 17 nt, Artificial Sequence
  Synthetic
gagccgugggaccggga

SEQ ID NO: 2597 - RNA, 17 nt, Artificial Sequence
  Synthetic
cgugggaccgggaagga

SEQ ID NO: 2598 - RNA, 17 nt, Artificial Sequence
  Synthetic
gugggaccgggaaggac

SEQ ID NO: 2599 - RNA, 17 nt, Artificial Sequence
  Synthetic
gggaaggacgggagacg

SEQ ID NO: 2600 - RNA, 17 nt, Artificial Sequence
  Synthetic
aggacgggagacgcggc

SEQ ID NO: 2601 - RNA, 17 nt, Artificial Sequence
  Synthetic
acugccgccuuuuguuc

SEQ ID NO: 2602 - RNA, 17 nt, Artificial Sequence
  Synthetic
ccuuuuguuccggccag

SEQ ID NO: 2603 - RNA, 17 nt, Artificial Sequence
  Synthetic
uuuguuccggccagagg

SEQ ID NO: 2604 - RNA, 17 nt, Artificial Sequence
  Synthetic
uuguuccggccagaggu

SEQ ID NO: 2605 - RNA, 17 nt, Artificial Sequence
  Synthetic
cccgcugccuuuugugc

SEQ ID NO: 2606 - RNA, 17 nt, Artificial Sequence
  Synthetic
gccgccgccgccgccga

SEQ ID NO: 2607 - RNA, 17 nt, Artificial Sequence
  Synthetic
ccgccgccgccgccgaa

SEQ ID NO: 2608 - RNA, 17 nt, Artificial Sequence
  Synthetic
cgccgccgccgaagggc

SEQ ID NO: 2609 - RNA, 17 nt, Artificial Sequence
  Synthetic
gccgaagggcaggagcu

SEQ ID NO: 2610 - RNA, 17 nt, Artificial Sequence
  Synthetic
ccgaagggcaggagcua

SEQ ID NO: 2611 - RNA, 17 nt, Artificial Sequence
  Synthetic
agggcaggagcuagggc

SEQ ID NO: 2612 - RNA, 17 nt, Artificial Sequence
  Synthetic
gggcaggagcuagggcc

SEQ ID NO: 2613 - RNA, 17 nt, Artificial Sequence
  Synthetic
ggcaggagcuagggccg

SEQ ID NO: 2614 - RNA, 17 nt, Artificial Sequence
  Synthetic
gcaggagcuagggccgg

SEQ ID NO: 2615 - RNA, 17 nt, Artificial Sequence
  Synthetic
ggagcuagggccggggg

SEQ ID NO: 2616 - RNA, 17 nt, Artificial Sequence
  Synthetic
gcuagggccgggggagg

SEQ ID NO: 2617 - RNA, 17 nt, Artificial Sequence
  Synthetic
agggccgggggaggagg

SEQ ID NO: 2618 - RNA, 17 nt, Artificial Sequence
  Synthetic
ccgggggaggaggcggc

SEQ ID NO: 2619 - RNA, 17 nt, Artificial Sequence
  Synthetic
cgggggaggaggcggcc

SEQ ID NO: 2620 - RNA, 17 nt, Artificial Sequence
  Synthetic
gggggaggaggcggccg

SEQ ID NO: 2621 - RNA, 17 nt, Artificial Sequence
  Synthetic
ggggaggaggcggccgg

SEQ ID NO: 2622 - RNA, 17 nt, Artificial Sequence
  Synthetic
aggcggccgggggcacg

SEQ ID NO: 2623 - RNA, 17 nt, Artificial Sequence
  Synthetic
ggcggccgggggcacgc

SEQ ID NO: 2624 - RNA, 17 nt, Artificial Sequence
  Synthetic
ccgggggcacgcgggag

SEQ ID NO: 2625 - RNA, 17 nt, Artificial Sequence
  Synthetic
cgggggcacgcgggaga

SEQ ID NO: 2626 - RNA, 17 nt, Artificial Sequence
  Synthetic
gggcacgcgggagaggg

SEQ ID NO: 2627 - RNA, 17 nt, Artificial Sequence
  Synthetic
ggcacgcgggagaggga

SEQ ID NO: 2628 - RNA, 17 nt, Artificial Sequence
  Synthetic
acgcgggagagggaggg

SEQ ID NO: 2629 - RNA, 17 nt, Artificial Sequence
  Synthetic
cgcgggagagggaggga

SEQ ID NO: 2630 - RNA, 17 nt, Artificial Sequence
  Synthetic
gagggagggagggagcc

SEQ ID NO: 2631 - RNA, 17 nt, Artificial Sequence
  Synthetic
cccggacugcugccucc

SEQ ID NO: 2632 - RNA, 17 nt, Artificial Sequence
  Synthetic
ccggacugcugccuccu

SEQ ID NO: 2633 - RNA, 17 nt, Artificial Sequence
  Synthetic
ucccgaccgaaccucag

SEQ ID NO: 2634 - RNA, 17 nt, Artificial Sequence
  Synthetic
gaaccucagaggcagca

SEQ ID NO: 2635 - RNA, 17 nt, Artificial Sequence
  Synthetic
ggcagcaaggagaagac

SEQ ID NO: 2636 - RNA, 17 nt, Artificial Sequence
  Synthetic
auaaaauaaauaaaaca

SEQ ID NO: 2637 - RNA, 20 nt, Artificial Sequence
  Synthetic
cagucuucuccuugcugccu

SEQ ID NO: 2638 - RNA, 20 nt, Artificial Sequence
  Synthetic
uugcugccucugagguucgg

SEQ ID NO: 2639 - RNA, 20 nt, Artificial Sequence
  Synthetic
ugcugccucugagguucggu

SEQ ID NO: 2640 - RNA, 20 nt, Artificial Sequence
  Synthetic
gcugccucugagguucgguc

SEQ ID NO: 2641 - RNA, 20 nt, Artificial Sequence
  Synthetic
ugccucugagguucggucgg

SEQ ID NO: 2642 - RNA, 20 nt, Artificial Sequence
  Synthetic
gccucugagguucggucggg

SEQ ID NO: 2643 - RNA, 20 nt, Artificial Sequence
  Synthetic
ccucugagguucggucggga

SEQ ID NO: 2644 - RNA, 20 nt, Artificial Sequence
  Synthetic
cucugagguucggucgggag

SEQ ID NO: 2645 - RNA, 20 nt, Artificial Sequence
  Synthetic
cugagguucggucgggaggg

SEQ ID NO: 2646 - RNA, 20 nt, Artificial Sequence
  Synthetic
aggggagggcagcggcaacc

SEQ ID NO: 2647 - RNA, 20 nt, Artificial Sequence
  Synthetic
ggggagggcagcggcaaccc

SEQ ID NO: 2648 - RNA, 20 nt, Artificial Sequence
  Synthetic
gcaacccaggaggcagcagu

SEQ ID NO: 2649 - RNA, 20 nt, Artificial Sequence
  Synthetic
gcggcggcggcggcggcggc

SEQ ID NO: 2650 - RNA, 20 nt, Artificial Sequence
  Synthetic
cggcggcggcggcggcggcg

SEQ ID NO: 2651 - RNA, 20 nt, Artificial Sequence
  Synthetic
ggcggcggcggcggcggcgc

SEQ ID NO: 2652 - RNA, 20 nt, Artificial Sequence
  Synthetic
cggcggcggcggcggcgcgg

SEQ ID NO: 2653 - RNA, 20 nt, Artificial Sequence
  Synthetic
ggcggcgcgggagggcaagc

SEQ ID NO: 2654 - RNA, 20 nt, Artificial Sequence
  Synthetic
cggcgcgggagggcaagcgc

SEQ ID NO: 2655 - RNA, 20 nt, Artificial Sequence
  Synthetic
ggcgcgggagggcaagcgcg

SEQ ID NO: 2656 - RNA, 20 nt, Artificial Sequence
  Synthetic
aggagccggcacaaaaggca

SEQ ID NO: 2657 - RNA, 20 nt, Artificial Sequence
  Synthetic
ggagccggcacaaaaggcag

SEQ ID NO: 2658 - RNA, 20 nt, Artificial Sequence
  Synthetic
ggacaaacacccaccucugg

SEQ ID NO: 2659 - RNA, 20 nt, Artificial Sequence
  Synthetic
gacaaacacccaccucuggc

SEQ ID NO: 2660 - RNA, 20 nt, Artificial Sequence
  Synthetic
gcggccccucucccgacucc

SEQ ID NO: 2661 - RNA, 20 nt, Artificial Sequence
  Synthetic
cucucccgacuccgcggacu

SEQ ID NO: 2662 - RNA, 20 nt, Artificial Sequence
  Synthetic
ucucccgacuccgcggacuc

SEQ ID NO: 2663 - RNA, 20 nt, Artificial Sequence
  Synthetic
acuccgcggacucaggagcg

SEQ ID NO: 2664 - RNA, 20 nt, Artificial Sequence
  Synthetic
cuccgcggacucaggagcgc

SEQ ID NO: 2665 - RNA, 20 nt, Artificial Sequence
  Synthetic
uccgcggacucaggagcgcc

SEQ ID NO: 2666 - RNA, 20 nt, Artificial Sequence
  Synthetic
agugccacuuucucacuauu

SEQ ID NO: 2667 - RNA, 20 nt, Artificial Sequence
  Synthetic
gugccacuuucucacuauug

SEQ ID NO: 2668 - RNA, 20 nt, Artificial Sequence
  Synthetic
ugccacuuucucacuauugu

SEQ ID NO: 2669 - RNA, 20 nt, Artificial Sequence
  Synthetic
cucccgcugcacacuugacc

SEQ ID NO: 2670 - RNA, 20 nt, Artificial Sequence
  Synthetic
cagucucaccucuuuucucc

SEQ ID NO: 2671 - RNA, 20 nt, Artificial Sequence
  Synthetic
agucucaccucuuuucuccc

SEQ ID NO: 2672 - RNA, 20 nt, Artificial Sequence
  Synthetic
gucucaccucuuuucucccc

SEQ ID NO: 2673 - RNA, 20 nt, Artificial Sequence
  Synthetic
uacccccccauuuucuuacg

SEQ ID NO: 2674 - RNA, 20 nt, Artificial Sequence
  Synthetic
cccccauuuucuuacgguga

SEQ ID NO: 2675 - RNA, 20 nt, Artificial Sequence
  Synthetic
ccccauuuucuuacggugag

SEQ ID NO: 2676 - RNA, 20 nt, Artificial Sequence
  Synthetic
cccauuuucuuacggugagu

SEQ ID NO: 2677 - RNA, 20 nt, Artificial Sequence
  Synthetic
ucccacccccagguuugcau

SEQ ID NO: 2678 - RNA, 20 nt, Artificial Sequence
  Synthetic
uucauuauuuugcaaaacug

SEQ ID NO: 2679 - RNA, 20 nt, Artificial Sequence
  Synthetic
ucauuauuuugcaaaacugg

SEQ ID NO: 2680 - RNA, 20 nt, Artificial Sequence
  Synthetic
uauuuugcaaaacuggcggg

SEQ ID NO: 2681 - RNA, 20 nt, Artificial Sequence
  Synthetic
auuuugcaaaacuggcgggg

SEQ ID NO: 2682 - RNA, 20 nt, Artificial Sequence
  Synthetic
uuuugcaaaacuggcggggc

SEQ ID NO: 2683 - RNA, 20 nt, Artificial Sequence
  Synthetic
uuugcaaaacuggcggggcg

SEQ ID NO: 2684 - RNA, 20 nt, Artificial Sequence
  Synthetic
uugcaaaacuggcggggcgg

SEQ ID NO: 2685 - RNA, 20 nt, Artificial Sequence
  Synthetic
ugcaaaacuggcggggcggg

SEQ ID NO: 2686 - RNA, 20 nt, Artificial Sequence
  Synthetic
gcaaaacuggcggggcgggg

SEQ ID NO: 2687 - RNA, 20 nt, Artificial Sequence
  Synthetic
caaaacuggcggggcggggg

SEQ ID NO: 2688 - RNA, 20 nt, Artificial Sequence
  Synthetic
acuggcggggcgggggggga

SEQ ID NO: 2689 - RNA, 20 nt, Artificial Sequence
  Synthetic
cuggcggggcggggggggag

SEQ ID NO: 2690 - RNA, 20 nt, Artificial Sequence
  Synthetic
uggaaucauugcauuccuuu

SEQ ID NO: 2691 - RNA, 20 nt, Artificial Sequence
  Synthetic
ucauugcauuccuuuucgaa

SEQ ID NO: 2692 - RNA, 20 nt, Artificial Sequence
  Synthetic
auugcauuccuuuucgaaaa

SEQ ID NO: 2693 - RNA, 20 nt, Artificial Sequence
  Synthetic
ucgaaaagagaaauaaagcg

SEQ ID NO: 2694 - RNA, 20 nt, Artificial Sequence
  Synthetic
cgaaaagagaaauaaagcgg

SEQ ID NO: 2695 - RNA, 20 nt, Artificial Sequence
  Synthetic
aagagaaauaaagcggcgga

SEQ ID NO: 2696 - RNA, 20 nt, Artificial Sequence
  Synthetic
agagaaauaaagcggcggaa

SEQ ID NO: 2697 - RNA, 20 nt, Artificial Sequence
  Synthetic
agaaauaaagcggcggaaag

SEQ ID NO: 2698 - RNA, 20 nt, Artificial Sequence
  Synthetic
gaaauaaagcggcggaaagg

SEQ ID NO: 2699 - RNA, 20 nt, Artificial Sequence
  Synthetic
uaaagcggcggaaaggagga

SEQ ID NO: 2700 - RNA, 20 nt, Artificial Sequence
  Synthetic
aagcggcggaaaggaggaaa

SEQ ID NO: 2701 - RNA, 20 nt, Artificial Sequence
  Synthetic
agcggcggaaaggaggaaag

SEQ ID NO: 2702 - RNA, 20 nt, Artificial Sequence
  Synthetic
cggcggaaaggaggaaagag

SEQ ID NO: 2703 - RNA, 20 nt, Artificial Sequence
  Synthetic
ggcggaaaggaggaaagagg

SEQ ID NO: 2704 - RNA, 20 nt, Artificial Sequence
  Synthetic
auacacggcaaugguuccag

SEQ ID NO: 2705 - RNA, 20 nt, Artificial Sequence
  Synthetic
uacacggcaaugguuccaga

SEQ ID NO: 2706 - RNA, 20 nt, Artificial Sequence
  Synthetic
cggcaaugguuccagauggg

SEQ ID NO: 2707 - RNA, 20 nt, Artificial Sequence
  Synthetic
gcaaugguuccagaugggau

SEQ ID NO: 2708 - RNA, 20 nt, Artificial Sequence
  Synthetic
uaucucuuuuaccucgacuc

SEQ ID NO: 2709 - RNA, 20 nt, Artificial Sequence
  Synthetic
aucucuuuuaccucgacucu

SEQ ID NO: 2710 - RNA, 20 nt, Artificial Sequence
  Synthetic
gacucucggagguuuuucuc

SEQ ID NO: 2711 - RNA, 20 nt, Artificial Sequence
  Synthetic
aauaauuauuauuacuauua

SEQ ID NO: 2712 - RNA, 20 nt, Artificial Sequence
  Synthetic
acuauuauuggguuacuuac

SEQ ID NO: 2713 - RNA, 20 nt, Artificial Sequence
  Synthetic
uauuauuggguuacuuacgc

SEQ ID NO: 2714 - RNA, 17 nt, Artificial Sequence
  Synthetic
ucuucuccuugcugccu

SEQ ID NO: 2715 - RNA, 17 nt, Artificial Sequence
  Synthetic
cugccucugagguucgg

SEQ ID NO: 2716 - RNA, 17 nt, Artificial Sequence
  Synthetic
ugccucugagguucggu

SEQ ID NO: 2717 - RNA, 17 nt, Artificial Sequence
  Synthetic
gccucugagguucgguc

SEQ ID NO: 2718 - RNA, 17 nt, Artificial Sequence
  Synthetic
cucugagguucggucgg

SEQ ID NO: 2719 - RNA, 17 nt, Artificial Sequence
  Synthetic
ucugagguucggucggg

SEQ ID NO: 2720 - RNA, 17 nt, Artificial Sequence
  Synthetic
cugagguucggucggga

SEQ ID NO: 2721 - RNA, 17 nt, Artificial Sequence
  Synthetic
ugagguucggucgggag

SEQ ID NO: 2722 - RNA, 17 nt, Artificial Sequence
  Synthetic
agguucggucgggaggg

SEQ ID NO: 2723 - RNA, 17 nt, Artificial Sequence
  Synthetic
ggagggcagcggcaacc

SEQ ID NO: 2724 - RNA, 17 nt, Artificial Sequence
  Synthetic
gagggcagcggcaaccc

SEQ ID NO: 2725 - RNA, 17 nt, Artificial Sequence
  Synthetic
acccaggaggcagcagu

SEQ ID NO: 2726 - RNA, 17 nt, Artificial Sequence
  Synthetic
gcggcggcggcggcggc

SEQ ID NO: 2727 - RNA, 17 nt, Artificial Sequence
  Synthetic
cggcggcggcggcggcg

SEQ ID NO: 2728 - RNA, 17 nt, Artificial Sequence
  Synthetic
ggcggcggcggcggcgc

SEQ ID NO: 2729 - RNA, 17 nt, Artificial Sequence
  Synthetic
cggcggcggcggcgcgg

SEQ ID NO: 2730 - RNA, 17 nt, Artificial Sequence
  Synthetic
ggcgcgggagggcaagc

SEQ ID NO: 2731 - RNA, 17 nt, Artificial Sequence
  Synthetic
cgcgggagggcaagcgc

SEQ ID NO: 2732 - RNA, 17 nt, Artificial Sequence
  Synthetic
gcgggagggcaagcgcg

SEQ ID NO: 2733 - RNA, 17 nt, Artificial Sequence
  Synthetic
agccggcacaaaaggca

SEQ ID NO: 2734 - RNA, 17 nt, Artificial Sequence
  Synthetic
gccggcacaaaaggcag

SEQ ID NO: 2735 - RNA, 17 nt, Artificial Sequence
  Synthetic
caaacacccaccucugg

SEQ ID NO: 2736 - RNA, 17 nt, Artificial Sequence
  Synthetic
aaacacccaccucuggc

SEQ ID NO: 2737 - RNA, 17 nt, Artificial Sequence
  Synthetic
gccccucucccgacucc

SEQ ID NO: 2738 - RNA, 17 nt, Artificial Sequence
  Synthetic
ucccgacuccgcggacu

SEQ ID NO: 2739 - RNA, 17 nt, Artificial Sequence
  Synthetic
cccgacuccgcggacuc

SEQ ID NO: 2740 - RNA, 17 nt, Artificial Sequence
  Synthetic
ccgcggacucaggagcg

SEQ ID NO: 2741 - RNA, 17 nt, Artificial Sequence
  Synthetic
cgcggacucaggagcgc

SEQ ID NO: 2742 - RNA, 17 nt, Artificial Sequence
  Synthetic
gcggacucaggagcgcc

SEQ ID NO: 2743 - RNA, 17 nt, Artificial Sequence
  Synthetic
gccacuuucucacuauu

SEQ ID NO: 2744 - RNA, 17 nt, Artificial Sequence
  Synthetic
ccacuuucucacuauug

SEQ ID NO: 2745 - RNA, 17 nt, Artificial Sequence
  Synthetic
cacuuucucacuauugu

SEQ ID NO: 2746 - RNA, 17 nt, Artificial Sequence
  Synthetic
ccgcugcacacuugacc

SEQ ID NO: 2747 - RNA, 17 nt, Artificial Sequence
  Synthetic
ucucaccucuuuucucc

SEQ ID NO: 2748 - RNA, 17 nt, Artificial Sequence
  Synthetic
cucaccucuuuucuccc

SEQ ID NO: 2749 - RNA, 17 nt, Artificial Sequence
  Synthetic
ucaccucuuuucucccc

SEQ ID NO: 2750 - RNA, 17 nt, Artificial Sequence
  Synthetic
ccccccauuuucuuacg

SEQ ID NO: 2751 - RNA, 17 nt, Artificial Sequence
  Synthetic
ccauuuucuuacgguga

SEQ ID NO: 2752 - RNA, 17 nt, Artificial Sequence
  Synthetic
cauuuucuuacggugag

SEQ ID NO: 2753 - RNA, 17 nt, Artificial Sequence
  Synthetic
auuuucuuacggugagu

SEQ ID NO: 2754 - RNA, 17 nt, Artificial Sequence
  Synthetic
cacccccagguuugcau

SEQ ID NO: 2755 - RNA, 17 nt, Artificial Sequence
  Synthetic
auuauuuugcaaaacug

SEQ ID NO: 2756 - RNA, 17 nt, Artificial Sequence
  Synthetic
uuauuuugcaaaacugg

SEQ ID NO: 2757 - RNA, 17 nt, Artificial Sequence
  Synthetic
uuugcaaaacuggcggg

SEQ ID NO: 2758 - RNA, 17 nt, Artificial Sequence
  Synthetic
uugcaaaacuggcgggg

SEQ ID NO: 2759 - RNA, 17 nt, Artificial Sequence
  Synthetic
ugcaaaacuggcggggc

SEQ ID NO: 2760 - RNA, 17 nt, Artificial Sequence
  Synthetic
gcaaaacuggcggggcg

SEQ ID NO: 2761 - RNA, 17 nt, Artificial Sequence
  Synthetic
caaaacuggcggggcgg

SEQ ID NO: 2762 - RNA, 17 nt, Artificial Sequence
  Synthetic
aaaacuggcggggcggg

SEQ ID NO: 2763 - RNA, 17 nt, Artificial Sequence
  Synthetic
aaacuggcggggcgggg

SEQ ID NO: 2764 - RNA, 17 nt, Artificial Sequence
  Synthetic
aacuggcggggcggggg

SEQ ID NO: 2765 - RNA, 17 nt, Artificial Sequence
  Synthetic
ggcggggcgggggggga

SEQ ID NO: 2766 - RNA, 17 nt, Artificial Sequence
  Synthetic
gcggggcggggggggag

SEQ ID NO: 2767 - RNA, 17 nt, Artificial Sequence
  Synthetic
aaucauugcauuccuuu

SEQ ID NO: 2768 - RNA, 17 nt, Artificial Sequence
  Synthetic
uugcauuccuuuucgaa

SEQ ID NO: 2769 - RNA, 17 nt, Artificial Sequence
  Synthetic
gcauuccuuuucgaaaa

SEQ ID NO: 2770 - RNA, 17 nt, Artificial Sequence
  Synthetic
aaaagagaaauaaagcg

SEQ ID NO: 2771 - RNA, 17 nt, Artificial Sequence
  Synthetic
aaagagaaauaaagcgg

SEQ ID NO: 2772 - RNA, 17 nt, Artificial Sequence
  Synthetic
agaaauaaagcggcgga

SEQ ID NO: 2773 - RNA, 17 nt, Artificial Sequence
  Synthetic
gaaauaaagcggcggaa

SEQ ID NO: 2774 - RNA, 17 nt, Artificial Sequence
  Synthetic
aauaaagcggcggaaag

SEQ ID NO: 2775 - RNA, 17 nt, Artificial Sequence
  Synthetic
auaaagcggcggaaagg

SEQ ID NO: 2776 - RNA, 17 nt, Artificial Sequence
  Synthetic
agcggcggaaaggagga

SEQ ID NO: 2777 - RNA, 17 nt, Artificial Sequence
  Synthetic
cggcggaaaggaggaaa

SEQ ID NO: 2778 - RNA, 17 nt, Artificial Sequence
  Synthetic
ggcggaaaggaggaaag

SEQ ID NO: 2779 - RNA, 17 nt, Artificial Sequence
  Synthetic
cggaaaggaggaaagag

SEQ ID NO: 2780 - RNA, 17 nt, Artificial Sequence
  Synthetic
ggaaaggaggaaagagg

SEQ ID NO: 2781 - RNA, 17 nt, Artificial Sequence
  Synthetic
cacggcaaugguuccag

SEQ ID NO: 2782 - RNA, 17 nt, Artificial Sequence
  Synthetic
acggcaaugguuccaga

SEQ ID NO: 2783 - RNA, 17 nt, Artificial Sequence
  Synthetic
caaugguuccagauggg

SEQ ID NO: 2784 - RNA, 17 nt, Artificial Sequence
  Synthetic
augguuccagaugggau

SEQ ID NO: 2785 - RNA, 17 nt, Artificial Sequence
  Synthetic
cucuuuuaccucgacuc

SEQ ID NO: 2786 - RNA, 17 nt, Artificial Sequence
  Synthetic
ucuuuuaccucgacucu

SEQ ID NO: 2787 - RNA, 17 nt, Artificial Sequence
  Synthetic
ucucggagguuuuucuc

SEQ ID NO: 2788 - RNA, 17 nt, Artificial Sequence
  Synthetic
aauuauuauuacuauua

SEQ ID NO: 2789 - RNA, 17 nt, Artificial Sequence
  Synthetic
auuauuggguuacuuac

SEQ ID NO: 2790 - RNA, 17 nt, Artificial Sequence
  Synthetic
uauuggguuacuuacgc

SEQ ID NO: 2791 - RNA, 20 nt, Artificial Sequence
  Synthetic
cgaaccucagaggcagcaag

SEQ ID NO: 2792 - RNA, 20 nt, Artificial Sequence
  Synthetic
accgaaccucagaggcagca

SEQ ID NO: 2793 - RNA, 20 nt, Artificial Sequence
  Synthetic
gaccgaaccucagaggcagc

SEQ ID NO: 2794 - RNA, 20 nt, Artificial Sequence
  Synthetic
cuccccucccgaccgaaccu

SEQ ID NO: 2795 - RNA, 20 nt, Artificial Sequence
  Synthetic
ccgcugcccuccccucccga

SEQ ID NO: 2796 - RNA, 20 nt, Artificial Sequence
  Synthetic
ggagcccggacugcugccuc

SEQ ID NO: 2797 - RNA, 20 nt, Artificial Sequence
  Synthetic
gggagagggagggagggagc

SEQ ID NO: 2798 - RNA, 20 nt, Artificial Sequence
  Synthetic
gcacgcgggagagggaggga

SEQ ID NO: 2799 - RNA, 20 nt, Artificial Sequence
  Synthetic
ggcacgcgggagagggaggg

SEQ ID NO: 2800 - RNA, 20 nt, Artificial Sequence
  Synthetic
gggcacgcgggagagggagg

SEQ ID NO: 2801 - RNA, 20 nt, Artificial Sequence
  Synthetic
gggggcacgcgggagaggga

SEQ ID NO: 2802 - RNA, 20 nt, Artificial Sequence
  Synthetic
cgggggcacgcgggagaggg

SEQ ID NO: 2803 - RNA, 20 nt, Artificial Sequence
  Synthetic
ccgggggcacgcgggagagg

SEQ ID NO: 2804 - RNA, 20 nt, Artificial Sequence
  Synthetic
ggccgggggcacgcgggaga

SEQ ID NO: 2805 - RNA, 20 nt, Artificial Sequence
  Synthetic
cggccgggggcacgcgggag

SEQ ID NO: 2806 - RNA, 20 nt, Artificial Sequence
  Synthetic
gcggccgggggcacgcggga

SEQ ID NO: 2807 - RNA, 20 nt, Artificial Sequence
  Synthetic
aggcggccgggggcacgcgg

SEQ ID NO: 2808 - RNA, 20 nt, Artificial Sequence
  Synthetic
ggaggcggccgggggcacgc

SEQ ID NO: 2809 - RNA, 20 nt, Artificial Sequence
  Synthetic
aggaggcggccgggggcacg

SEQ ID NO: 2810 - RNA, 20 nt, Artificial Sequence
  Synthetic
gaggaggcggccgggggcac

SEQ ID NO: 2811 - RNA, 20 nt, Artificial Sequence
  Synthetic
ggccgggggaggaggcggcc

SEQ ID NO: 2812 - RNA, 20 nt, Artificial Sequence
  Synthetic
gggccgggggaggaggcggc

SEQ ID NO: 2813 - RNA, 20 nt, Artificial Sequence
  Synthetic
agggccgggggaggaggcgg

SEQ ID NO: 2814 - RNA, 20 nt, Artificial Sequence
  Synthetic
gcaggagcuagggccggggg

SEQ ID NO: 2815 - RNA, 20 nt, Artificial Sequence
  Synthetic
ggcaggagcuagggccgggg

SEQ ID NO: 2816 - RNA, 20 nt, Artificial Sequence
  Synthetic
agggcaggagcuagggccgg

SEQ ID NO: 2817 - RNA, 20 nt, Artificial Sequence
  Synthetic
aagggcaggagcuagggccg

SEQ ID NO: 2818 - RNA, 20 nt, Artificial Sequence
  Synthetic
gaagggcaggagcuagggcc

SEQ ID NO: 2819 - RNA, 20 nt, Artificial Sequence
  Synthetic
cgaagggcaggagcuagggc

SEQ ID NO: 2820 - RNA, 20 nt, Artificial Sequence
  Synthetic
ccgaagggcaggagcuaggg

SEQ ID NO: 2821 - RNA, 20 nt, Artificial Sequence
  Synthetic
cgccgccgaagggcaggagc

SEQ ID NO: 2822 - RNA, 20 nt, Artificial Sequence
  Synthetic
cgccgccgccgccgaagggc

SEQ ID NO: 2823 - RNA, 20 nt, Artificial Sequence
  Synthetic
ccgccgccgccgccgaaggg

SEQ ID NO: 2824 - RNA, 20 nt, Artificial Sequence
  Synthetic
cgccgccgccgccgccgccg

SEQ ID NO: 2825 - RNA, 20 nt, Artificial Sequence
  Synthetic
cgccgccgccgccgccgccg

SEQ ID NO: 2826 - RNA, 20 nt, Artificial Sequence
  Synthetic
gccuuuuguuccggccagag

SEQ ID NO: 2827 - RNA, 20 nt, Artificial Sequence
  Synthetic
cugccgccuuuuguuccggc

SEQ ID NO: 2828 - RNA, 20 nt, Artificial Sequence
  Synthetic
gccgugggaccgggaaggac

SEQ ID NO: 2829 - RNA, 20 nt, Artificial Sequence
  Synthetic
agccgugggaccgggaagga

SEQ ID NO: 2830 - RNA, 20 nt, Artificial Sequence
  Synthetic
gagccgugggaccgggaagg

SEQ ID NO: 2831 - RNA, 20 nt, Artificial Sequence
  Synthetic
gggagagccgugggaccggg

SEQ ID NO: 2832 - RNA, 20 nt, Artificial Sequence
  Synthetic
acggggagagccgugggacc

SEQ ID NO: 2833 - RNA, 20 nt, Artificial Sequence
  Synthetic
gacggggagagccgugggac

SEQ ID NO: 2834 - RNA, 20 nt, Artificial Sequence
  Synthetic
cgacggggagagccguggga

SEQ ID NO: 2835 - RNA, 20 nt, Artificial Sequence
  Synthetic
cgcggcgacggggagagccg

SEQ ID NO: 2836 - RNA, 20 nt, Artificial Sequence
  Synthetic
ccgcggcgacggggagagcc

SEQ ID NO: 2837 - RNA, 20 nt, Artificial Sequence
  Synthetic
agaggggccgcggcgacggg

SEQ ID NO: 2838 - RNA, 20 nt, Artificial Sequence
  Synthetic
ggagaggggccgcggcgacg

SEQ ID NO: 2839 - RNA, 20 nt, Artificial Sequence
  Synthetic
gggagaggggccgcggcgac

SEQ ID NO: 2840 - RNA, 20 nt, Artificial Sequence
  Synthetic
cgggagaggggccgcggcga

SEQ ID NO: 2841 - RNA, 20 nt, Artificial Sequence
  Synthetic
ucgggagaggggccgcggcg

SEQ ID NO: 2842 - RNA, 20 nt, Artificial Sequence
  Synthetic
ugaguccgcggagucgggag

SEQ ID NO: 2843 - RNA, 20 nt, Artificial Sequence
  Synthetic
cugaguccgcggagucggga

SEQ ID NO: 2844 - RNA, 20 nt, Artificial Sequence
  Synthetic
uccugaguccgcggagucgg

SEQ ID NO: 2845 - RNA, 20 nt, Artificial Sequence
  Synthetic
gcuccugaguccgcggaguc

SEQ ID NO: 2846 - RNA, 20 nt, Artificial Sequence
  Synthetic
cgcuccugaguccgcggagu

SEQ ID NO: 2847 - RNA, 20 nt, Artificial Sequence
  Synthetic
gcgcuccugaguccgcggag

SEQ ID NO: 2848 - RNA, 20 nt, Artificial Sequence
  Synthetic
ccccggcgcuccugaguccg

SEQ ID NO: 2849 - RNA, 20 nt, Artificial Sequence
  Synthetic
cccccggcgcuccugagucc

SEQ ID NO: 2850 - RNA, 20 nt, Artificial Sequence
  Synthetic
gaaaggggcccccggcgcuc

SEQ ID NO: 2851 - RNA, 20 nt, Artificial Sequence
  Synthetic
gagaaaguggcacuguggaa

SEQ ID NO: 2852 - RNA, 20 nt, Artificial Sequence
  Synthetic
ugagaaaguggcacugugga

SEQ ID NO: 2853 - RNA, 20 nt, Artificial Sequence
  Synthetic
auagugagaaaguggcacug

SEQ ID NO: 2854 - RNA, 20 nt, Artificial Sequence
  Synthetic
aauagugagaaaguggcacu

SEQ ID NO: 2855 - RNA, 20 nt, Artificial Sequence
  Synthetic
guagucauccccacaauagu

SEQ ID NO: 2856 - RNA, 20 nt, Artificial Sequence
  Synthetic
aaguagucauccccacaaua

SEQ ID NO: 2857 - RNA, 20 nt, Artificial Sequence
  Synthetic
acggucaagugugcagcggg

SEQ ID NO: 2858 - RNA, 20 nt, Artificial Sequence
  Synthetic
cacggucaagugugcagcgg

SEQ ID NO: 2859 - RNA, 20 nt, Artificial Sequence
  Synthetic
cucacggucaagugugcagc

SEQ ID NO: 2860 - RNA, 20 nt, Artificial Sequence
  Synthetic
gcucacggucaagugugcag

SEQ ID NO: 2861 - RNA, 20 nt, Artificial Sequence
  Synthetic
cgcucacggucaagugugca

SEQ ID NO: 2862 - RNA, 20 nt, Artificial Sequence
  Synthetic
aaaagaggugagacuggcuu

SEQ ID NO: 2863 - RNA, 20 nt, Artificial Sequence
  Synthetic
gauucccggggagaaaagag

SEQ ID NO: 2864 - RNA, 20 nt, Artificial Sequence
  Synthetic
aaaacgauucccggggagaa

SEQ ID NO: 2865 - RNA, 20 nt, Artificial Sequence
  Synthetic
ucuaaaaaacgauucccggg

SEQ ID NO: 2866 - RNA, 20 nt, Artificial Sequence
  Synthetic
agucuaaaaaacgauucccg

SEQ ID NO: 2867 - RNA, 20 nt, Artificial Sequence
  Synthetic
aagucuaaaaaacgauuccc

SEQ ID NO: 2868 - RNA, 20 nt, Artificial Sequence
  Synthetic
caagucuaaaaaacgauucc

SEQ ID NO: 2869 - RNA, 20 nt, Artificial Sequence
  Synthetic
acaagucuaaaaaacgauuc

SEQ ID NO: 2870 - RNA, 20 nt, Artificial Sequence
  Synthetic
aauggggggguagggaggga

SEQ ID NO: 2871 - RNA, 20 nt, Artificial Sequence
  Synthetic
agaaaauggggggguaggga

SEQ ID NO: 2872 - RNA, 20 nt, Artificial Sequence
  Synthetic
aagaaaauggggggguaggg

SEQ ID NO: 2873 - RNA, 20 nt, Artificial Sequence
  Synthetic
uaagaaaauggggggguagg

SEQ ID NO: 2874 - RNA, 20 nt, Artificial Sequence
  Synthetic
cguaagaaaaugggggggua

SEQ ID NO: 2875 - RNA, 20 nt, Artificial Sequence
  Synthetic
ccguaagaaaaugggggggu

SEQ ID NO: 2876 - RNA, 20 nt, Artificial Sequence
  Synthetic
accguaagaaaauggggggg

SEQ ID NO: 2877 - RNA, 20 nt, Artificial Sequence
  Synthetic
cacucaccguaagaaaaugg

SEQ ID NO: 2878 - RNA, 20 nt, Artificial Sequence
  Synthetic
ccacucaccguaagaaaaug

SEQ ID NO: 2879 - RNA, 20 nt, Artificial Sequence
  Synthetic
cccacucaccguaagaaaau

SEQ ID NO: 2880 - RNA, 20 nt, Artificial Sequence
  Synthetic
ucccacucaccguaagaaaa

SEQ ID NO: 2881 - RNA, 20 nt, Artificial Sequence
  Synthetic
uucccacucaccguaagaaa

SEQ ID NO: 2882 - RNA, 20 nt, Artificial Sequence
  Synthetic
gguugcuucccacucaccgu

SEQ ID NO: 2883 - RNA, 20 nt, Artificial Sequence
  Synthetic
ggugggagcugguggggaaa

SEQ ID NO: 2884 - RNA, 20 nt, Artificial Sequence
  Synthetic
gggugggagcugguggggaa

SEQ ID NO: 2885 - RNA, 20 nt, Artificial Sequence
  Synthetic
ggggugggagcuggugggga

SEQ ID NO: 2886 - RNA, 20 nt, Artificial Sequence
  Synthetic
ccugggggugggagcuggug

SEQ ID NO: 2887 - RNA, 20 nt, Artificial Sequence
  Synthetic
accugggggugggagcuggu

SEQ ID NO: 2888 - RNA, 20 nt, Artificial Sequence
  Synthetic
aaccugggggugggagcugg

SEQ ID NO: 2889 - RNA, 20 nt, Artificial Sequence
  Synthetic
aaaccugggggugggagcug

SEQ ID NO: 2890 - RNA, 20 nt, Artificial Sequence
  Synthetic
ucacaugcaaaccugggggu

SEQ ID NO: 2891 - RNA, 20 nt, Artificial Sequence
  Synthetic
cucacaugcaaaccuggggg

SEQ ID NO: 2892 - RNA, 20 nt, Artificial Sequence
  Synthetic
acucacaugcaaaccugggg

SEQ ID NO: 2893 - RNA, 20 nt, Artificial Sequence
  Synthetic
aacaacucacaugcaaaccu

SEQ ID NO: 2894 - RNA, 20 nt, Artificial Sequence
  Synthetic
gaacaacucacaugcaaacc

SEQ ID NO: 2895 - RNA, 20 nt, Artificial Sequence
  Synthetic
cgaacaacucacaugcaaac

SEQ ID NO: 2896 - RNA, 20 nt, Artificial Sequence
  Synthetic
uaaugaacaaugcuaagguu

SEQ ID NO: 2897 - RNA, 20 nt, Artificial Sequence
  Synthetic
cccgccaguuuugcaaaaua

SEQ ID NO: 2898 - RNA, 20 nt, Artificial Sequence
  Synthetic
cuuuauuucucuuuucgaaa

SEQ ID NO: 2899 - RNA, 20 nt, Artificial Sequence
  Synthetic
gcuuuauuucucuuuucgaa

SEQ ID NO: 2900 - RNA, 20 nt, Artificial Sequence
  Synthetic
ccgccgcuuuauuucucuuu

SEQ ID NO: 2901 - RNA, 20 nt, Artificial Sequence
  Synthetic
ccauugccguguaugcacuu

SEQ ID NO: 2902 - RNA, 20 nt, Artificial Sequence
  Synthetic
gaaaaaacccucaucccauc

SEQ ID NO: 2903 - RNA, 20 nt, Artificial Sequence
  Synthetic
ggaaaaaacccucaucccau

SEQ ID NO: 2904 - RNA, 20 nt, Artificial Sequence
  Synthetic
cgagguaaaagagauaaagg

SEQ ID NO: 2905 - RNA, 20 nt, Artificial Sequence
  Synthetic
ucgagguaaaagagauaaag

SEQ ID NO: 2906 - RNA, 20 nt, Artificial Sequence
  Synthetic
gucgagguaaaagagauaaa

SEQ ID NO: 2907 - RNA, 20 nt, Artificial Sequence
  Synthetic
agucgagguaaaagagauaa

SEQ ID NO: 2908 - RNA, 20 nt, Artificial Sequence
  Synthetic
gagucgagguaaaagagaua

SEQ ID NO: 2909 - RNA, 20 nt, Artificial Sequence
  Synthetic
accuccgagagucgagguaa

SEQ ID NO: 2910 - RNA, 20 nt, Artificial Sequence
  Synthetic
acgagaaaaaccuccgagag

SEQ ID NO: 2911 - RNA, 20 nt, Artificial Sequence
  Synthetic
uuuucacgagaaaaaccucc

SEQ ID NO: 2912 - RNA, 20 nt, Artificial Sequence
  Synthetic
auuuuucacgagaaaaaccu

SEQ ID NO: 2913 - RNA, 20 nt, Artificial Sequence
  Synthetic
ugcauuuuuaaauuuuucac

SEQ ID NO: 2914 - RNA, 20 nt, Artificial Sequence
  Synthetic
caugcauuuuuaaauuuuuc

SEQ ID NO: 2915 - RNA, 20 nt, Artificial Sequence
  Synthetic
agcaaaagcgagggggagag

SEQ ID NO: 2916 - RNA, 20 nt, Artificial Sequence
  Synthetic
aagcaaaagcgagggggaga

SEQ ID NO: 2917 - RNA, 20 nt, Artificial Sequence
  Synthetic
agaagcaaaagcgaggggga

SEQ ID NO: 2918 - RNA, 20 nt, Artificial Sequence
  Synthetic
cuagaagcaaaagcgagggg

SEQ ID NO: 2919 - RNA, 20 nt, Artificial Sequence
  Synthetic
gacuagaagcaaaagcgagg

SEQ ID NO: 2920 - RNA, 20 nt, Artificial Sequence
  Synthetic
ggacuagaagcaaaagcgag

SEQ ID NO: 2921 - RNA, 20 nt, Artificial Sequence
  Synthetic
aggacuagaagcaaaagcga

SEQ ID NO: 2922 - RNA, 20 nt, Artificial Sequence
  Synthetic
caggacuagaagcaaaagcg

SEQ ID NO: 2923 - RNA, 20 nt, Artificial Sequence
  Synthetic
gcaggacuagaagcaaaagc

SEQ ID NO: 2924 - RNA, 20 nt, Artificial Sequence
  Synthetic
gcgcaggacuagaagcaaaa

SEQ ID NO: 2925 - RNA, 20 nt, Artificial Sequence
  Synthetic
aucacgagagcgcgcaggac

SEQ ID NO: 2926 - RNA, 20 nt, Artificial Sequence
  Synthetic
uuaauaaucacgagagcgcg

SEQ ID NO: 2927 - RNA, 20 nt, Artificial Sequence
  Synthetic
uaauaauuauuaauaaucac

SEQ ID NO: 2928 - RNA, 20 nt, Artificial Sequence
  Synthetic
aauaauaauuauuaauaauc

SEQ ID NO: 2929 - RNA, 17 nt, Artificial Sequence
  Synthetic
accucagaggcagcaag

SEQ ID NO: 2930 - RNA, 17 nt, Artificial Sequence
  Synthetic
gaaccucagaggcagca

SEQ ID NO: 2931 - RNA, 17 nt, Artificial Sequence
  Synthetic
cgaaccucagaggcagc

SEQ ID NO: 2932 - RNA, 17 nt, Artificial Sequence
  Synthetic
cccucccgaccgaaccu

SEQ ID NO: 2933 - RNA, 17 nt, Artificial Sequence
  Synthetic
cugcccuccccucccga

SEQ ID NO: 2934 - RNA, 17 nt, Artificial Sequence
  Synthetic
gcccggacugcugccuc

SEQ ID NO: 2935 - RNA, 17 nt, Artificial Sequence
  Synthetic
agagggagggagggagc

SEQ ID NO: 2936 - RNA, 17 nt, Artificial Sequence
  Synthetic
cgcgggagagggaggga

SEQ ID NO: 2937 - RNA, 17 nt, Artificial Sequence
  Synthetic
acgcgggagagggaggg

SEQ ID NO: 2938 - RNA, 17 nt, Artificial Sequence
  Synthetic
cacgcgggagagggagg

SEQ ID NO: 2939 - RNA, 17 nt, Artificial Sequence
  Synthetic
ggcacgcgggagaggga

SEQ ID NO: 2940 - RNA, 17 nt, Artificial Sequence
  Synthetic
gggcacgcgggagaggg

SEQ ID NO: 2941 - RNA, 17 nt, Artificial Sequence
  Synthetic
ggggcacgcgggagagg

SEQ ID NO: 2942 - RNA, 17 nt, Artificial Sequence
  Synthetic
cgggggcacgcgggaga

SEQ ID NO: 2943 - RNA, 17 nt, Artificial Sequence
  Synthetic
ccgggggcacgcgggag

SEQ ID NO: 2944 - RNA, 17 nt, Artificial Sequence
  Synthetic
gccgggggcacgcggga

SEQ ID NO: 2945 - RNA, 17 nt, Artificial Sequence
  Synthetic
cggccgggggcacgcgg

SEQ ID NO: 2946 - RNA, 17 nt, Artificial Sequence
  Synthetic
ggcggccgggggcacgc

SEQ ID NO: 2947 - RNA, 17 nt, Artificial Sequence
  Synthetic
aggcggccgggggcacg

SEQ ID NO: 2948 - RNA, 17 nt, Artificial Sequence
  Synthetic
gaggcggccgggggcac

SEQ ID NO: 2949 - RNA, 17 nt, Artificial Sequence
  Synthetic
cgggggaggaggcggcc

SEQ ID NO: 2950 - RNA, 17 nt, Artificial Sequence
  Synthetic
ccgggggaggaggcggc

SEQ ID NO: 2951 - RNA, 17 nt, Artificial Sequence
  Synthetic
gccgggggaggaggcgg

SEQ ID NO: 2952 - RNA, 17 nt, Artificial Sequence
  Synthetic
ggagcuagggccggggg

SEQ ID NO: 2953 - RNA, 17 nt, Artificial Sequence
  Synthetic
aggagcuagggccgggg

SEQ ID NO: 2954 - RNA, 17 nt, Artificial Sequence
  Synthetic
gcaggagcuagggccgg

SEQ ID NO: 2955 - RNA, 17 nt, Artificial Sequence
  Synthetic
ggcaggagcuagggccg

SEQ ID NO: 2956 - RNA, 17 nt, Artificial Sequence
  Synthetic
gggcaggagcuagggcc

SEQ ID NO: 2957 - RNA, 17 nt, Artificial Sequence
  Synthetic
agggcaggagcuagggc

SEQ ID NO: 2958 - RNA, 17 nt, Artificial Sequence
  Synthetic
aagggcaggagcuaggg

SEQ ID NO: 2959 - RNA, 17 nt, Artificial Sequence
  Synthetic
cgccgaagggcaggagc

SEQ ID NO: 2960 - RNA, 17 nt, Artificial Sequence
  Synthetic
cgccgccgccgaagggc

SEQ ID NO: 2961 - RNA, 17 nt, Artificial Sequence
  Synthetic
ccgccgccgccgaaggg

SEQ ID NO: 2962 - RNA, 17 nt, Artificial Sequence
  Synthetic
cgccgccgccgccgccg

SEQ ID NO: 2963 - RNA, 17 nt, Artificial Sequence
  Synthetic
cgccgccgccgccgccg

SEQ ID NO: 2964 - RNA, 17 nt, Artificial Sequence
  Synthetic
uuuuguuccggccagag

SEQ ID NO: 2965 - RNA, 17 nt, Artificial Sequence
  Synthetic
ccgccuuuuguuccggc

SEQ ID NO: 2966 - RNA, 17 nt, Artificial Sequence
  Synthetic
gugggaccgggaaggac

SEQ ID NO: 2967 - RNA, 17 nt, Artificial Sequence
  Synthetic
cgugggaccgggaagga

SEQ ID NO: 2968 - RNA, 17 nt, Artificial Sequence
  Synthetic
ccgugggaccgggaagg

SEQ ID NO: 2969 - RNA, 17 nt, Artificial Sequence
  Synthetic
agagccgugggaccggg

SEQ ID NO: 2970 - RNA, 17 nt, Artificial Sequence
  Synthetic
gggagagccgugggacc

SEQ ID NO: 2971 - RNA, 17 nt, Artificial Sequence
  Synthetic
ggggagagccgugggac

SEQ ID NO: 2972 - RNA, 17 nt, Artificial Sequence
  Synthetic
cggggagagccguggga

SEQ ID NO: 2973 - RNA, 17 nt, Artificial Sequence
  Synthetic
ggcgacggggagagccg

SEQ ID NO: 2974 - RNA, 17 nt, Artificial Sequence
  Synthetic
cggcgacggggagagcc

SEQ ID NO: 2975 - RNA, 17 nt, Artificial Sequence
  Synthetic
ggggccgcggcgacggg

SEQ ID NO: 2976 - RNA, 17 nt, Artificial Sequence
  Synthetic
gaggggccgcggcgacg

SEQ ID NO: 2977 - RNA, 17 nt, Artificial Sequence
  Synthetic
agaggggccgcggcgac

SEQ ID NO: 2978 - RNA, 17 nt, Artificial Sequence
  Synthetic
gagaggggccgcggcga

SEQ ID NO: 2979 - RNA, 17 nt, Artificial Sequence
  Synthetic
ggagaggggccgcggcg

SEQ ID NO: 2980 - RNA, 17 nt, Artificial Sequence
  Synthetic
guccgcggagucgggag

SEQ ID NO: 2981 - RNA, 17 nt, Artificial Sequence
  Synthetic
aguccgcggagucggga

SEQ ID NO: 2982 - RNA, 17 nt, Artificial Sequence
  Synthetic
ugaguccgcggagucgg

SEQ ID NO: 2983 - RNA, 17 nt, Artificial Sequence
  Synthetic
ccugaguccgcggaguc

SEQ ID NO: 2984 - RNA, 17 nt, Artificial Sequence
  Synthetic
uccugaguccgcggagu

SEQ ID NO: 2985 - RNA, 17 nt, Artificial Sequence
  Synthetic
cuccugaguccgcggag

SEQ ID NO: 2986 - RNA, 17 nt, Artificial Sequence
  Synthetic
cggcgcuccugaguccg

SEQ ID NO: 2987 - RNA, 17 nt, Artificial Sequence
  Synthetic
ccggcgcuccugagucc

SEQ ID NO: 2988 - RNA, 17 nt, Artificial Sequence
  Synthetic
aggggcccccggcgcuc

SEQ ID NO: 2989 - RNA, 17 nt, Artificial Sequence
  Synthetic
aaaguggcacuguggaa

SEQ ID NO: 2990 - RNA, 17 nt, Artificial Sequence
  Synthetic
gaaaguggcacugugga

SEQ ID NO: 2991 - RNA, 17 nt, Artificial Sequence
  Synthetic
gugagaaaguggcacug

SEQ ID NO: 2992 - RNA, 17 nt, Artificial Sequence
  Synthetic
agugagaaaguggcacu

SEQ ID NO: 2993 - RNA, 17 nt, Artificial Sequence
  Synthetic
gucauccccacaauagu

SEQ ID NO: 2994 - RNA, 17 nt, Artificial Sequence
  Synthetic
uagucauccccacaaua

SEQ ID NO: 2995 - RNA, 17 nt, Artificial Sequence
  Synthetic
gucaagugugcagcggg

SEQ ID NO: 2996 - RNA, 17 nt, Artificial Sequence
  Synthetic
ggucaagugugcagcgg

SEQ ID NO: 2997 - RNA, 17 nt, Artificial Sequence
  Synthetic
acggucaagugugcagc

SEQ ID NO: 2998 - RNA, 17 nt, Artificial Sequence
  Synthetic
cacggucaagugugcag

SEQ ID NO: 2999 - RNA, 17 nt, Artificial Sequence
  Synthetic
ucacggucaagugugca

SEQ ID NO: 3000 - RNA, 17 nt, Artificial Sequence
  Synthetic
agaggugagacuggcuu

SEQ ID NO: 3001 - RNA, 17 nt, Artificial Sequence
  Synthetic
ucccggggagaaaagag

SEQ ID NO: 3002 - RNA, 17 nt, Artificial Sequence
  Synthetic
acgauucccggggagaa

SEQ ID NO: 3003 - RNA, 17 nt, Artificial Sequence
  Synthetic
aaaaaacgauucccggg

SEQ ID NO: 3004 - RNA, 17 nt, Artificial Sequence
  Synthetic
cuaaaaaacgauucccg

SEQ ID NO: 3005 - RNA, 17 nt, Artificial Sequence
  Synthetic
ucuaaaaaacgauuccc

SEQ ID NO: 3006 - RNA, 17 nt, Artificial Sequence
  Synthetic
gucuaaaaaacgauucc

SEQ ID NO: 3007 - RNA, 17 nt, Artificial Sequence
  Synthetic
agucuaaaaaacgauuc

SEQ ID NO: 3008 - RNA, 17 nt, Artificial Sequence
  Synthetic
ggggggguagggaggga

SEQ ID NO: 3009 - RNA, 17 nt, Artificial Sequence
  Synthetic
aaauggggggguaggga

SEQ ID NO: 3010 - RNA, 17 nt, Artificial Sequence
  Synthetic
aaaauggggggguaggg

SEQ ID NO: 3011 - RNA, 17 nt, Artificial Sequence
  Synthetic
gaaaauggggggguagg

SEQ ID NO: 3012 - RNA, 17 nt, Artificial Sequence
  Synthetic
aagaaaaugggggggua

SEQ ID NO: 3013 - RNA, 17 nt, Artificial Sequence
  Synthetic
uaagaaaaugggggggu

SEQ ID NO: 3014 - RNA, 17 nt, Artificial Sequence
  Synthetic
guaagaaaauggggggg

SEQ ID NO: 3015 - RNA, 17 nt, Artificial Sequence
  Synthetic
ucaccguaagaaaaugg

SEQ ID NO: 3016 - RNA, 17 nt, Artificial Sequence
  Synthetic
cucaccguaagaaaaug

SEQ ID NO: 3017 - RNA, 17 nt, Artificial Sequence
  Synthetic
acucaccguaagaaaau

SEQ ID NO: 3018 - RNA, 17 nt, Artificial Sequence
  Synthetic
cacucaccguaagaaaa

SEQ ID NO: 3019 - RNA, 17 nt, Artificial Sequence
  Synthetic
ccacucaccguaagaaa

SEQ ID NO: 3020 - RNA, 17 nt, Artificial Sequence
  Synthetic
ugcuucccacucaccgu

SEQ ID NO: 3021 - RNA, 17 nt, Artificial Sequence
  Synthetic
gggagcugguggggaaa

SEQ ID NO: 3022 - RNA, 17 nt, Artificial Sequence
  Synthetic
ugggagcugguggggaa

SEQ ID NO: 3023 - RNA, 17 nt, Artificial Sequence
  Synthetic
gugggagcuggugggga

SEQ ID NO: 3024 - RNA, 17 nt, Artificial Sequence
  Synthetic
gggggugggagcuggug

SEQ ID NO: 3025 - RNA, 17 nt, Artificial Sequence
  Synthetic
ugggggugggagcuggu

SEQ ID NO: 3026 - RNA, 17 nt, Artificial Sequence
  Synthetic
cugggggugggagcugg

SEQ ID NO: 3027 - RNA, 17 nt, Artificial Sequence
  Synthetic
ccugggggugggagcug

SEQ ID NO: 3028 - RNA, 17 nt, Artificial Sequence
  Synthetic
caugcaaaccugggggu

SEQ ID NO: 3029 - RNA, 17 nt, Artificial Sequence
  Synthetic
acaugcaaaccuggggg

SEQ ID NO: 3030 - RNA, 17 nt, Artificial Sequence
  Synthetic
cacaugcaaaccugggg

SEQ ID NO: 3031 - RNA, 17 nt, Artificial Sequence
  Synthetic
aacucacaugcaaaccu

SEQ ID NO: 3032 - RNA, 17 nt, Artificial Sequence
  Synthetic
caacucacaugcaaacc

SEQ ID NO: 3033 - RNA, 17 nt, Artificial Sequence
  Synthetic
acaacucacaugcaaac

SEQ ID NO: 3034 - RNA, 17 nt, Artificial Sequence
  Synthetic
ugaacaaugcuaagguu

SEQ ID NO: 3035 - RNA, 17 nt, Artificial Sequence
  Synthetic
gccaguuuugcaaaaua

SEQ ID NO: 3036 - RNA, 17 nt, Artificial Sequence
  Synthetic
uauuucucuuuucgaaa

SEQ ID NO: 3037 - RNA, 17 nt, Artificial Sequence
  Synthetic
uuauuucucuuuucgaa

SEQ ID NO: 3038 - RNA, 17 nt, Artificial Sequence
  Synthetic
ccgcuuuauuucucuuu

SEQ ID NO: 3039 - RNA, 17 nt, Artificial Sequence
  Synthetic
uugccguguaugcacuu

SEQ ID NO: 3040 - RNA, 17 nt, Artificial Sequence
  Synthetic
aaaacccucaucccauc

SEQ ID NO: 3041 - RNA, 17 nt, Artificial Sequence
  Synthetic
aaaaacccucaucccau

SEQ ID NO: 3042 - RNA, 17 nt, Artificial Sequence
  Synthetic
gguaaaagagauaaagg

SEQ ID NO: 3043 - RNA, 17 nt, Artificial Sequence
  Synthetic
agguaaaagagauaaag

SEQ ID NO: 3044 - RNA, 17 nt, Artificial Sequence
  Synthetic
gagguaaaagagauaaa

SEQ ID NO: 3045 - RNA, 17 nt, Artificial Sequence
  Synthetic
cgagguaaaagagauaa

SEQ ID NO: 3046 - RNA, 17 nt, Artificial Sequence
  Synthetic
ucgagguaaaagagaua

SEQ ID NO: 3047 - RNA, 17 nt, Artificial Sequence
  Synthetic
uccgagagucgagguaa

SEQ ID NO: 3048 - RNA, 17 nt, Artificial Sequence
  Synthetic
agaaaaaccuccgagag

SEQ ID NO: 3049 - RNA, 17 nt, Artificial Sequence
  Synthetic
ucacgagaaaaaccucc

SEQ ID NO: 3050 - RNA, 17 nt, Artificial Sequence
  Synthetic
uuucacgagaaaaaccu

SEQ ID NO: 3051 - RNA, 17 nt, Artificial Sequence
  Synthetic
auuuuuaaauuuuucac

SEQ ID NO: 3052 - RNA, 17 nt, Artificial Sequence
  Synthetic
gcauuuuuaaauuuuuc

SEQ ID NO: 3053 - RNA, 17 nt, Artificial Sequence
  Synthetic
aaaagcgagggggagag

SEQ ID NO: 3054 - RNA, 17 nt, Artificial Sequence
  Synthetic
caaaagcgagggggaga

SEQ ID NO: 3055 - RNA, 17 nt, Artificial Sequence
  Synthetic
agcaaaagcgaggggga

SEQ ID NO: 3056 - RNA, 17 nt, Artificial Sequence
  Synthetic
gaagcaaaagcgagggg

SEQ ID NO: 3057 - RNA, 17 nt, Artificial Sequence
  Synthetic
uagaagcaaaagcgagg

SEQ ID NO: 3058 - RNA, 17 nt, Artificial Sequence
  Synthetic
cuagaagcaaaagcgag

SEQ ID NO: 3059 - RNA, 17 nt, Artificial Sequence
  Synthetic
acuagaagcaaaagcga

SEQ ID NO: 3060 - RNA, 17 nt, Artificial Sequence
  Synthetic
gacuagaagcaaaagcg

SEQ ID NO: 3061 - RNA, 17 nt, Artificial Sequence
  Synthetic
ggacuagaagcaaaagc

SEQ ID NO: 3062 - RNA, 17 nt, Artificial Sequence
  Synthetic
caggacuagaagcaaaa

SEQ ID NO: 3063 - RNA, 17 nt, Artificial Sequence
  Synthetic
acgagagcgcgcaggac

SEQ ID NO: 3064 - RNA, 17 nt, Artificial Sequence
  Synthetic
auaaucacgagagcgcg

SEQ ID NO: 3065 - RNA, 17 nt, Artificial Sequence
  Synthetic
uaauuauuaauaaucac

SEQ ID NO: 3066 - RNA, 17 nt, Artificial Sequence
  Synthetic
aauaauuauuaauaauc

SEQ ID NO: 3067 - RNA, 20 nt, Artificial Sequence
  Synthetic
gcuucuaguccugcgcgcuc

SEQ ID NO: 3068 - RNA, 17 nt, Artificial Sequence
  Synthetic
ucuaguccugcgcgcuc

SEQ ID NO: 3069 - RNA, 20 nt, Artificial Sequence
  Synthetic
uuuagacuuguacucacucc

SEQ ID NO: 3070 - RNA, 20 nt, Artificial Sequence
  Synthetic
cauuccuuuucgaaaagaga

SEQ ID NO: 3071 - RNA, 17 nt, Artificial Sequence
  Synthetic
uuuagacuuguacucac

SEQ ID NO: 3072 - RNA, 17 nt, Artificial Sequence
  Synthetic
cauuccuuuucgaaaag

SEQ ID NO: 3073 - RNA, 20 nt, Artificial Sequence
  Synthetic
gagcuccaugugcagaacga

SEQ ID NO: 3074 - RNA, 17 nt, Artificial Sequence
  Synthetic
gagcucccaacgggccg

SEQ ID NO: 3075 - RNA, 20 nt, Artificial Sequence
  Synthetic
gagugcagaauaugccccgc

SEQ ID NO: 3076 - RNA, 20 nt, Artificial Sequence
  Synthetic
gauaaacaaucgucauccuc

SEQ ID NO: 3077 - RNA, 20 nt, Artificial Sequence
  Synthetic
gaugccaaccuccacgggau

SEQ ID NO: 3078 - RNA, 17 nt, Artificial Sequence
  Synthetic
gcagaauaugccccgca

SEQ ID NO: 3079 - RNA, 20 nt, Artificial Sequence
  Synthetic
gcauccaaucccguggaggu

SEQ ID NO: 3080 - RNA, 17 nt, Artificial Sequence
  Synthetic
gccaaccuccacgggau

SEQ ID NO: 3081 - RNA, 20 nt, Artificial Sequence
  Synthetic
gcucccaacgggccgugguc

SEQ ID NO: 3082 - RNA, 20 nt, Artificial Sequence
  Synthetic
ggagcucuaauccccacgcc

SEQ ID NO: 3083 - RNA, 17 nt, Artificial Sequence
  Synthetic
agcauccaaucccgugg

SEQ ID NO: 3084 - RNA, 20 nt, Artificial Sequence
  Synthetic
agugcagaauaugccccgca

SEQ ID NO: 3085 - RNA, 17 nt, Artificial Sequence
  Synthetic
augucucgccgcaagca

SEQ ID NO: 3086 - RNA, 20 nt, Artificial Sequence
  Synthetic
auucccguuugcuuaagugc

SEQ ID NO: 3087 - RNA, 17 nt, Artificial Sequence
  Synthetic
cauccucuggcgugacc

SEQ ID NO: 3088 - RNA, 17 nt, Artificial Sequence
  Synthetic
cccaacgggccgugguc

SEQ ID NO: 3089 - RNA, 20 nt, Artificial Sequence
  Synthetic
cccccaaugggaaguucauc

SEQ ID NO: 3090 - RNA, 17 nt, Artificial Sequence
  Synthetic
cccguuugcuuaagugc

SEQ ID NO: 3091 - RNA, 20 nt, Artificial Sequence
  Synthetic
cgucauccucuggcgugacc

SEQ ID NO: 3092 - RNA, 17 nt, Artificial Sequence
  Synthetic
ucaucucgauuggugaa

SEQ ID NO: 3093 - RNA, 17 nt, Artificial Sequence
  Synthetic
uccaaucccguggaggu

SEQ ID NO: 3094 - RNA, 20 nt, Artificial Sequence
  Synthetic
ucccguuugcuuaagugcug

SEQ ID NO: 3095 - RNA, 20 nt, Artificial Sequence
  Synthetic
ugaaccagaccacggcccgu

SEQ ID NO: 3096 - RNA, 17 nt, Artificial Sequence
  Synthetic
ugcagaauaugccccgc

SEQ ID NO: 3097 - RNA, 20 nt, Artificial Sequence
  Synthetic
uggcauccaggucacgccag

SEQ ID NO: 3098 - RNA, 17 nt, Artificial Sequence
  Synthetic
uuaucaacgucaucuag

SEQ ID NO: 3099 - RNA, 17 nt, Artificial Sequence
  Synthetic
uucaucucgauugguga

SEQ ID NO: 3100 - RNA, 20 nt, Artificial Sequence
  Synthetic
gaaaaaagcauccaaucccg

SEQ ID NO: 3101 - RNA, 20 nt, Artificial Sequence
  Synthetic
gaaccagaccacggcccguu

SEQ ID NO: 3102 - RNA, 20 nt, Artificial Sequence
  Synthetic
gaccuggaugccaaccucca

SEQ ID NO: 3103 - RNA, 20 nt, Artificial Sequence
  Synthetic
gagcucuaauccccacgccu

SEQ ID NO: 3104 - RNA, 20 nt, Artificial Sequence
  Synthetic
gaucaugaccuccucaccug

SEQ ID NO: 3105 - RNA, 17 nt, Artificial Sequence
  Synthetic
gaugaacuucccauugg

SEQ ID NO: 3106 - RNA, 17 nt, Artificial Sequence
  Synthetic
gaugaugaaccagacca

SEQ ID NO: 3107 - RNA, 20 nt, Artificial Sequence
  Synthetic
gaugcuuuuuucaucucgau

SEQ ID NO: 3108 - RNA, 17 nt, Artificial Sequence
  Synthetic
gcacucaucccaggcgu

SEQ ID NO: 3109 - RNA, 20 nt, Artificial Sequence
  Synthetic
gcauauucugcacucauccc

SEQ ID NO: 3110 - RNA, 20 nt, Artificial Sequence
  Synthetic
gccagaugaacuucccauug

SEQ ID NO: 3111 - RNA, 20 nt, Artificial Sequence
  Synthetic
gcccguugggagcuccagaa

SEQ ID NO: 3112 - RNA, 17 nt, Artificial Sequence
  Synthetic
gcuauguguuccuguuu

SEQ ID NO: 3113 - RNA, 17 nt, Artificial Sequence
  Synthetic
gcuccaugugcagaacg

SEQ ID NO: 3114 - RNA, 17 nt, Artificial Sequence
  Synthetic
gcucuaauccccacgcc

SEQ ID NO: 3115 - RNA, 20 nt, Artificial Sequence
  Synthetic
gcugggguuugccuugcuug

SEQ ID NO: 3116 - RNA, 17 nt, Artificial Sequence
  Synthetic
gcuuuuuucaucucgau

SEQ ID NO: 3117 - RNA, 17 nt, Artificial Sequence
  Synthetic
ggcacugcccacaggug

SEQ ID NO: 3118 - RNA, 20 nt, Artificial Sequence
  Synthetic
ggcacugcccacaggugagg

SEQ ID NO: 3119 - RNA, 20 nt, Artificial Sequence
  Synthetic
ggcccguugggagcuccaga

SEQ ID NO: 3120 - RNA, 17 nt, Artificial Sequence
  Synthetic
gggguuugccuugcuug

SEQ ID NO: 3121 - RNA, 17 nt, Artificial Sequence
  Synthetic
guaagaauggcuucaag

SEQ ID NO: 3122 - RNA, 20 nt, Artificial Sequence
  Synthetic
gugcagaacgaggggaggag

SEQ ID NO: 3123 - RNA, 20 nt, Artificial Sequence
  Synthetic
gugccagaugaacuucccau

SEQ ID NO: 3124 - RNA, 20 nt, Artificial Sequence
  Synthetic
guucaucuggcacugcccac

SEQ ID NO: 3125 - RNA, 17 nt, Artificial Sequence
  Synthetic
guugggagcuccagaag

SEQ ID NO: 3126 - RNA, 17 nt, Artificial Sequence
  Synthetic
aaaagcauccaaucccg

SEQ ID NO: 3127 - RNA, 20 nt, Artificial Sequence
  Synthetic
aaaagcauccaaucccgugg

SEQ ID NO: 3128 - RNA, 20 nt, Artificial Sequence
  Synthetic
aaaauaagaaugucccccaa

SEQ ID NO: 3129 - RNA, 17 nt, Artificial Sequence
  Synthetic
aaacaaucgucauccuc

SEQ ID NO: 3130 - RNA, 17 nt, Artificial Sequence
  Synthetic
aaacggaaacaaugcaa

SEQ ID NO: 3131 - RNA, 17 nt, Artificial Sequence
  Synthetic
aaacuucugcacuggag

SEQ ID NO: 3132 - RNA, 20 nt, Artificial Sequence
  Synthetic
aaauaagaaugucccccaau

SEQ ID NO: 3133 - RNA, 20 nt, Artificial Sequence
  Synthetic
aaccccagcacuuaagcaaa

SEQ ID NO: 3134 - RNA, 20 nt, Artificial Sequence
  Synthetic
aagaauggcuucaagaggcu

SEQ ID NO: 3135 - RNA, 17 nt, Artificial Sequence
  Synthetic
aauggcuucaagaggcu

SEQ ID NO: 3136 - RNA, 20 nt, Artificial Sequence
  Synthetic
acagaugaugaaccagacca

SEQ ID NO: 3137 - RNA, 17 nt, Artificial Sequence
  Synthetic
accagaccacggcccgu

SEQ ID NO: 3138 - RNA, 20 nt, Artificial Sequence
  Synthetic
accccagcacuuaagcaaac

SEQ ID NO: 3139 - RNA, 20 nt, Artificial Sequence
  Synthetic
accuggaugccaaccuccac

SEQ ID NO: 3140 - RNA, 17 nt, Artificial Sequence
  Synthetic
acugcccacaggugagg

SEQ ID NO: 3141 - RNA, 20 nt, Artificial Sequence
  Synthetic
agagcuccaugugcagaacg

SEQ ID NO: 3142 - RNA, 17 nt, Artificial Sequence
  Synthetic
agaugaacuucccauug

SEQ ID NO: 3143 - RNA, 20 nt, Artificial Sequence
  Synthetic
agcuccaugugcagaacgag

SEQ ID NO: 3144 - RNA, 17 nt, Artificial Sequence
  Synthetic
aggaauuugccccaaac

SEQ ID NO: 3145 - RNA, 20 nt, Artificial Sequence
  Synthetic
aggaggucaugauccccuuc

SEQ ID NO: 3146 - RNA, 17 nt, Artificial Sequence
  Synthetic
aggucaugauccccuuc

SEQ ID NO: 3147 - RNA, 17 nt, Artificial Sequence
  Synthetic
auaaacuucugcacugg

SEQ ID NO: 3148 - RNA, 17 nt, Artificial Sequence
  Synthetic
auaagaaugucccccaa

SEQ ID NO: 3149 - RNA, 20 nt, Artificial Sequence
  Synthetic
aucaugaccuccucaccugu

SEQ ID NO: 3150 - RNA, 20 nt, Artificial Sequence
  Synthetic
aucucgauuggugaagggga

SEQ ID NO: 3151 - RNA, 17 nt, Artificial Sequence
  Synthetic
augaccuccucaccugu

SEQ ID NO: 3152 - RNA, 17 nt, Artificial Sequence
  Synthetic
augugcagaacgagggg

SEQ ID NO: 3153 - RNA, 17 nt, Artificial Sequence
  Synthetic
auuggugaaggggaagg

SEQ ID NO: 3154 - RNA, 20 nt, Artificial Sequence
  Synthetic
cacaaacggaaacaaugcaa

SEQ ID NO: 3155 - RNA, 17 nt, Artificial Sequence
  Synthetic
cacucaucccaggcgug

SEQ ID NO: 3156 - RNA, 17 nt, Artificial Sequence
  Synthetic
cagaacgaggggaggag

SEQ ID NO: 3157 - RNA, 17 nt, Artificial Sequence
  Synthetic
cagaugaacuucccauu

SEQ ID NO: 3158 - RNA, 17 nt, Artificial Sequence
  Synthetic
cagcuuuuucuaagcag

SEQ ID NO: 3159 - RNA, 17 nt, Artificial Sequence
  Synthetic
cauccaggucacgccag

SEQ ID NO: 3160 - RNA, 17 nt, Artificial Sequence
  Synthetic
caucucgauuggugaag

SEQ ID NO: 3161 - RNA, 17 nt, Artificial Sequence
  Synthetic
caucuggcacugcccac

SEQ ID NO: 3162 - RNA, 17 nt, Artificial Sequence
  Synthetic
caugaccuccucaccug

SEQ ID NO: 3163 - RNA, 17 nt, Artificial Sequence
  Synthetic
ccaaugggaaguucauc

SEQ ID NO: 3164 - RNA, 20 nt, Artificial Sequence
  Synthetic
ccacagcuuuuucuaagcag

SEQ ID NO: 3165 - RNA, 17 nt, Artificial Sequence
  Synthetic
ccagaccacggcccguu

SEQ ID NO: 3166 - RNA, 17 nt, Artificial Sequence
  Synthetic
ccagaugaacuucccau

SEQ ID NO: 3167 - RNA, 20 nt, Artificial Sequence
  Synthetic
ccagaugaacuucccauugg

SEQ ID NO: 3168 - RNA, 17 nt, Artificial Sequence
  Synthetic
ccagcacuuaagcaaac

SEQ ID NO: 3169 - RNA, 17 nt, Artificial Sequence
  Synthetic
cccagcacuuaagcaaa

SEQ ID NO: 3170 - RNA, 20 nt, Artificial Sequence
  Synthetic
ccccuucuggagcucccaac

SEQ ID NO: 3171 - RNA, 20 nt, Artificial Sequence
  Synthetic
cccguugggagcuccagaag

SEQ ID NO: 3172 - RNA, 17 nt, Artificial Sequence
  Synthetic
ccguugggagcuccaga

SEQ ID NO: 3173 - RNA, 17 nt, Artificial Sequence
  Synthetic
ccguuugcuuaagugcu

SEQ ID NO: 3174 - RNA, 20 nt, Artificial Sequence
  Synthetic
ccucugcuuagaaaaagcug

SEQ ID NO: 3175 - RNA, 17 nt, Artificial Sequence
  Synthetic
ccuucuggagcucccaa

SEQ ID NO: 3176 - RNA, 17 nt, Artificial Sequence
  Synthetic
cguggagguuggcaucc

SEQ ID NO: 3177 - RNA, 17 nt, Artificial Sequence
  Synthetic
cguugggagcuccagaa

SEQ ID NO: 3178 - RNA, 17 nt, Artificial Sequence
  Synthetic
cguuugcuuaagugcug

SEQ ID NO: 3179 - RNA, 17 nt, Artificial Sequence
  Synthetic
cuauguguuccuguuug

SEQ ID NO: 3180 - RNA, 17 nt, Artificial Sequence
  Synthetic
cuccaugugcagaacga

SEQ ID NO: 3181 - RNA, 17 nt, Artificial Sequence
  Synthetic
cucuaauccccacgccu

SEQ ID NO: 3182 - RNA, 20 nt, Artificial Sequence
  Synthetic
cugcacucaucccaggcgug

SEQ ID NO: 3183 - RNA, 20 nt, Artificial Sequence
  Synthetic
cugcuauguguuccuguuug

SEQ ID NO: 3184 - RNA, 17 nt, Artificial Sequence
  Synthetic
cugcuuagaaaaagcug

SEQ ID NO: 3185 - RNA, 20 nt, Artificial Sequence
  Synthetic
cuggagcucccaacgggccg

SEQ ID NO: 3186 - RNA, 17 nt, Artificial Sequence
  Synthetic
cuggaugccaaccucca

SEQ ID NO: 3187 - RNA, 17 nt, Artificial Sequence
  Synthetic
cuucuggagcucccaac

SEQ ID NO: 3188 - RNA, 17 nt, Artificial Sequence
  Synthetic
uaaacuucugcacugga

SEQ ID NO: 3189 - RNA, 17 nt, Artificial Sequence
  Synthetic
uaagaaugucccccaau

SEQ ID NO: 3190 - RNA, 20 nt, Artificial Sequence
  Synthetic
uagaggaauuugccccaaac

SEQ ID NO: 3191 - RNA, 17 nt, Artificial Sequence
  Synthetic
uauucugcacucauccc

SEQ ID NO: 3192 - RNA, 17 nt, Artificial Sequence
  Synthetic
uccaugugcagaacgag

SEQ ID NO: 3193 - RNA, 20 nt, Artificial Sequence
  Synthetic
uccaugugcagaacgagggg

SEQ ID NO: 3194 - RNA, 17 nt, Artificial Sequence
  Synthetic
uccccucguucugcaca

SEQ ID NO: 3195 - RNA, 20 nt, Artificial Sequence
  Synthetic
uccccuucuggagcucccaa

SEQ ID NO: 3196 - RNA, 20 nt, Artificial Sequence
  Synthetic
ucccguggagguuggcaucc

SEQ ID NO: 3197 - RNA, 20 nt, Artificial Sequence
  Synthetic
uccuccccucguucugcaca

SEQ ID NO: 3198 - RNA, 17 nt, Artificial Sequence
  Synthetic
ucgauuggugaagggga

SEQ ID NO: 3199 - RNA, 20 nt, Artificial Sequence
  Synthetic
ucgauuggugaaggggaagg

SEQ ID NO: 3200 - RNA, 20 nt, Artificial Sequence
  Synthetic
ucugcacucaucccaggcgu

SEQ ID NO: 3201 - RNA, 20 nt, Artificial Sequence
  Synthetic
ucuggcacugcccacaggug

SEQ ID NO: 3202 - RNA, 20 nt, Artificial Sequence
  Synthetic
ucuguaagaauggcuucaag

SEQ ID NO: 3203 - RNA, 17 nt, Artificial Sequence
  Synthetic
ugcacucaucccaggcg

SEQ ID NO: 3204 - RNA, 20 nt, Artificial Sequence
  Synthetic
ugccagaugaacuucccauu

SEQ ID NO: 3205 - RNA, 17 nt, Artificial Sequence
  Synthetic
ugcuauguguuccuguu

SEQ ID NO: 3206 - RNA, 17 nt, Artificial Sequence
  Synthetic
uggaugccaaccuccac

SEQ ID NO: 3207 - RNA, 20 nt, Artificial Sequence
  Synthetic
ugguucaucaucuguaagaa

SEQ ID NO: 3208 - RNA, 20 nt, Artificial Sequence
  Synthetic
uguuuaucaacgucaucuag

SEQ ID NO: 3209 - RNA, 20 nt, Artificial Sequence
  Synthetic
uuauuuuuaucgagcacaaa

SEQ ID NO: 3210 - RNA, 17 nt, Artificial Sequence
  Synthetic
uucaucaucuguaagaa

SEQ ID NO: 3211 - RNA, 20 nt, Artificial Sequence
  Synthetic
uucccguuugcuuaagugcu

SEQ ID NO: 3212 - RNA, 20 nt, Artificial Sequence
  Synthetic
uucugcacucaucccaggcg

SEQ ID NO: 3213 - RNA, 20 nt, Artificial Sequence
  Synthetic
uuucaucucgauuggugaag

SEQ ID NO: 3214 - RNA, 20 nt, Artificial Sequence
  Synthetic
uuuucaucucgauuggugaa

SEQ ID NO: 3215 - RNA, 17 nt, Artificial Sequence
  Synthetic
uuuuuaucgagcacaaa

SEQ ID NO: 3216 - RNA, 20 nt, Artificial Sequence
  Synthetic
uuuuucaucucgauugguga

SEQ ID NO: 3217 - RNA, 17 nt, Artificial Sequence
  Synthetic
uaugcgguccgacucgc

SEQ ID NO: 3218 - RNA, 17 nt, Artificial Sequence
  Synthetic
ucggaccgcauagacga

SEQ ID NO: 3219 - RNA, 17 nt, Artificial Sequence
  Synthetic
uggguacuacgccgaau

SEQ ID NO: 3220 - RNA, 17 nt, Artificial Sequence
  Synthetic
gguacuacgccgaaugg

SEQ ID NO: 3221 - RNA, 17 nt, Artificial Sequence
  Synthetic
uugcgacgaagacucgg

SEQ ID NO: 3222 - RNA, 17 nt, Artificial Sequence
  Synthetic
cuggguacuacgccgaa

SEQ ID NO: 3223 - RNA, 17 nt, Artificial Sequence
  Synthetic
ggguacuacgccgaaug

SEQ ID NO: 3224 - RNA, 17 nt, Artificial Sequence
  Synthetic
ucggacuugaccgucau

SEQ ID NO: 3225 - RNA, 17 nt, Artificial Sequence
  Synthetic
agggauaccaacccgcg

SEQ ID NO: 3226 - RNA, 17 nt, Artificial Sequence
  Synthetic
cgcgcucaaguccgugg

SEQ ID NO: 3227 - RNA, 17 nt, Artificial Sequence
  Synthetic
cgaggagugcuccgacg

SEQ ID NO: 3228 - RNA, 17 nt, Artificial Sequence
  Synthetic
gucggacuugaccguca

SEQ ID NO: 3229 - RNA, 17 nt, Artificial Sequence
  Synthetic
ugcacgcguggucgcac

SEQ ID NO: 3230 - RNA, 17 nt, Artificial Sequence
  Synthetic
cagcgcgcucaaguccg

SEQ ID NO: 3231 - RNA, 17 nt, Artificial Sequence
  Synthetic
uaccaacccgcgggguc

SEQ ID NO: 3232 - RNA, 17 nt, Artificial Sequence
  Synthetic
guggcucgccggcuacg

SEQ ID NO: 3233 - RNA, 17 nt, Artificial Sequence
  Synthetic
cggacuugaccgucaug

SEQ ID NO: 3234 - RNA, 17 nt, Artificial Sequence
  Synthetic
caccgcauagagcgccu

SEQ ID NO: 3235 - RNA, 17 nt, Artificial Sequence
  Synthetic
gcgcaucaagcucgaga

SEQ ID NO: 3236 - RNA, 17 nt, Artificial Sequence
  Synthetic
ggcccggaccacuaaua

SEQ ID NO: 3237 - RNA, 17 nt, Artificial Sequence
  Synthetic
gcccggaccacuaauau

SEQ ID NO: 3238 - RNA, 17 nt, Artificial Sequence
  Synthetic
gcauaagcgcggccacc

SEQ ID NO: 3239 - RNA, 17 nt, Artificial Sequence
  Synthetic
aggcgcucuaugcggug

SEQ ID NO: 3240 - RNA, 17 nt, Artificial Sequence
  Synthetic
acggucaaguccgacga

SEQ ID NO: 3241 - RNA, 17 nt, Artificial Sequence
  Synthetic
cgaggccgacucgcccg

SEQ ID NO: 3242 - RNA, 17 nt, Artificial Sequence
  Synthetic
accgcauagagcgccug

SEQ ID NO: 3243 - RNA, 17 nt, Artificial Sequence
  Synthetic
cgaccacgcgugcaccc

SEQ ID NO: 3244 - RNA, 17 nt, Artificial Sequence
  Synthetic
guacacguucuccgugu

SEQ ID NO: 3245 - RNA, 17 nt, Artificial Sequence
  Synthetic
cacuugcgacgaagacu

SEQ ID NO: 3246 - RNA, 17 nt, Artificial Sequence
  Synthetic
cggguugguaucccuuc

SEQ ID NO: 3247 - RNA, 17 nt, Artificial Sequence
  Synthetic
cucgucggagcacuccu

SEQ ID NO: 3248 - RNA, 17 nt, Artificial Sequence
  Synthetic
cccggaccacuaauaug

SEQ ID NO: 3249 - RNA, 17 nt, Artificial Sequence
  Synthetic
ucggugguggacuaaac

SEQ ID NO: 3250 - RNA, 17 nt, Artificial Sequence
  Synthetic
caggcgcucuaugcggu

SEQ ID NO: 3251 - RNA, 17 nt, Artificial Sequence
  Synthetic
aagggauaccaacccgc

SEQ ID NO: 3252 - RNA, 17 nt, Artificial Sequence
  Synthetic
ggcgcucuaugcggugg

SEQ ID NO: 3253 - RNA, 17 nt, Artificial Sequence
  Synthetic
ccaccgcauagagcgcc

SEQ ID NO: 3254 - RNA, 17 nt, Artificial Sequence
  Synthetic
uacucgcaguggcucgc

SEQ ID NO: 3255 - RNA, 17 nt, Artificial Sequence
  Synthetic
cgggcgagucggccucg

SEQ ID NO: 3256 - RNA, 17 nt, Artificial Sequence
  Synthetic
uacacguucuccguguu

SEQ ID NO: 3257 - RNA, 17 nt, Artificial Sequence
  Synthetic
agcacgccccauauuag

SEQ ID NO: 3258 - RNA, 17 nt, Artificial Sequence
  Synthetic
gaagggauaccaacccg

SEQ ID NO: 3259 - RNA, 17 nt, Artificial Sequence
  Synthetic
uugggcaucgcggccgg

SEQ ID NO: 3260 - RNA, 17 nt, Artificial Sequence
  Synthetic
ccgggcgagucggccuc

SEQ ID NO: 3261 - RNA, 17 nt, Artificial Sequence
  Synthetic
gguggagagaccgucgu

SEQ ID NO: 3262 - RNA, 17 nt, Artificial Sequence
  Synthetic
guugggcaucgcggccg

SEQ ID NO: 3263 - RNA, 17 nt, Artificial Sequence
  Synthetic
agaacguguacucgcag

SEQ ID NO: 3264 - RNA, 17 nt, Artificial Sequence
  Synthetic
accaacccgcgggguca

SEQ ID NO: 3265 - RNA, 17 nt, Artificial Sequence
  Synthetic
cacgagaacagcucgcg

SEQ ID NO: 3266 - RNA, 17 nt, Artificial Sequence
  Synthetic
uauuagugguccgggcc

SEQ ID NO: 3267 - RNA, 17 nt, Artificial Sequence
  Synthetic
cgucgcaagugucccug

SEQ ID NO: 3268 - RNA, 17 nt, Artificial Sequence
  Synthetic
cccgcgagcuguucucg

SEQ ID NO: 3269 - RNA, 17 nt, Artificial Sequence
  Synthetic
ugcgccggugcaccacc

SEQ ID NO: 3270 - RNA, 17 nt, Artificial Sequence
  Synthetic
cugcccgacgucaugca

SEQ ID NO: 3271 - RNA, 17 nt, Artificial Sequence
  Synthetic
gacgaagacucgguggc

SEQ ID NO: 3272 - RNA, 17 nt, Artificial Sequence
  Synthetic
ccugcccgacgucaugc

SEQ ID NO: 3273 - RNA, 17 nt, Artificial Sequence
  Synthetic
aagggcggcuugcuacc

SEQ ID NO: 3274 - RNA, 17 nt, Artificial Sequence
  Synthetic
ggguggacuacggcuuc

SEQ ID NO: 3275 - RNA, 17 nt, Artificial Sequence
  Synthetic
ucgcuggugccggguuc

SEQ ID NO: 3276 - RNA, 17 nt, Artificial Sequence
  Synthetic
ggcgagaagcauaagcg

SEQ ID NO: 3277 - RNA, 17 nt, Artificial Sequence
  Synthetic
ggacuugagcgcgcugc

SEQ ID NO: 3278 - RNA, 17 nt, Artificial Sequence
  Synthetic
cucgguggccggcgagu

SEQ ID NO: 3279 - RNA, 17 nt, Artificial Sequence
  Synthetic
cccgaggccgacucgcc

SEQ ID NO: 3280 - RNA, 17 nt, Artificial Sequence
  Synthetic
cccgggcgagucggccu

SEQ ID NO: 3281 - RNA, 17 nt, Artificial Sequence
  Synthetic
ccgcauagagcgccugg

SEQ ID NO: 3282 - RNA, 17 nt, Artificial Sequence
  Synthetic
uguugggcaucgcggcc

SEQ ID NO: 3283 - RNA, 17 nt, Artificial Sequence
  Synthetic
guguugggcaucgcggc

SEQ ID NO: 3284 - RNA, 17 nt, Artificial Sequence
  Synthetic
ucucucgauacugaucc

SEQ ID NO: 3285 - RNA, 17 nt, Artificial Sequence
  Synthetic
acccgagugccuuugac

SEQ ID NO: 3286 - RNA, 17 nt, Artificial Sequence
  Synthetic
uccgacgaggaggcaaa

SEQ ID NO: 3287 - RNA, 17 nt, Artificial Sequence
  Synthetic
acccggcaccagcgacu

SEQ ID NO: 3288 - RNA, 17 nt, Artificial Sequence
  Synthetic
ccccguucuccgggauc

SEQ ID NO: 3289 - RNA, 17 nt, Artificial Sequence
  Synthetic
ccgaggccgacucgccc

SEQ ID NO: 3290 - RNA, 17 nt, Artificial Sequence
  Synthetic
ccccauauuaguggucc

SEQ ID NO: 3291 - RNA, 17 nt, Artificial Sequence
  Synthetic
gacuuggacuugaccgg

SEQ ID NO: 3292 - RNA, 17 nt, Artificial Sequence
  Synthetic
gccccauauuagugguc

SEQ ID NO: 3293 - RNA, 17 nt, Artificial Sequence
  Synthetic
aggguggacuacggcuu

SEQ ID NO: 3294 - RNA, 17 nt, Artificial Sequence
  Synthetic
caaaucgucccccauga

SEQ ID NO: 3295 - RNA, 17 nt, Artificial Sequence
  Synthetic
cgacgucaugcagggca

SEQ ID NO: 3296 - RNA, 17 nt, Artificial Sequence
  Synthetic
ggccgcgaugcccaaca

SEQ ID NO: 3297 - RNA, 17 nt, Artificial Sequence
  Synthetic
ccaggcgcucuaugcgg

SEQ ID NO: 3298 - RNA, 17 nt, Artificial Sequence
  Synthetic
ccugaucccggagaacg

SEQ ID NO: 3299 - RNA, 17 nt, Artificial Sequence
  Synthetic
ccaacccgcggggucag

SEQ ID NO: 3300 - RNA, 17 nt, Artificial Sequence
  Synthetic
ggcgagucggccucggg

SEQ ID NO: 3301 - RNA, 17 nt, Artificial Sequence
  Synthetic
ggcaaaaggcgauuguc

SEQ ID NO: 3302 - RNA, 17 nt, Artificial Sequence
  Synthetic
uuuggacaggccccccg

SEQ ID NO: 3303 - RNA, 17 nt, Artificial Sequence
  Synthetic
gcggcuugcuaccuggc

SEQ ID NO: 3304 - RNA, 17 nt, Artificial Sequence
  Synthetic
ggacuugaccgucaugg

SEQ ID NO: 3305 - RNA, 17 nt, Artificial Sequence
  Synthetic
ggagugcuccgacgagg

SEQ ID NO: 3306 - RNA, 17 nt, Artificial Sequence
  Synthetic
auuagugguccgggccc

SEQ ID NO: 3307 - RNA, 17 nt, Artificial Sequence
  Synthetic
ccacgagaacagcucgc

SEQ ID NO: 3308 - RNA, 17 nt, Artificial Sequence
  Synthetic
guaucgagagaggcuuc

SEQ ID NO: 3309 - RNA, 17 nt, Artificial Sequence
  Synthetic
cuccguguugggcaucg

SEQ ID NO: 3310 - RNA, 17 nt, Artificial Sequence
  Synthetic
caaacucccguucuccg

SEQ ID NO: 3311 - RNA, 17 nt, Artificial Sequence
  Synthetic
accugaucccggagaac

SEQ ID NO: 3312 - RNA, 17 nt, Artificial Sequence
  Synthetic
ggcacuguuaauggccg

SEQ ID NO: 3313 - RNA, 17 nt, Artificial Sequence
  Synthetic
uucuccgggaucagguu

SEQ ID NO: 3314 - RNA, 17 nt, Artificial Sequence
  Synthetic
uauggagccucccgcca

SEQ ID NO: 3315 - RNA, 17 nt, Artificial Sequence
  Synthetic
cuugaugcgcuuagaga

SEQ ID NO: 3316 - RNA, 17 nt, Artificial Sequence
  Synthetic
uagcaagccgcccuucc

SEQ ID NO: 3317 - RNA, 17 nt, Artificial Sequence
  Synthetic
ccggcuacgcggccucc

SEQ ID NO: 3318 - RNA, 17 nt, Artificial Sequence
  Synthetic
uccaagugaugucucgg

SEQ ID NO: 3319 - RNA, 17 nt, Artificial Sequence
  Synthetic
gaacagcucgcggggcg

SEQ ID NO: 3320 - RNA, 17 nt, Artificial Sequence
  Synthetic
gcugcgguugaauccaa

SEQ ID NO: 3321 - RNA, 17 nt, Artificial Sequence
  Synthetic
ugacuuggacuugaccg

SEQ ID NO: 3322 - RNA, 17 nt, Artificial Sequence
  Synthetic
cccggagaacggggacg

SEQ ID NO: 3323 - RNA, 17 nt, Artificial Sequence
  Synthetic
guggcgcuucagcuugc

SEQ ID NO: 3324 - RNA, 17 nt, Artificial Sequence
  Synthetic
guucuccgggaucaggu

SEQ ID NO: 3325 - RNA, 17 nt, Artificial Sequence
  Synthetic
cagugccaucgucuaug

SEQ ID NO: 3326 - RNA, 17 nt, Artificial Sequence
  Synthetic
ucuccgggaucagguug

SEQ ID NO: 3327 - RNA, 17 nt, Artificial Sequence
  Synthetic
gacgauggcacuguuaa

SEQ ID NO: 3328 - RNA, 17 nt, Artificial Sequence
  Synthetic
cugcuccccgggcgagu

SEQ ID NO: 3329 - RNA, 17 nt, Artificial Sequence
  Synthetic
cggugguggacuaaaca

SEQ ID NO: 3330 - RNA, 17 nt, Artificial Sequence
  Synthetic
cucgcggggcgcggucg

SEQ ID NO: 3331 - RNA, 17 nt, Artificial Sequence
  Synthetic
augcccugcaugacguc

SEQ ID NO: 3332 - RNA, 17 nt, Artificial Sequence
  Synthetic
uggacuugaccgggggc

SEQ ID NO: 3333 - RNA, 17 nt, Artificial Sequence
  Synthetic
accaccgagacaucacu

SEQ ID NO: 3334 - RNA, 17 nt, Artificial Sequence
  Synthetic
ggaguucgaccugcccc

SEQ ID NO: 3335 - RNA, 17 nt, Artificial Sequence
  Synthetic
ccugcaugacgucgggc

SEQ ID NO: 3336 - RNA, 17 nt, Artificial Sequence
  Synthetic
cugcaugacgucgggca

SEQ ID NO: 3337 - RNA, 17 nt, Artificial Sequence
  Synthetic
aggaucaguaucgagag

SEQ ID NO: 3338 - RNA, 17 nt, Artificial Sequence
  Synthetic
ggacuugaccgggggcu

SEQ ID NO: 3339 - RNA, 17 nt, Artificial Sequence
  Synthetic
aaaggcacucgggugau

SEQ ID NO: 3340 - RNA, 17 nt, Artificial Sequence
  Synthetic
uggacggagggaucucg

SEQ ID NO: 3341 - RNA, 17 nt, Artificial Sequence
  Synthetic
cccccaggcgcucuaug

SEQ ID NO: 3342 - RNA, 17 nt, Artificial Sequence
  Synthetic
ccgccauggauuucucu

SEQ ID NO: 3343 - RNA, 17 nt, Artificial Sequence
  Synthetic
ggcgcggucgugggcgu

SEQ ID NO: 3344 - RNA, 17 nt, Artificial Sequence
  Synthetic
aaccugaucccggagaa

SEQ ID NO: 3345 - RNA, 17 nt, Artificial Sequence
  Synthetic
caugcccugcaugacgu

SEQ ID NO: 3346 - RNA, 17 nt, Artificial Sequence
  Synthetic
cgcuggugccggguucc

SEQ ID NO: 3347 - RNA, 17 nt, Artificial Sequence
  Synthetic
ccuggaggccgcguagc

SEQ ID NO: 3348 - RNA, 17 nt, Artificial Sequence
  Synthetic
ccccugaccccgcgggu

SEQ ID NO: 3349 - RNA, 17 nt, Artificial Sequence
  Synthetic
gcuuaugcuucucgccc

SEQ ID NO: 3350 - RNA, 17 nt, Artificial Sequence
  Synthetic
aagucaugcgaguucug

SEQ ID NO: 3351 - RNA, 17 nt, Artificial Sequence
  Synthetic
caccaagucgcuggugc

SEQ ID NO: 3352 - RNA, 17 nt, Artificial Sequence
  Synthetic
cccgagugccuuugaca

SEQ ID NO: 3353 - RNA, 17 nt, Artificial Sequence
  Synthetic
caugacuuggacuugac

SEQ ID NO: 3354 - RNA, 17 nt, Artificial Sequence
  Synthetic
cgaccccaaccugaucc

SEQ ID NO: 3355 - RNA, 17 nt, Artificial Sequence
  Synthetic
accaagucgcuggugcc

SEQ ID NO: 3356 - RNA, 17 nt, Artificial Sequence
  Synthetic
aagugaugucucggugg

SEQ ID NO: 3357 - RNA, 17 nt, Artificial Sequence
  Synthetic
cuucuccacaccgcccg

SEQ ID NO: 3358 - RNA, 17 nt, Artificial Sequence
  Synthetic
uggagucuccgaagcua

SEQ ID NO: 3359 - RNA, 17 nt, Artificial Sequence
  Synthetic
cgcuucuccacaccgcc

SEQ ID NO: 3360 - RNA, 17 nt, Artificial Sequence
  Synthetic
gcuggugccggguuccg

SEQ ID NO: 3361 - RNA, 17 nt, Artificial Sequence
  Synthetic
cgcagcggcacgggaag

SEQ ID NO: 3362 - RNA, 17 nt, Artificial Sequence
  Synthetic
gcaucgcggccgggggc

SEQ ID NO: 3363 - RNA, 17 nt, Artificial Sequence
  Synthetic
gagcacuccucggagaa

SEQ ID NO: 3364 - RNA, 17 nt, Artificial Sequence
  Synthetic
ggggggcgucgccagga

SEQ ID NO: 3365 - RNA, 17 nt, Artificial Sequence
  Synthetic
gaaagcgcccuucugcc

SEQ ID NO: 3366 - RNA, 17 nt, Artificial Sequence
  Synthetic
cuggacggagggaucuc

SEQ ID NO: 3367 - RNA, 17 nt, Artificial Sequence
  Synthetic
cggcuucgggcugagcc

SEQ ID NO: 3368 - RNA, 17 nt, Artificial Sequence
  Synthetic
gggggcgucgccaggaa

SEQ ID NO: 3369 - RNA, 17 nt, Artificial Sequence
  Synthetic
uaaccuuugcauagggc

SEQ ID NO: 3370 - RNA, 17 nt, Artificial Sequence
  Synthetic
gggcgagucggccucgg

SEQ ID NO: 3371 - RNA, 17 nt, Artificial Sequence
  Synthetic
cacaccgcccggggagc

SEQ ID NO: 3372 - RNA, 17 nt, Artificial Sequence
  Synthetic
gggaucucggggcgcag

SEQ ID NO: 3373 - RNA, 17 nt, Artificial Sequence
  Synthetic
cucgcugaagugcugca

SEQ ID NO: 3374 - RNA, 17 nt, Artificial Sequence
  Synthetic
ucggggcgcagcggcac

SEQ ID NO: 3375 - RNA, 17 nt, Artificial Sequence
  Synthetic
aaguccccugaccccgc

SEQ ID NO: 3376 - RNA, 17 nt, Artificial Sequence
  Synthetic
gccuuuugccuccucgu

SEQ ID NO: 3377 - RNA, 17 nt, Artificial Sequence
  Synthetic
caccuggccgaggccga

SEQ ID NO: 3378 - RNA, 17 nt, Artificial Sequence
  Synthetic
gguaucccuucaggacu

SEQ ID NO: 3379 - RNA, 17 nt, Artificial Sequence
  Synthetic
gugguggacuaaacagg

SEQ ID NO: 3380 - RNA, 17 nt, Artificial Sequence
  Synthetic
gcgagcuguucucgugg

SEQ ID NO: 3381 - RNA, 17 nt, Artificial Sequence
  Synthetic
agcacuccucggagaac

SEQ ID NO: 3382 - RNA, 17 nt, Artificial Sequence
  Synthetic
caugcagcacuucagcg

SEQ ID NO: 3383 - RNA, 17 nt, Artificial Sequence
  Synthetic
uggccugggugcacgcg

SEQ ID NO: 3384 - RNA, 17 nt, Artificial Sequence
  Synthetic
agcgagaggguggacua

SEQ ID NO: 3385 - RNA, 17 nt, Artificial Sequence
  Synthetic
gcacagguugcacuugu

SEQ ID NO: 3386 - RNA, 17 nt, Artificial Sequence
  Synthetic
gagaaauccauggcggg

SEQ ID NO: 3387 - RNA, 17 nt, Artificial Sequence
  Synthetic
gcagaacucgcaugacu

SEQ ID NO: 3388 - RNA, 17 nt, Artificial Sequence
  Synthetic
ucuccgaagcuaaggaa

SEQ ID NO: 3389 - RNA, 17 nt, Artificial Sequence
  Synthetic
ugacgucgggcagggcg

SEQ ID NO: 3390 - RNA, 17 nt, Artificial Sequence
  Synthetic
ggguccaagugaugucu

SEQ ID NO: 3391 - RNA, 17 nt, Artificial Sequence
  Synthetic
gcaaccugguggugcac

SEQ ID NO: 3392 - RNA, 17 nt, Artificial Sequence
  Synthetic
gguggcgcgccgccucc

SEQ ID NO: 3393 - RNA, 17 nt, Artificial Sequence
  Synthetic
gcugcccaccaagucgc

SEQ ID NO: 3394 - RNA, 17 nt, Artificial Sequence
  Synthetic
guucucgcucuugaacu

SEQ ID NO: 3395 - RNA, 17 nt, Artificial Sequence
  Synthetic
ccgcagcacccugucaa

SEQ ID NO: 3396 - RNA, 17 nt, Artificial Sequence
  Synthetic
gaaguccccugaccccg

SEQ ID NO: 3397 - RNA, 17 nt, Artificial Sequence
  Synthetic
gcgcggccaccuggccg

SEQ ID NO: 3398 - RNA, 17 nt, Artificial Sequence
  Synthetic
ggcgucgccaggaaggg

SEQ ID NO: 3399 - RNA, 17 nt, Artificial Sequence
  Synthetic
guugaauccaauggcua

SEQ ID NO: 3400 - RNA, 17 nt, Artificial Sequence
  Synthetic
cucggggcgcagcggca

SEQ ID NO: 3401 - RNA, 17 nt, Artificial Sequence
  Synthetic
ccgaggccgagggccac

SEQ ID NO: 3402 - RNA, 17 nt, Artificial Sequence
  Synthetic
cuaaacagggggggagu

SEQ ID NO: 3403 - RNA, 17 nt, Artificial Sequence
  Synthetic
gcggcacgggaagugga

SEQ ID NO: 3404 - RNA, 17 nt, Artificial Sequence
  Synthetic
cacagguugcacuugua

SEQ ID NO: 3405 - RNA, 17 nt, Artificial Sequence
  Synthetic
cagcgaggccuuccacc

SEQ ID NO: 3406 - RNA, 17 nt, Artificial Sequence
  Synthetic
aaccugcuaagaauacc

SEQ ID NO: 3407 - RNA, 17 nt, Artificial Sequence
  Synthetic
auccugguauucuuagc

SEQ ID NO: 3408 - RNA, 17 nt, Artificial Sequence
  Synthetic
ggugguggacuaaacag

SEQ ID NO: 3409 - RNA, 17 nt, Artificial Sequence
  Synthetic
cgaggccgagggccaca

SEQ ID NO: 3410 - RNA, 17 nt, Artificial Sequence
  Synthetic
guacauguguagcugcu

SEQ ID NO: 3411 - RNA, 17 nt, Artificial Sequence
  Synthetic
uugaugcgcuuagagaa

SEQ ID NO: 3412 - RNA, 17 nt, Artificial Sequence
  Synthetic
uccucguccccguucuc

SEQ ID NO: 3413 - RNA, 17 nt, Artificial Sequence
  Synthetic
augacuuggacuugacc

SEQ ID NO: 3414 - RNA, 17 nt, Artificial Sequence
  Synthetic
gucuccgaagcuaagga

SEQ ID NO: 3415 - RNA, 17 nt, Artificial Sequence
  Synthetic
gguggacuaaacagggg

SEQ ID NO: 3416 - RNA, 17 nt, Artificial Sequence
  Synthetic
gcaugugcgucuucaug

SEQ ID NO: 3417 - RNA, 17 nt, Artificial Sequence
  Synthetic
ggcacucgggugauggg

SEQ ID NO: 3418 - RNA, 17 nt, Artificial Sequence
  Synthetic
auagggcugggccggcc

SEQ ID NO: 3419 - RNA, 17 nt, Artificial Sequence
  Synthetic
ccguccagcuccccggg

SEQ ID NO: 3420 - RNA, 17 nt, Artificial Sequence
  Synthetic
gcaguaaccuuugcaua

SEQ ID NO: 3421 - RNA, 17 nt, Artificial Sequence
  Synthetic
gaucccuuccuuagcuu

SEQ ID NO: 3422 - RNA, 17 nt, Artificial Sequence
  Synthetic
aaggggcucagcgagcu

SEQ ID NO: 3423 - RNA, 17 nt, Artificial Sequence
  Synthetic
agcugacggagagcgag

SEQ ID NO: 3424 - RNA, 17 nt, Artificial Sequence
  Synthetic
ucgcggggcgcggucgu

SEQ ID NO: 3425 - RNA, 17 nt, Artificial Sequence
  Synthetic
agcggcacgggaagugg

SEQ ID NO: 3426 - RNA, 17 nt, Artificial Sequence
  Synthetic
caaaggcacucggguga

SEQ ID NO: 3427 - RNA, 17 nt, Artificial Sequence
  Synthetic
cugcaccuaguccugaa

SEQ ID NO: 3428 - RNA, 17 nt, Artificial Sequence
  Synthetic
gcuggacggagggaucu

SEQ ID NO: 3429 - RNA, 17 nt, Artificial Sequence
  Synthetic
cccugucaaaggcacuc

SEQ ID NO: 3430 - RNA, 17 nt, Artificial Sequence
  Synthetic
aaccuuugcauagggcu

SEQ ID NO: 3431 - RNA, 17 nt, Artificial Sequence
  Synthetic
cgcccggggagcagccg

SEQ ID NO: 3432 - RNA, 17 nt, Artificial Sequence
  Synthetic
ugguggacuaaacaggg

SEQ ID NO: 3433 - RNA, 17 nt, Artificial Sequence
  Synthetic
ggcccagcccuaugcaa

SEQ ID NO: 3434 - RNA, 17 nt, Artificial Sequence
  Synthetic
ccucguccccguucucc

SEQ ID NO: 3435 - RNA, 17 nt, Artificial Sequence
  Synthetic
gccagcuccccggaacc

SEQ ID NO: 3436 - RNA, 17 nt, Artificial Sequence
  Synthetic
gccggguuccggggagc

SEQ ID NO: 3437 - RNA, 17 nt, Artificial Sequence
  Synthetic
ugcaguaaccuuugcau

SEQ ID NO: 3438 - RNA, 17 nt, Artificial Sequence
  Synthetic
gcuucucgcccaggacc

SEQ ID NO: 3439 - RNA, 17 nt, Artificial Sequence
  Synthetic
ccgcccggggagcugga

SEQ ID NO: 3440 - RNA, 17 nt, Artificial Sequence
  Synthetic
ccggggagcuggacgga

SEQ ID NO: 3441 - RNA, 17 nt, Artificial Sequence
  Synthetic
cuuccggccuggcagaa

SEQ ID NO: 3442 - RNA, 17 nt, Artificial Sequence
  Synthetic
ccuagagaaauccaugg

SEQ ID NO: 3443 - RNA, 17 nt, Artificial Sequence
  Synthetic
ggagggggggcgucgcc

SEQ ID NO: 3444 - RNA, 17 nt, Artificial Sequence
  Synthetic
uacuuagaaagcgaaca

SEQ ID NO: 3445 - RNA, 17 nt, Artificial Sequence
  Synthetic
ggaggcuccauagccau

SEQ ID NO: 3446 - RNA, 17 nt, Artificial Sequence
  Synthetic
acacaucuugagcucuc

SEQ ID NO: 3447 - RNA, 17 nt, Artificial Sequence
  Synthetic
ggcaccagcgacuuggu

SEQ ID NO: 3448 - RNA, 17 nt, Artificial Sequence
  Synthetic
gggaucuuugagcugcc

SEQ ID NO: 3449 - RNA, 17 nt, Artificial Sequence
  Synthetic
gcagcagcuuuuuggac

SEQ ID NO: 3450 - RNA, 17 nt, Artificial Sequence
  Synthetic
cugcaauaugaauccca

SEQ ID NO: 3451 - RNA, 17 nt, Artificial Sequence
  Synthetic
ucugcaccuaguccuga

SEQ ID NO: 3452 - RNA, 17 nt, Artificial Sequence
  Synthetic
gaaggggcucagcgagc

SEQ ID NO: 3453 - RNA, 17 nt, Artificial Sequence
  Synthetic
uuccggggagcuggcgg

SEQ ID NO: 3454 - RNA, 17 nt, Artificial Sequence
  Synthetic
gcaccggcgcagccaca

SEQ ID NO: 3455 - RNA, 17 nt, Artificial Sequence
  Synthetic
auaugaaucccauggag

SEQ ID NO: 3456 - RNA, 17 nt, Artificial Sequence
  Synthetic
gugguccgggcccgggc

SEQ ID NO: 3457 - RNA, 17 nt, Artificial Sequence
  Synthetic
cuucacacacccccauu

SEQ ID NO: 3458 - RNA, 17 nt, Artificial Sequence
  Synthetic
guccaaaaagcugcugc

SEQ ID NO: 3459 - RNA, 17 nt, Artificial Sequence
  Synthetic
cggcaccagcgacuugg

SEQ ID NO: 3460 - RNA, 17 nt, Artificial Sequence
  Synthetic
gcuucuccacaccgccc

SEQ ID NO: 3461 - RNA, 17 nt, Artificial Sequence
  Synthetic
cgcccguguggcugcgc

SEQ ID NO: 3462 - RNA, 17 nt, Artificial Sequence
  Synthetic
cacgcacagaacacuca

SEQ ID NO: 3463 - RNA, 17 nt, Artificial Sequence
  Synthetic
uguacauguguagcugc

SEQ ID NO: 3464 - RNA, 17 nt, Artificial Sequence
  Synthetic
caccggcgcagccacac

SEQ ID NO: 3465 - RNA, 17 nt, Artificial Sequence
  Synthetic
uugcuaccuggcuggaa

SEQ ID NO: 3466 - RNA, 17 nt, Artificial Sequence
  Synthetic
acccugucaaaggcacu

SEQ ID NO: 3467 - RNA, 17 nt, Artificial Sequence
  Synthetic
ccaccuggccgaggccg

SEQ ID NO: 3468 - RNA, 17 nt, Artificial Sequence
  Synthetic
gggcggauugcagagga

SEQ ID NO: 3469 - RNA, 17 nt, Artificial Sequence
  Synthetic
cuagagaaauccauggc

SEQ ID NO: 3470 - RNA, 17 nt, Artificial Sequence
  Synthetic
ggcggaagagauggccc

SEQ ID NO: 3471 - RNA, 17 nt, Artificial Sequence
  Synthetic
ggggcggauugcagagg

SEQ ID NO: 3472 - RNA, 17 nt, Artificial Sequence
  Synthetic
guguggcaguuuucgga

SEQ ID NO: 3473 - RNA, 17 nt, Artificial Sequence
  Synthetic
gagagaggcuuccggcc

SEQ ID NO: 3474 - RNA, 17 nt, Artificial Sequence
  Synthetic
cgggugauggguggcca

SEQ ID NO: 3475 - RNA, 17 nt, Artificial Sequence
  Synthetic
cccggggagcuggacgg

SEQ ID NO: 3476 - RNA, 17 nt, Artificial Sequence
  Synthetic
uaggagacuuagagagc

SEQ ID NO: 3477 - RNA, 17 nt, Artificial Sequence
  Synthetic
cacaucuugagcucucu

SEQ ID NO: 3478 - RNA, 17 nt, Artificial Sequence
  Synthetic
ccucggccucggccagg

SEQ ID NO: 3479 - RNA, 17 nt, Artificial Sequence
  Synthetic
ggccuuccaccaggucc

SEQ ID NO: 3480 - RNA, 17 nt, Artificial Sequence
  Synthetic
ucucgcccaggaccugg

SEQ ID NO: 3481 - RNA, 17 nt, Artificial Sequence
  Synthetic
ucugcccucuuuugagc

SEQ ID NO: 3482 - RNA, 17 nt, Artificial Sequence
  Synthetic
acuaaacagggggggag

SEQ ID NO: 3483 - RNA, 17 nt, Artificial Sequence
  Synthetic
cuugaccgggggcuggg

SEQ ID NO: 3484 - RNA, 17 nt, Artificial Sequence
  Synthetic
uugaccgggggcuggga

SEQ ID NO: 3485 - RNA, 17 nt, Artificial Sequence
  Synthetic
agacuuagagagcuggc

SEQ ID NO: 3486 - RNA, 17 nt, Artificial Sequence
  Synthetic
agcccaccgcugucccc

SEQ ID NO: 3487 - RNA, 17 nt, Artificial Sequence
  Synthetic
agccauucaccagugca

SEQ ID NO: 3488 - RNA, 17 nt, Artificial Sequence
  Synthetic
gcuuccggccuggcaga

SEQ ID NO: 3489 - RNA, 17 nt, Artificial Sequence
  Synthetic
gacuuagagagcuggca

SEQ ID NO: 3490 - RNA, 17 nt, Artificial Sequence
  Synthetic
aggcccagcucaaaaga

SEQ ID NO: 3491 - RNA, 17 nt, Artificial Sequence
  Synthetic
ucgggugauggguggcc

SEQ ID NO: 3492 - RNA, 17 nt, Artificial Sequence
  Synthetic
caagagaaaccaugcac

SEQ ID NO: 3493 - RNA, 17 nt, Artificial Sequence
  Synthetic
aucuuugagcugccugg

SEQ ID NO: 3494 - RNA, 17 nt, Artificial Sequence
  Synthetic
uauucuuagcagguuaa

SEQ ID NO: 3495 - RNA, 17 nt, Artificial Sequence
  Synthetic
cugcccucuuuugagcu

SEQ ID NO: 3496 - RNA, 17 nt, Artificial Sequence
  Synthetic
ccaucucuuccgccccc

SEQ ID NO: 3497 - RNA, 17 nt, Artificial Sequence
  Synthetic
uggccgcggcugcuccc

SEQ ID NO: 3498 - RNA, 17 nt, Artificial Sequence
  Synthetic
ccuguggcccucggccu

SEQ ID NO: 3499 - RNA, 17 nt, Artificial Sequence
  Synthetic
cagcuccccgggcggug

SEQ ID NO: 3500 - RNA, 17 nt, Artificial Sequence
  Synthetic
uuugcauagggcugggc

SEQ ID NO: 3501 - RNA, 17 nt, Artificial Sequence
  Synthetic
ggcccucggccucggcc

SEQ ID NO: 3502 - RNA, 17 nt, Artificial Sequence
  Synthetic
gcugacggagagcgaga

SEQ ID NO: 3503 - RNA, 17 nt, Artificial Sequence
  Synthetic
agauguguggcaguuuu

SEQ ID NO: 3504 - RNA, 17 nt, Artificial Sequence
  Synthetic
auucuuagcagguuaaa

SEQ ID NO: 3505 - RNA, 17 nt, Artificial Sequence
  Synthetic
ucuccuagagaaaucca

SEQ ID NO: 3506 - RNA, 17 nt, Artificial Sequence
  Synthetic
ccuuugacagggugcug

SEQ ID NO: 3507 - RNA, 17 nt, Artificial Sequence
  Synthetic
ggaggggcggauugcag

SEQ ID NO: 3508 - RNA, 17 nt, Artificial Sequence
  Synthetic
uucuuagcagguuaaag

SEQ ID NO: 3509 - RNA, 17 nt, Artificial Sequence
  Synthetic
cggauugcagaggaggg

SEQ ID NO: 3510 - RNA, 17 nt, Artificial Sequence
  Synthetic
uuugagcugggccugcc

SEQ ID NO: 3511 - RNA, 17 nt, Artificial Sequence
  Synthetic
cuucagcuugcuggccu

SEQ ID NO: 3512 - RNA, 17 nt, Artificial Sequence
  Synthetic
cuugaacuuggccacca

SEQ ID NO: 3513 - RNA, 17 nt, Artificial Sequence
  Synthetic
cugcaaccauuccagcc

SEQ ID NO: 3514 - RNA, 17 nt, Artificial Sequence
  Synthetic
cauagagcgccuggggg

SEQ ID NO: 3515 - RNA, 17 nt, Artificial Sequence
  Synthetic
gggcgcggucgugggcg

SEQ ID NO: 3516 - RNA, 17 nt, Artificial Sequence
  Synthetic
ucccauggagagguggc

SEQ ID NO: 3517 - RNA, 17 nt, Artificial Sequence
  Synthetic
ggccgcggcugcucccc

SEQ ID NO: 3518 - RNA, 17 nt, Artificial Sequence
  Synthetic
auuucagagcaaccugg

SEQ ID NO: 3519 - RNA, 17 nt, Artificial Sequence
  Synthetic
gccuuccaccagguccu

SEQ ID NO: 3520 - RNA, 17 nt, Artificial Sequence
  Synthetic
ugaaucccauggagagg

SEQ ID NO: 3521 - RNA, 17 nt, Artificial Sequence
  Synthetic
uugagcugggccugccc

SEQ ID NO: 3522 - RNA, 17 nt, Artificial Sequence
  Synthetic
aggggcucagcgagcug

SEQ ID NO: 3523 - RNA, 17 nt, Artificial Sequence
  Synthetic
agggcuucucgcccgug

SEQ ID NO: 3524 - RNA, 17 nt, Artificial Sequence
  Synthetic
caccgcuguccccaggc

SEQ ID NO: 3525 - RNA, 17 nt, Artificial Sequence
  Synthetic
caaauuucagagcaacc

SEQ ID NO: 3526 - RNA, 17 nt, Artificial Sequence
  Synthetic
agagagcucaagaugug

SEQ ID NO: 3527 - RNA, 17 nt, Artificial Sequence
  Synthetic
aaccaugcacuggugaa

SEQ ID NO: 3528 - RNA, 17 nt, Artificial Sequence
  Synthetic
ccuccguccagcucccc

SEQ ID NO: 3529 - RNA, 17 nt, Artificial Sequence
  Synthetic
agugucccuguggcccu

SEQ ID NO: 3530 - RNA, 17 nt, Artificial Sequence
  Synthetic
cccuccguccagcuccc

SEQ ID NO: 3531 - RNA, 17 nt, Artificial Sequence
  Synthetic
ggccuggggacagcggu

SEQ ID NO: 3532 - RNA, 17 nt, Artificial Sequence
  Synthetic
gcccagcagcagcuuuu

SEQ ID NO: 3533 - RNA, 17 nt, Artificial Sequence
  Synthetic
caggcccagcucaaaag

SEQ ID NO: 3534 - RNA, 17 nt, Artificial Sequence
  Synthetic
cuucgggcugagccugg

SEQ ID NO: 3535 - RNA, 17 nt, Artificial Sequence
  Synthetic
cccauggagagguggcu

SEQ ID NO: 3536 - RNA, 17 nt, Artificial Sequence
  Synthetic
cccagccaccucuccau

SEQ ID NO: 3537 - RNA, 17 nt, Artificial Sequence
  Synthetic
ggguuccggggagcugg

SEQ ID NO: 3538 - RNA, 17 nt, Artificial Sequence
  Synthetic
uagggcugggccggccu

SEQ ID NO: 3539 - RNA, 17 nt, Artificial Sequence
  Synthetic
ccugggggcggaagaga

SEQ ID NO: 3540 - RNA, 17 nt, Artificial Sequence
  Synthetic
gcccaggaccuggugga

SEQ ID NO: 3541 - RNA, 17 nt, Artificial Sequence
  Synthetic
cgggcugagccuggagg

SEQ ID NO: 3542 - RNA, 17 nt, Artificial Sequence
  Synthetic
accacgagaacagcucg

SEQ ID NO: 3543 - RNA, 17 nt, Artificial Sequence
  Synthetic
cggccuggggacagcgg

SEQ ID NO: 3544 - RNA, 17 nt, Artificial Sequence
  Synthetic
uccaaaaagcugcugcu

SEQ ID NO: 3545 - RNA, 17 nt, Artificial Sequence
  Synthetic
gcgcccuucugccaggc

SEQ ID NO: 3546 - RNA, 17 nt, Artificial Sequence
  Synthetic
ucccagccaccucucca

SEQ ID NO: 3547 - RNA, 17 nt, Artificial Sequence
  Synthetic
cuccaccgccagcuccc

SEQ ID NO: 3548 - RNA, 17 nt, Artificial Sequence
  Synthetic
cugggccugcccgggcc

SEQ ID NO: 3549 - RNA, 17 nt, Artificial Sequence
  Synthetic
agggcugggccggccug

SEQ ID NO: 3550 - RNA, 17 nt, Artificial Sequence
  Synthetic
aacagggggggaguggg

SEQ ID NO: 3551 - RNA, 17 nt, Artificial Sequence
  Synthetic
ggagaacggggacgagg

SEQ ID NO: 3552 - RNA, 17 nt, Artificial Sequence
  Synthetic
ugaugcgcuuagagaag

SEQ ID NO: 3553 - RNA, 17 nt, Artificial Sequence
  Synthetic
ggauugcagaggaggga

SEQ ID NO: 3554 - RNA, 17 nt, Artificial Sequence
  Synthetic
ggccggccuggggacag

SEQ ID NO: 3555 - RNA, 17 nt, Artificial Sequence
  Synthetic
gauugcagaggagggag

SEQ ID NO: 3556 - RNA, 17 nt, Artificial Sequence
  Synthetic
auugcagaggagggagg

SEQ ID NO: 3557 - RNA, 17 nt, Artificial Sequence
  Synthetic
accgggggcugggaggg

SEQ ID NO: 3558 - RNA, 17 nt, Artificial Sequence
  Synthetic
uggagagguggcuggga

SEQ ID NO: 3559 - RNA, 17 nt, Artificial Sequence
  Synthetic
uugcagaggagggaggg

SEQ ID NO: 3560 - RNA, 17 nt, Artificial Sequence
  Synthetic
cggggacgaggaggaag

SEQ ID NO: 3561 - RNA, 17 nt, Artificial Sequence
  Synthetic
gacggagagcgagaggg

SEQ ID NO: 3562 - RNA, 17 nt, Artificial Sequence
  Synthetic
uccucccucccagcccc

SEQ ID NO: 3563 - RNA, 17 nt, Artificial Sequence
  Synthetic
gcuucagcuugcuggcc

SEQ ID NO: 3564 - RNA, 17 nt, Artificial Sequence
  Synthetic
ugcagaggagggagggg

SEQ ID NO: 3565 - RNA, 17 nt, Artificial Sequence
  Synthetic
gggcugggagggaggag

SEQ ID NO: 3566 - RNA, 17 nt, Artificial Sequence
  Synthetic
ggaagaggaggacgacg

SEQ ID NO: 3567 - RNA, 17 nt, Artificial Sequence
  Synthetic
ggggcugggagggagga

SEQ ID NO: 3568 - RNA, 17 nt, Artificial Sequence
  Synthetic
ggaggacgacgaggaag

SEQ ID NO: 3569 - RNA, 17 nt, Artificial Sequence
  Synthetic
ggaggaggaggagcuga

SEQ ID NO: 3570 - RNA, 17 nt, Artificial Sequence
  Synthetic
gggggcugggagggagg

SEQ ID NO: 3571 - RNA, 17 nt, Artificial Sequence
  Synthetic
cugggagggaggagggg

SEQ ID NO: 3572 - RNA, 17 nt, Artificial Sequence
  Synthetic
cgaggaagaggaagaag

SEQ ID NO: 3573 - RNA, 17 nt, Artificial Sequence
  Synthetic
ggacgaggaggaagagg

SEQ ID NO: 3574 - RNA, 17 nt, Artificial Sequence
  Synthetic
ggaagaagaggaggaag

SEQ ID NO: 3575 - RNA, 17 nt, Artificial Sequence
  Synthetic
ggaagaggaagaagagg

SEQ ID NO: 3576 - RNA, 17 nt, Artificial Sequence
  Synthetic
agaagaggaggaagagg

SEQ ID NO: 3577 - RNA, 17 nt, Artificial Sequence
  Synthetic
agaggaggaagaggagg

SEQ ID NO: 3578 - RNA, 17 nt, Artificial Sequence
  Synthetic
ggaggaagaggaggagg

SEQ ID NO: 3579 - RNA, 20 nt, Artificial Sequence
  Synthetic
gucuaugcgguccgacucgc

SEQ ID NO: 3580 - RNA, 20 nt, Artificial Sequence
  Synthetic
ucgucggacuugaccgucau

SEQ ID NO: 3581 - RNA, 20 nt, Artificial Sequence
  Synthetic
cgucggacuugaccgucaug

SEQ ID NO: 3582 - RNA, 20 nt, Artificial Sequence
  Synthetic
augacggucaaguccgacga

SEQ ID NO: 3583 - RNA, 20 nt, Artificial Sequence
  Synthetic
gagucggaccgcauagacga

SEQ ID NO: 3584 - RNA, 20 nt, Artificial Sequence
  Synthetic
cgggcccggaccacuaauau

SEQ ID NO: 3585 - RNA, 20 nt, Artificial Sequence
  Synthetic
gucgucggacuugaccguca

SEQ ID NO: 3586 - RNA, 20 nt, Artificial Sequence
  Synthetic
cucuggguacuacgccgaau

SEQ ID NO: 3587 - RNA, 20 nt, Artificial Sequence
  Synthetic
cuggguacuacgccgaaugg

SEQ ID NO: 3588 - RNA, 20 nt, Artificial Sequence
  Synthetic
ccgggcccggaccacuaaua

SEQ ID NO: 3589 - RNA, 20 nt, Artificial Sequence
  Synthetic
ccgcggguugguaucccuuc

SEQ ID NO: 3590 - RNA, 20 nt, Artificial Sequence
  Synthetic
ucuggguacuacgccgaaug

SEQ ID NO: 3591 - RNA, 20 nt, Artificial Sequence
  Synthetic
ggauaccaacccgcgggguc

SEQ ID NO: 3592 - RNA, 20 nt, Artificial Sequence
  Synthetic
acgccccauauuaguggucc

SEQ ID NO: 3593 - RNA, 20 nt, Artificial Sequence
  Synthetic
cacuugcgacgaagacucgg

SEQ ID NO: 3594 - RNA, 20 nt, Artificial Sequence
  Synthetic
ucucuggguacuacgccgaa

SEQ ID NO: 3595 - RNA, 20 nt, Artificial Sequence
  Synthetic
uaagcgcaucaagcucgaga

SEQ ID NO: 3596 - RNA, 20 nt, Artificial Sequence
  Synthetic
ugcgacgaagacucgguggc

SEQ ID NO: 3597 - RNA, 20 nt, Artificial Sequence
  Synthetic
cgcgcuuaugcuucucgccc

SEQ ID NO: 3598 - RNA, 20 nt, Artificial Sequence
  Synthetic
ugaagggauaccaacccgcg

SEQ ID NO: 3599 - RNA, 20 nt, Artificial Sequence
  Synthetic
gggcccggaccacuaauaug

SEQ ID NO: 3600 - RNA, 20 nt, Artificial Sequence
  Synthetic
cguguugggcaucgcggccg

SEQ ID NO: 3601 - RNA, 20 nt, Artificial Sequence
  Synthetic
uccguguugggcaucgcggc

SEQ ID NO: 3602 - RNA, 20 nt, Artificial Sequence
  Synthetic
gucggacuugaccgucaugg

SEQ ID NO: 3603 - RNA, 20 nt, Artificial Sequence
  Synthetic
gcgcaaacucccguucuccg

SEQ ID NO: 3604 - RNA, 20 nt, Artificial Sequence
  Synthetic
cuccgaggagugcuccgacg

SEQ ID NO: 3605 - RNA, 20 nt, Artificial Sequence
  Synthetic
cacggacuugagcgcgcugc

SEQ ID NO: 3606 - RNA, 20 nt, Artificial Sequence
  Synthetic
cacgccccauauuagugguc

SEQ ID NO: 3607 - RNA, 20 nt, Artificial Sequence
  Synthetic
gauaccaacccgcgggguca

SEQ ID NO: 3608 - RNA, 20 nt, Artificial Sequence
  Synthetic
cagcgcgcucaaguccgugg

SEQ ID NO: 3609 - RNA, 20 nt, Artificial Sequence
  Synthetic
gggugcacgcguggucgcac

SEQ ID NO: 3610 - RNA, 20 nt, Artificial Sequence
  Synthetic
gaagcauaagcgcggccacc

SEQ ID NO: 3611 - RNA, 20 nt, Artificial Sequence
  Synthetic
gugcgaccacgcgugcaccc

SEQ ID NO: 3612 - RNA, 20 nt, Artificial Sequence
  Synthetic
gaguacacguucuccguguu

SEQ ID NO: 3613 - RNA, 20 nt, Artificial Sequence
  Synthetic
gucucggugguggacuaaac

SEQ ID NO: 3614 - RNA, 20 nt, Artificial Sequence
  Synthetic
ccguucuccgggaucagguu

SEQ ID NO: 3615 - RNA, 20 nt, Artificial Sequence
  Synthetic
cgaguacacguucuccgugu

SEQ ID NO: 3616 - RNA, 20 nt, Artificial Sequence
  Synthetic
cggagaacguguacucgcag

SEQ ID NO: 3617 - RNA, 20 nt, Artificial Sequence
  Synthetic
gggagcacgccccauauuag

SEQ ID NO: 3618 - RNA, 20 nt, Artificial Sequence
  Synthetic
ccauauuagugguccgggcc

SEQ ID NO: 3619 - RNA, 20 nt, Artificial Sequence
  Synthetic
gccgcagaacucgcaugacu

SEQ ID NO: 3620 - RNA, 20 nt, Artificial Sequence
  Synthetic
cgccccgcgagcuguucucg

SEQ ID NO: 3621 - RNA, 20 nt, Artificial Sequence
  Synthetic
gcaguggcucgccggcuacg

SEQ ID NO: 3622 - RNA, 20 nt, Artificial Sequence
  Synthetic
cauauuagugguccgggccc

SEQ ID NO: 3623 - RNA, 20 nt, Artificial Sequence
  Synthetic
cugaagggauaccaacccgc

SEQ ID NO: 3624 - RNA, 20 nt, Artificial Sequence
  Synthetic
auaccaacccgcggggucag

SEQ ID NO: 3625 - RNA, 20 nt, Artificial Sequence
  Synthetic
cagcagcgcgcucaaguccg

SEQ ID NO: 3626 - RNA, 20 nt, Artificial Sequence
  Synthetic
cguccccguucuccgggauc

SEQ ID NO: 3627 - RNA, 20 nt, Artificial Sequence
  Synthetic
caccacgagaacagcucgcg

SEQ ID NO: 3628 - RNA, 20 nt, Artificial Sequence
  Synthetic
gcgguugaauccaauggcua

SEQ ID NO: 3629 - RNA, 20 nt, Artificial Sequence
  Synthetic
ggacacuugcgacgaagacu

SEQ ID NO: 3630 - RNA, 20 nt, Artificial Sequence
  Synthetic
guguugggcaucgcggccgg

SEQ ID NO: 3631 - RNA, 20 nt, Artificial Sequence
  Synthetic
cuucgucgcaagugucccug

SEQ ID NO: 3632 - RNA, 20 nt, Artificial Sequence
  Synthetic
ccccaggcgcucuaugcggu

SEQ ID NO: 3633 - RNA, 20 nt, Artificial Sequence
  Synthetic
ccguguugggcaucgcggcc

SEQ ID NO: 3634 - RNA, 20 nt, Artificial Sequence
  Synthetic
cguucuccgggaucagguug

SEQ ID NO: 3635 - RNA, 20 nt, Artificial Sequence
  Synthetic
gccucucucgauacugaucc

SEQ ID NO: 3636 - RNA, 20 nt, Artificial Sequence
  Synthetic
ucgcaugacuuggacuugac

SEQ ID NO: 3637 - RNA, 20 nt, Artificial Sequence
  Synthetic
aucacccgagugccuuugac

SEQ ID NO: 3638 - RNA, 20 nt, Artificial Sequence
  Synthetic
uaagcgcggccaccuggccg

SEQ ID NO: 3639 - RNA, 20 nt, Artificial Sequence
  Synthetic
gcacaaaucgucccccauga

SEQ ID NO: 3640 - RNA, 20 nt, Artificial Sequence
  Synthetic
cgcccugcccgacgucaugc

SEQ ID NO: 3641 - RNA, 20 nt, Artificial Sequence
  Synthetic
caaccugaucccggagaacg

SEQ ID NO: 3642 - RNA, 20 nt, Artificial Sequence
  Synthetic
cggagcacuccucggagaac

SEQ ID NO: 3643 - RNA, 20 nt, Artificial Sequence
  Synthetic
agacucgguggccggcgagu

SEQ ID NO: 3644 - RNA, 20 nt, Artificial Sequence
  Synthetic
ggcgguggagagaccgucgu

SEQ ID NO: 3645 - RNA, 20 nt, Artificial Sequence
  Synthetic
guguacucgcaguggcucgc

SEQ ID NO: 3646 - RNA, 20 nt, Artificial Sequence
  Synthetic
ucggagcacuccucggagaa

SEQ ID NO: 3647 - RNA, 20 nt, Artificial Sequence
  Synthetic
cccggccgcgaugcccaaca

SEQ ID NO: 3648 - RNA, 20 nt, Artificial Sequence
  Synthetic
cccguucuccgggaucaggu

SEQ ID NO: 3649 - RNA, 20 nt, Artificial Sequence
  Synthetic
ucggugguggacuaaacagg

SEQ ID NO: 3650 - RNA, 20 nt, Artificial Sequence
  Synthetic
ccugaagggauaccaacccg

SEQ ID NO: 3651 - RNA, 20 nt, Artificial Sequence
  Synthetic
gucguucucgcucuugaacu

SEQ ID NO: 3652 - RNA, 20 nt, Artificial Sequence
  Synthetic
ccccaccgcauagagcgccu

SEQ ID NO: 3653 - RNA, 20 nt, Artificial Sequence
  Synthetic
gucgcuggugccggguuccg

SEQ ID NO: 3654 - RNA, 20 nt, Artificial Sequence
  Synthetic
cgagaacagcucgcggggcg

SEQ ID NO: 3655 - RNA, 20 nt, Artificial Sequence
  Synthetic
cgcaugacuuggacuugacc

SEQ ID NO: 3656 - RNA, 20 nt, Artificial Sequence
  Synthetic
cccaccgcauagagcgccug

SEQ ID NO: 3657 - RNA, 20 nt, Artificial Sequence
  Synthetic
aagucgcuggugccggguuc

SEQ ID NO: 3658 - RNA, 20 nt, Artificial Sequence
  Synthetic
cgaggagugcuccgacgagg

SEQ ID NO: 3659 - RNA, 20 nt, Artificial Sequence
  Synthetic
uccccgggcgagucggccuc

SEQ ID NO: 3660 - RNA, 20 nt, Artificial Sequence
  Synthetic
cuccccgggcgagucggccu

SEQ ID NO: 3661 - RNA, 20 nt, Artificial Sequence
  Synthetic
caugacuuggacuugaccgg

SEQ ID NO: 3662 - RNA, 20 nt, Artificial Sequence
  Synthetic
agcucgcggggcgcggucgu

SEQ ID NO: 3663 - RNA, 20 nt, Artificial Sequence
  Synthetic
ugcuccgacgaggaggcaaa

SEQ ID NO: 3664 - RNA, 20 nt, Artificial Sequence
  Synthetic
cuuuuuggacaggccccccg

SEQ ID NO: 3665 - RNA, 20 nt, Artificial Sequence
  Synthetic
cuacggcuucgggcugagcc

SEQ ID NO: 3666 - RNA, 20 nt, Artificial Sequence
  Synthetic
ccccgggcgagucggccucg

SEQ ID NO: 3667 - RNA, 20 nt, Artificial Sequence
  Synthetic
uaacagugccaucgucuaug

SEQ ID NO: 3668 - RNA, 20 nt, Artificial Sequence
  Synthetic
cuccucgucggagcacuccu

SEQ ID NO: 3669 - RNA, 20 nt, Artificial Sequence
  Synthetic
cccggcaccagcgacuuggu

SEQ ID NO: 3670 - RNA, 20 nt, Artificial Sequence
  Synthetic
gcgcuucuccacaccgcccg

SEQ ID NO: 3671 - RNA, 20 nt, Artificial Sequence
  Synthetic
cucggugguggacuaaacag

SEQ ID NO: 3672 - RNA, 20 nt, Artificial Sequence
  Synthetic
cccccaccgcauagagcgcc

SEQ ID NO: 3673 - RNA, 20 nt, Artificial Sequence
  Synthetic
gaucccggagaacggggacg

SEQ ID NO: 3674 - RNA, 20 nt, Artificial Sequence
  Synthetic
ccaggcgcucuaugcggugg

SEQ ID NO: 3675 - RNA, 20 nt, Artificial Sequence
  Synthetic
uuagugguccgggcccgggc

SEQ ID NO: 3676 - RNA, 20 nt, Artificial Sequence
  Synthetic
cccaggcgcucuaugcggug

SEQ ID NO: 3677 - RNA, 20 nt, Artificial Sequence
  Synthetic
cggcugcuccccgggcgagu

SEQ ID NO: 3678 - RNA, 20 nt, Artificial Sequence
  Synthetic
ucgccggcuacgcggccucc

SEQ ID NO: 3679 - RNA, 20 nt, Artificial Sequence
  Synthetic
aucgagagaggcuuccggcc

SEQ ID NO: 3680 - RNA, 20 nt, Artificial Sequence
  Synthetic
ggguccaagugaugucucgg

SEQ ID NO: 3681 - RNA, 20 nt, Artificial Sequence
  Synthetic
aucgccuuuugccuccucgu

SEQ ID NO: 3682 - RNA, 20 nt, Artificial Sequence
  Synthetic
aucucggggcgcagcggcac

SEQ ID NO: 3683 - RNA, 20 nt, Artificial Sequence
  Synthetic
cggugguggacuaaacaggg

SEQ ID NO: 3684 - RNA, 20 nt, Artificial Sequence
  Synthetic
gauggcacuguuaauggccg

SEQ ID NO: 3685 - RNA, 20 nt, Artificial Sequence
  Synthetic
ugcccugcaugacgucgggc

SEQ ID NO: 3686 - RNA, 20 nt, Artificial Sequence
  Synthetic
ucucggugguggacuaaaca

SEQ ID NO: 3687 - RNA, 20 nt, Artificial Sequence
  Synthetic
agaggguggacuacggcuuc

SEQ ID NO: 3688 - RNA, 20 nt, Artificial Sequence
  Synthetic
ccccgaggccgacucgcccg

SEQ ID NO: 3689 - RNA, 20 nt, Artificial Sequence
  Synthetic
gaucucggggcgcagcggca

SEQ ID NO: 3690 - RNA, 20 nt, Artificial Sequence
  Synthetic
acggaaguccccugaccccg

SEQ ID NO: 3691 - RNA, 20 nt, Artificial Sequence
  Synthetic
acucgcccggggagcagccg

SEQ ID NO: 3692 - RNA, 20 nt, Artificial Sequence
  Synthetic
uugcgcuucuccacaccgcc

SEQ ID NO: 3693 - RNA, 20 nt, Artificial Sequence
  Synthetic
ggaacccggcaccagcgacu

SEQ ID NO: 3694 - RNA, 20 nt, Artificial Sequence
  Synthetic
gcaugacuuggacuugaccg

SEQ ID NO: 3695 - RNA, 20 nt, Artificial Sequence
  Synthetic
uaauggccgcggcugcuccc

SEQ ID NO: 3696 - RNA, 20 nt, Artificial Sequence
  Synthetic
ccgggcgagucggccucggg

SEQ ID NO: 3697 - RNA, 20 nt, Artificial Sequence
  Synthetic
gucaaaggcacucgggugau

SEQ ID NO: 3698 - RNA, 20 nt, Artificial Sequence
  Synthetic
ggugcugcgguugaauccaa

SEQ ID NO: 3699 - RNA, 20 nt, Artificial Sequence
  Synthetic
cugggcgagaagcauaagcg

SEQ ID NO: 3700 - RNA, 20 nt, Artificial Sequence
  Synthetic
acuuggacuugaccgggggc

SEQ ID NO: 3701 - RNA, 20 nt, Artificial Sequence
  Synthetic
ccccccgaggccgacucgcc

SEQ ID NO: 3702 - RNA, 20 nt, Artificial Sequence
  Synthetic
ccaccgcauagagcgccugg

SEQ ID NO: 3703 - RNA, 20 nt, Artificial Sequence
  Synthetic
agucgcuggugccggguucc

SEQ ID NO: 3704 - RNA, 20 nt, Artificial Sequence
  Synthetic
ucgcacagguugcacuugua

SEQ ID NO: 3705 - RNA, 20 nt, Artificial Sequence
  Synthetic
gcccugcaugacgucgggca

SEQ ID NO: 3706 - RNA, 20 nt, Artificial Sequence
  Synthetic
ccgcccccaggcgcucuaug

SEQ ID NO: 3707 - RNA, 20 nt, Artificial Sequence
  Synthetic
gcccugcccgacgucaugca

SEQ ID NO: 3708 - RNA, 20 nt, Artificial Sequence
  Synthetic
gucgcacagguugcacuugu

SEQ ID NO: 3709 - RNA, 20 nt, Artificial Sequence
  Synthetic
agguagcaagccgcccuucc

SEQ ID NO: 3710 - RNA, 20 nt, Artificial Sequence
  Synthetic
ccaaccugaucccggagaac

SEQ ID NO: 3711 - RNA, 20 nt, Artificial Sequence
  Synthetic
aggaagggcggcuugcuacc

SEQ ID NO: 3712 - RNA, 20 nt, Artificial Sequence
  Synthetic
gaaggaguucgaccugcccc

SEQ ID NO: 3713 - RNA, 20 nt, Artificial Sequence
  Synthetic
cuuggacuugaccgggggcu

SEQ ID NO: 3714 - RNA, 20 nt, Artificial Sequence
  Synthetic
gagaggguggacuacggcuu

SEQ ID NO: 3715 - RNA, 20 nt, Artificial Sequence
  Synthetic
uccaagucaugcgaguucug

SEQ ID NO: 3716 - RNA, 20 nt, Artificial Sequence
  Synthetic
acccggcaccagcgacuugg

SEQ ID NO: 3717 - RNA, 20 nt, Artificial Sequence
  Synthetic
cccccaggcgcucuaugcgg

SEQ ID NO: 3718 - RNA, 20 nt, Artificial Sequence
  Synthetic
gcgucugcccucuuuugagc

SEQ ID NO: 3719 - RNA, 20 nt, Artificial Sequence
  Synthetic
gcccgacgucaugcagggca

SEQ ID NO: 3720 - RNA, 20 nt, Artificial Sequence
  Synthetic
gagcuugaugcgcuuagaga

SEQ ID NO: 3721 - RNA, 20 nt, Artificial Sequence
  Synthetic
cagcucgcggggcgcggucg

SEQ ID NO: 3722 - RNA, 20 nt, Artificial Sequence
  Synthetic
cgugguggcgcgccgccucc

SEQ ID NO: 3723 - RNA, 20 nt, Artificial Sequence
  Synthetic
ucacccgagugccuuugaca

SEQ ID NO: 3724 - RNA, 20 nt, Artificial Sequence
  Synthetic
gaacgaccccaaccugaucc

SEQ ID NO: 3725 - RNA, 20 nt, Artificial Sequence
  Synthetic
caaccgcagcacccugucaa

SEQ ID NO: 3726 - RNA, 20 nt, Artificial Sequence
  Synthetic
uccaagugaugucucggugg

SEQ ID NO: 3727 - RNA, 20 nt, Artificial Sequence
  Synthetic
guucuccguguugggcaucg

SEQ ID NO: 3728 - RNA, 20 nt, Artificial Sequence
  Synthetic
cggaaguccccugaccccgc

SEQ ID NO: 3729 - RNA, 20 nt, Artificial Sequence
  Synthetic
uaugcuucucgcccaggacc

SEQ ID NO: 3730 - RNA, 20 nt, Artificial Sequence
  Synthetic
agcuggacggagggaucucg

SEQ ID NO: 3731 - RNA, 20 nt, Artificial Sequence
  Synthetic
ggcugcgccggugcaccacc

SEQ ID NO: 3732 - RNA, 20 nt, Artificial Sequence
  Synthetic
guugguaucccuucaggacu

SEQ ID NO: 3733 - RNA, 20 nt, Artificial Sequence
  Synthetic
auagacgauggcacuguuaa

SEQ ID NO: 3734 - RNA, 20 nt, Artificial Sequence
  Synthetic
cucccgccauggauuucucu

SEQ ID NO: 3735 - RNA, 20 nt, Artificial Sequence
  Synthetic
accaggaucaguaucgagag

SEQ ID NO: 3736 - RNA, 20 nt, Artificial Sequence
  Synthetic
aguccccugaccccgcgggu

SEQ ID NO: 3737 - RNA, 20 nt, Artificial Sequence
  Synthetic
gucuggagucuccgaagcua

SEQ ID NO: 3738 - RNA, 20 nt, Artificial Sequence
  Synthetic
gccggcccagcccuaugcaa

SEQ ID NO: 3739 - RNA, 20 nt, Artificial Sequence
  Synthetic
gauguguggcaguuuucgga

SEQ ID NO: 3740 - RNA, 20 nt, Artificial Sequence
  Synthetic
cuagagaaauccauggcggg

SEQ ID NO: 3741 - RNA, 20 nt, Artificial Sequence
  Synthetic
ggcgcugcccaccaagucgc

SEQ ID NO: 3742 - RNA, 20 nt, Artificial Sequence
  Synthetic
cccgggcgagucggccucgg

SEQ ID NO: 3743 - RNA, 20 nt, Artificial Sequence
  Synthetic
acaccgcccggggagcugga

SEQ ID NO: 3744 - RNA, 20 nt, Artificial Sequence
  Synthetic
caguaaccuuugcauagggc

SEQ ID NO: 3745 - RNA, 20 nt, Artificial Sequence
  Synthetic
ucaguaucgagagaggcuuc

SEQ ID NO: 3746 - RNA, 20 nt, Artificial Sequence
  Synthetic
gcaugacgucgggcagggcg

SEQ ID NO: 3747 - RNA, 20 nt, Artificial Sequence
  Synthetic
ccgcauagagcgccuggggg

SEQ ID NO: 3748 - RNA, 20 nt, Artificial Sequence
  Synthetic
cccccgaggccgacucgccc

SEQ ID NO: 3749 - RNA, 20 nt, Artificial Sequence
  Synthetic
agggcggcuugcuaccuggc

SEQ ID NO: 3750 - RNA, 20 nt, Artificial Sequence
  Synthetic
gcacccugucaaaggcacuc

SEQ ID NO: 3751 - RNA, 20 nt, Artificial Sequence
  Synthetic
cugauccugguauucuuagc

SEQ ID NO: 3752 - RNA, 20 nt, Artificial Sequence
  Synthetic
cauguggcgcuucagcuugc

SEQ ID NO: 3753 - RNA, 20 nt, Artificial Sequence
  Synthetic
cccaccaagucgcuggugcc

SEQ ID NO: 3754 - RNA, 20 nt, Artificial Sequence
  Synthetic
ggaggcaaaaggcgauuguc

SEQ ID NO: 3755 - RNA, 20 nt, Artificial Sequence
  Synthetic
cccaaccugaucccggagaa

SEQ ID NO: 3756 - RNA, 20 nt, Artificial Sequence
  Synthetic
gagucuccgaagcuaaggaa

SEQ ID NO: 3757 - RNA, 20 nt, Artificial Sequence
  Synthetic
ggcuauggagccucccgcca

SEQ ID NO: 3758 - RNA, 20 nt, Artificial Sequence
  Synthetic
cgucugcccucuuuugagcu

SEQ ID NO: 3759 - RNA, 20 nt, Artificial Sequence
  Synthetic
cgcccggggagcuggacgga

SEQ ID NO: 3760 - RNA, 20 nt, Artificial Sequence
  Synthetic
aguaaccuuugcauagggcu

SEQ ID NO: 3761 - RNA, 20 nt, Artificial Sequence
  Synthetic
uccaccaccgagacaucacu

SEQ ID NO: 3762 - RNA, 20 nt, Artificial Sequence
  Synthetic
gguugcaguaaccuuugcau

SEQ ID NO: 3763 - RNA, 20 nt, Artificial Sequence
  Synthetic
gcaauaugaaucccauggag

SEQ ID NO: 3764 - RNA, 20 nt, Artificial Sequence
  Synthetic
accaugcccugcaugacguc

SEQ ID NO: 3765 - RNA, 20 nt, Artificial Sequence
  Synthetic
ggccucgcugaagugcugca

SEQ ID NO: 3766 - RNA, 20 nt, Artificial Sequence
  Synthetic
agagcaaccugguggugcac

SEQ ID NO: 3767 - RNA, 20 nt, Artificial Sequence
  Synthetic
gcccaccaagucgcuggugc

SEQ ID NO: 3768 - RNA, 20 nt, Artificial Sequence
  Synthetic
ugucaaaggcacucggguga

SEQ ID NO: 3769 - RNA, 20 nt, Artificial Sequence
  Synthetic
agcuugaugcgcuuagagaa

SEQ ID NO: 3770 - RNA, 20 nt, Artificial Sequence
  Synthetic
agggggggcgucgccaggaa

SEQ ID NO: 3771 - RNA, 20 nt, Artificial Sequence
  Synthetic
guggaaagcgcccuucugcc

SEQ ID NO: 3772 - RNA, 20 nt, Artificial Sequence
  Synthetic
uggggguccaagugaugucu

SEQ ID NO: 3773 - RNA, 20 nt, Artificial Sequence
  Synthetic
cuccaugcagcacuucagcg

SEQ ID NO: 3774 - RNA, 20 nt, Artificial Sequence
  Synthetic
gcgcuucagcuugcuggccu

SEQ ID NO: 3775 - RNA, 20 nt, Artificial Sequence
  Synthetic
cuucagcgaggccuuccacc

SEQ ID NO: 3776 - RNA, 20 nt, Artificial Sequence
  Synthetic
ggagucuccgaagcuaagga

SEQ ID NO: 3777 - RNA, 20 nt, Artificial Sequence
  Synthetic
cacucgggugauggguggcc

SEQ ID NO: 3778 - RNA, 20 nt, Artificial Sequence
  Synthetic
ugcgcuucuccacaccgccc

SEQ ID NO: 3779 - RNA, 20 nt, Artificial Sequence
  Synthetic
ggugguggacuaaacagggg

SEQ ID NO: 3780 - RNA, 20 nt, Artificial Sequence
  Synthetic
cgaggccuuccaccaggucc

SEQ ID NO: 3781 - RNA, 20 nt, Artificial Sequence
  Synthetic
aauggccgcggcugcucccc

SEQ ID NO: 3782 - RNA, 20 nt, Artificial Sequence
  Synthetic
guuguacauguguagcugcu

SEQ ID NO: 3783 - RNA, 20 nt, Artificial Sequence
  Synthetic
guucuucacacacccccauu

SEQ ID NO: 3784 - RNA, 20 nt, Artificial Sequence
  Synthetic
cgcagcggcacgggaagugg

SEQ ID NO: 3785 - RNA, 20 nt, Artificial Sequence
  Synthetic
gcgggaggcuccauagccau

SEQ ID NO: 3786 - RNA, 20 nt, Artificial Sequence
  Synthetic
ggugcaccggcgcagccaca

SEQ ID NO: 3787 - RNA, 20 nt, Artificial Sequence
  Synthetic
cuccacaccgcccggggagc

SEQ ID NO: 3788 - RNA, 20 nt, Artificial Sequence
  Synthetic
aaagcgcccuucugccaggc

SEQ ID NO: 3789 - RNA, 20 nt, Artificial Sequence
  Synthetic
acucgggugauggguggcca

SEQ ID NO: 3790 - RNA, 20 nt, Artificial Sequence
  Synthetic
cugccuggaggccgcguagc

SEQ ID NO: 3791 - RNA, 20 nt, Artificial Sequence
  Synthetic
guccagcuccccgggcggug

SEQ ID NO: 3792 - RNA, 20 nt, Artificial Sequence
  Synthetic
gagcuggacggagggaucuc

SEQ ID NO: 3793 - RNA, 20 nt, Artificial Sequence
  Synthetic
ucuagcccaccgcugucccc

SEQ ID NO: 3794 - RNA, 20 nt, Artificial Sequence
  Synthetic
aguuguacauguguagcugc

SEQ ID NO: 3795 - RNA, 20 nt, Artificial Sequence
  Synthetic
auucugcaccuaguccugaa

SEQ ID NO: 3796 - RNA, 20 nt, Artificial Sequence
  Synthetic
ccaccacgagaacagcucgc

SEQ ID NO: 3797 - RNA, 20 nt, Artificial Sequence
  Synthetic
cuccuagagaaauccauggc

SEQ ID NO: 3798 - RNA, 20 nt, Artificial Sequence
  Synthetic
uuuaaccugcuaagaauacc

SEQ ID NO: 3799 - RNA, 20 nt, Artificial Sequence
  Synthetic
ggacuaaacagggggggagu

SEQ ID NO: 3800 - RNA, 20 nt, Artificial Sequence
  Synthetic
ggccaccuggccgaggccga

SEQ ID NO: 3801 - RNA, 20 nt, Artificial Sequence
  Synthetic
ggcuugcuaccuggcuggaa

SEQ ID NO: 3802 - RNA, 20 nt, Artificial Sequence
  Synthetic
cauucugcaccuaguccuga

SEQ ID NO: 3803 - RNA, 20 nt, Artificial Sequence
  Synthetic
ugcuggccugggugcacgcg

SEQ ID NO: 3804 - RNA, 20 nt, Artificial Sequence
  Synthetic
uguggcccucggccucggcc

SEQ ID NO: 3805 - RNA, 20 nt, Artificial Sequence
  Synthetic
ccgcccggggagcuggacgg

SEQ ID NO: 3806 - RNA, 20 nt, Artificial Sequence
  Synthetic
uggccgaggccgagggccac

SEQ ID NO: 3807 - RNA, 20 nt, Artificial Sequence
  Synthetic
ugggcaucgcggccgggggc

SEQ ID NO: 3808 - RNA, 20 nt, Artificial Sequence
  Synthetic
ucuccuagagaaauccaugg

SEQ ID NO: 3809 - RNA, 20 nt, Artificial Sequence
  Synthetic
gggccaucucuuccgccccc

SEQ ID NO: 3810 - RNA, 20 nt, Artificial Sequence
  Synthetic
guugcaguaaccuuugcaua

SEQ ID NO: 3811 - RNA, 20 nt, Artificial Sequence
  Synthetic
aaaggcacucgggugauggg

SEQ ID NO: 3812 - RNA, 20 nt, Artificial Sequence
  Synthetic
gaagggaucuuugagcugcc

SEQ ID NO: 3813 - RNA, 20 nt, Artificial Sequence
  Synthetic
gccacacaucuugagcucuc

SEQ ID NO: 3814 - RNA, 20 nt, Artificial Sequence
  Synthetic
ggagggaucucggggcgcag

SEQ ID NO: 3815 - RNA, 20 nt, Artificial Sequence
  Synthetic
cccggagaacggggacgagg

SEQ ID NO: 3816 - RNA, 20 nt, Artificial Sequence
  Synthetic
ugcauagggcugggccggcc

SEQ ID NO: 3817 - RNA, 20 nt, Artificial Sequence
  Synthetic
cggggcgcggucgugggcgu

SEQ ID NO: 3818 - RNA, 20 nt, Artificial Sequence
  Synthetic
gagggggggcgucgccagga

SEQ ID NO: 3819 - RNA, 20 nt, Artificial Sequence
  Synthetic
accgccagcuccccggaacc

SEQ ID NO: 3820 - RNA, 20 nt, Artificial Sequence
  Synthetic
gguauucuuagcagguuaaa

SEQ ID NO: 3821 - RNA, 20 nt, Artificial Sequence
  Synthetic
aggcuuccggccuggcagaa

SEQ ID NO: 3822 - RNA, 20 nt, Artificial Sequence
  Synthetic
gaucccuccguccagcuccc

SEQ ID NO: 3823 - RNA, 20 nt, Artificial Sequence
  Synthetic
ugguauucuuagcagguuaa

SEQ ID NO: 3824 - RNA, 20 nt, Artificial Sequence
  Synthetic
aucuacuuagaaagcgaaca

SEQ ID NO: 3825 - RNA, 20 nt, Artificial Sequence
  Synthetic
cggccaccuggccgaggccg

SEQ ID NO: 3826 - RNA, 20 nt, Artificial Sequence
  Synthetic
caacacgcacagaacacuca

SEQ ID NO: 3827 - RNA, 20 nt, Artificial Sequence
  Synthetic
gccggccuggggacagcggu

SEQ ID NO: 3828 - RNA, 20 nt, Artificial Sequence
  Synthetic
gccaccacgagaacagcucg

SEQ ID NO: 3829 - RNA, 20 nt, Artificial Sequence
  Synthetic
guauucuuagcagguuaaag

SEQ ID NO: 3830 - RNA, 20 nt, Artificial Sequence
  Synthetic
cucuaggagacuuagagagc

SEQ ID NO: 3831 - RNA, 20 nt, Artificial Sequence
  Synthetic
aacagccauucaccagugca

SEQ ID NO: 3832 - RNA, 20 nt, Artificial Sequence
  Synthetic
uugcaagagaaaccaugcac

SEQ ID NO: 3833 - RNA, 20 nt, Artificial Sequence
  Synthetic
gacuugaccgggggcuggga

SEQ ID NO: 3834 - RNA, 20 nt, Artificial Sequence
  Synthetic
accuuugcauagggcugggc

SEQ ID NO: 3835 - RNA, 20 nt, Artificial Sequence
  Synthetic
ucuuuugagcugggccugcc

SEQ ID NO: 3836 - RNA, 20 nt, Artificial Sequence
  Synthetic
gaggccuuccaccagguccu

SEQ ID NO: 3837 - RNA, 20 nt, Artificial Sequence
  Synthetic
cuuuugagcugggccugccc

SEQ ID NO: 3838 - RNA, 20 nt, Artificial Sequence
  Synthetic
gggaucuuugagcugccugg

SEQ ID NO: 3839 - RNA, 20 nt, Artificial Sequence
  Synthetic
gggcaggcccagcucaaaag

SEQ ID NO: 3840 - RNA, 20 nt, Artificial Sequence
  Synthetic
agcacccugucaaaggcacu

SEQ ID NO: 3841 - RNA, 20 nt, Artificial Sequence
  Synthetic
uggacuaaacagggggggag

SEQ ID NO: 3842 - RNA, 20 nt, Artificial Sequence
  Synthetic
gcucuugaacuuggccacca

SEQ ID NO: 3843 - RNA, 20 nt, Artificial Sequence
  Synthetic
gaaucccauggagagguggc

SEQ ID NO: 3844 - RNA, 20 nt, Artificial Sequence
  Synthetic
gugcaccggcgcagccacac

SEQ ID NO: 3845 - RNA, 20 nt, Artificial Sequence
  Synthetic
aaagaucccuuccuuagcuu

SEQ ID NO: 3846 - RNA, 20 nt, Artificial Sequence
  Synthetic
ugucugcaauaugaauccca

SEQ ID NO: 3847 - RNA, 20 nt, Artificial Sequence
  Synthetic
ggcaggcccagcucaaaaga

SEQ ID NO: 3848 - RNA, 20 nt, Artificial Sequence
  Synthetic
ccuccguccagcuccccggg

SEQ ID NO: 3849 - RNA, 20 nt, Artificial Sequence
  Synthetic
cuguccaaaaagcugcugcu

SEQ ID NO: 3850 - RNA, 20 nt, Artificial Sequence
  Synthetic
gcuugaugcgcuuagagaag

SEQ ID NO: 3851 - RNA, 20 nt, Artificial Sequence
  Synthetic
cggcuucgggcugagccugg

SEQ ID NO: 3852 - RNA, 20 nt, Artificial Sequence
  Synthetic
caccaugcccugcaugacgu

SEQ ID NO: 3853 - RNA, 20 nt, Artificial Sequence
  Synthetic
ucaagauguguggcaguuuu

SEQ ID NO: 3854 - RNA, 20 nt, Artificial Sequence
  Synthetic
guucaaauuucagagcaacc

SEQ ID NO: 3855 - RNA, 20 nt, Artificial Sequence
  Synthetic
gagaaggggcucagcgagcu

SEQ ID NO: 3856 - RNA, 20 nt, Artificial Sequence
  Synthetic
gcagcggcacgggaagugga

SEQ ID NO: 3857 - RNA, 20 nt, Artificial Sequence
  Synthetic
aagucuccuagagaaaucca

SEQ ID NO: 3858 - RNA, 20 nt, Artificial Sequence
  Synthetic
ggugccggguuccggggagc

SEQ ID NO: 3859 - RNA, 20 nt, Artificial Sequence
  Synthetic
ccuguccaaaaagcugcugc

SEQ ID NO: 3860 - RNA, 20 nt, Artificial Sequence
  Synthetic
auaugaaucccauggagagg

SEQ ID NO: 3861 - RNA, 20 nt, Artificial Sequence
  Synthetic
gggcgcagcggcacgggaag

SEQ ID NO: 3862 - RNA, 20 nt, Artificial Sequence
  Synthetic
ggccgaggccgagggccaca

SEQ ID NO: 3863 - RNA, 20 nt, Artificial Sequence
  Synthetic
gcaagugucccuguggcccu

SEQ ID NO: 3864 - RNA, 20 nt, Artificial Sequence
  Synthetic
ggacuugaccgggggcuggg

SEQ ID NO: 3865 - RNA, 20 nt, Artificial Sequence
  Synthetic
gcuucucgcccaggaccugg

SEQ ID NO: 3866 - RNA, 20 nt, Artificial Sequence
  Synthetic
gcgccugggggcggaagaga

SEQ ID NO: 3867 - RNA, 20 nt, Artificial Sequence
  Synthetic
gucccuguggcccucggccu

SEQ ID NO: 3868 - RNA, 20 nt, Artificial Sequence
  Synthetic
aucccuccguccagcucccc

SEQ ID NO: 3869 - RNA, 20 nt, Artificial Sequence
  Synthetic
gugccuuugacagggugcug

SEQ ID NO: 3870 - RNA, 20 nt, Artificial Sequence
  Synthetic
cccagagagcucaagaugug

SEQ ID NO: 3871 - RNA, 20 nt, Artificial Sequence
  Synthetic
ggcccucggccucggccagg

SEQ ID NO: 3872 - RNA, 20 nt, Artificial Sequence
  Synthetic
gagagcgagaggguggacua

SEQ ID NO: 3873 - RNA, 20 nt, Artificial Sequence
  Synthetic
gggggcgucgccaggaaggg

SEQ ID NO: 3874 - RNA, 20 nt, Artificial Sequence
  Synthetic
agagaaggggcucagcgagc

SEQ ID NO: 3875 - RNA, 20 nt, Artificial Sequence
  Synthetic
ccacacaucuugagcucucu

SEQ ID NO: 3876 - RNA, 20 nt, Artificial Sequence
  Synthetic
gcugcccagcagcagcuuuu

SEQ ID NO: 3877 - RNA, 20 nt, Artificial Sequence
  Synthetic
ggagcuggacggagggaucu

SEQ ID NO: 3878 - RNA, 20 nt, Artificial Sequence
  Synthetic
gggggcggaagagauggccc

SEQ ID NO: 3879 - RNA, 20 nt, Artificial Sequence
  Synthetic
aggagacuuagagagcuggc

SEQ ID NO: 3880 - RNA, 20 nt, Artificial Sequence
  Synthetic
gaggcuuccggccuggcaga

SEQ ID NO: 3881 - RNA, 20 nt, Artificial Sequence
  Synthetic
aaucccauggagagguggcu

SEQ ID NO: 3882 - RNA, 20 nt, Artificial Sequence
  Synthetic
ugugcaugugcgucuucaug

SEQ ID NO: 3883 - RNA, 20 nt, Artificial Sequence
  Synthetic
cucgcccaggaccuggugga

SEQ ID NO: 3884 - RNA, 20 nt, Artificial Sequence
  Synthetic
uccuccucguccccguucuc

SEQ ID NO: 3885 - RNA, 20 nt, Artificial Sequence
  Synthetic
agaaaccaugcacuggugaa

SEQ ID NO: 3886 - RNA, 20 nt, Artificial Sequence
  Synthetic
cuucgggcugagccuggagg

SEQ ID NO: 3887 - RNA, 20 nt, Artificial Sequence
  Synthetic
gccggguuccggggagcugg

SEQ ID NO: 3888 - RNA, 20 nt, Artificial Sequence
  Synthetic
agaaggggcucagcgagcug

SEQ ID NO: 3889 - RNA, 20 nt, Artificial Sequence
  Synthetic
cuaaacagggggggaguggg

SEQ ID NO: 3890 - RNA, 20 nt, Artificial Sequence
  Synthetic
caaauuucagagcaaccugg

SEQ ID NO: 3891 - RNA, 20 nt, Artificial Sequence
  Synthetic
gagggagggggggcgucgcc

SEQ ID NO: 3892 - RNA, 20 nt, Artificial Sequence
  Synthetic
ccuccucguccccguucucc

SEQ ID NO: 3893 - RNA, 20 nt, Artificial Sequence
  Synthetic
ccagcagcagcuuuuuggac

SEQ ID NO: 3894 - RNA, 20 nt, Artificial Sequence
  Synthetic
gcccaccgcuguccccaggc

SEQ ID NO: 3895 - RNA, 20 nt, Artificial Sequence
  Synthetic
ggagacuuagagagcuggca

SEQ ID NO: 3896 - RNA, 20 nt, Artificial Sequence
  Synthetic
aggagcugacggagagcgag

SEQ ID NO: 3897 - RNA, 20 nt, Artificial Sequence
  Synthetic
gaggggcggauugcagagga

SEQ ID NO: 3898 - RNA, 20 nt, Artificial Sequence
  Synthetic
cauagggcugggccggccug

SEQ ID NO: 3899 - RNA, 20 nt, Artificial Sequence
  Synthetic
ggcggauugcagaggaggga

SEQ ID NO: 3900 - RNA, 20 nt, Artificial Sequence
  Synthetic
ggaggggcggauugcagagg

SEQ ID NO: 3901 - RNA, 20 nt, Artificial Sequence
  Synthetic
uuacugcaaccauuccagcc

SEQ ID NO: 3902 - RNA, 20 nt, Artificial Sequence
  Synthetic
gcauagggcugggccggccu

SEQ ID NO: 3903 - RNA, 20 nt, Artificial Sequence
  Synthetic
gggcggauugcagaggaggg

SEQ ID NO: 3904 - RNA, 20 nt, Artificial Sequence
  Synthetic
ggguuccggggagcuggcgg

SEQ ID NO: 3905 - RNA, 20 nt, Artificial Sequence
  Synthetic
ucucgcccguguggcugcgc

SEQ ID NO: 3906 - RNA, 20 nt, Artificial Sequence
  Synthetic
cuucccagccaccucuccau

SEQ ID NO: 3907 - RNA, 20 nt, Artificial Sequence
  Synthetic
gcugacggagagcgagaggg

SEQ ID NO: 3908 - RNA, 20 nt, Artificial Sequence
  Synthetic
gcggauugcagaggagggag

SEQ ID NO: 3909 - RNA, 20 nt, Artificial Sequence
  Synthetic
ggagcugacggagagcgaga

SEQ ID NO: 3910 - RNA, 20 nt, Artificial Sequence
  Synthetic
ucucuccaccgccagcuccc

SEQ ID NO: 3911 - RNA, 20 nt, Artificial Sequence
  Synthetic
uugaccgggggcugggaggg

SEQ ID NO: 3912 - RNA, 20 nt, Artificial Sequence
  Synthetic
cggauugcagaggagggagg

SEQ ID NO: 3913 - RNA, 20 nt, Artificial Sequence
  Synthetic
gcggggcgcggucgugggcg

SEQ ID NO: 3914 - RNA, 20 nt, Artificial Sequence
  Synthetic
gagcugggccugcccgggcc

SEQ ID NO: 3915 - RNA, 20 nt, Artificial Sequence
  Synthetic
cugggccggccuggggacag

SEQ ID NO: 3916 - RNA, 20 nt, Artificial Sequence
  Synthetic
uguagggcuucucgcccgug

SEQ ID NO: 3917 - RNA, 20 nt, Artificial Sequence
  Synthetic
ccauggagagguggcuggga

SEQ ID NO: 3918 - RNA, 20 nt, Artificial Sequence
  Synthetic
ggaggaggggcggauugcag

SEQ ID NO: 3919 - RNA, 20 nt, Artificial Sequence
  Synthetic
ccuucccagccaccucucca

SEQ ID NO: 3920 - RNA, 20 nt, Artificial Sequence
  Synthetic
cccgcgagcuguucucgugg

SEQ ID NO: 3921 - RNA, 20 nt, Artificial Sequence
  Synthetic
gauugcagaggagggagggg

SEQ ID NO: 3922 - RNA, 20 nt, Artificial Sequence
  Synthetic
ggccggccuggggacagcgg

SEQ ID NO: 3923 - RNA, 20 nt, Artificial Sequence
  Synthetic
ggauugcagaggagggaggg

SEQ ID NO: 3924 - RNA, 20 nt, Artificial Sequence
  Synthetic
accgggggcugggagggagg

SEQ ID NO: 3925 - RNA, 20 nt, Artificial Sequence
  Synthetic
ccgggggcugggagggagga

SEQ ID NO: 3926 - RNA, 20 nt, Artificial Sequence
  Synthetic
gaacggggacgaggaggaag

SEQ ID NO: 3927 - RNA, 20 nt, Artificial Sequence
  Synthetic
cccuccucccucccagcccc

SEQ ID NO: 3928 - RNA, 20 nt, Artificial Sequence
  Synthetic
cgggggcugggagggaggag

SEQ ID NO: 3929 - RNA, 20 nt, Artificial Sequence
  Synthetic
ggcgcuucagcuugcuggcc

SEQ ID NO: 3930 - RNA, 20 nt, Artificial Sequence
  Synthetic
cggggacgaggaggaagagg

SEQ ID NO: 3931 - RNA, 20 nt, Artificial Sequence
  Synthetic
agaggaggaggaggagcuga

SEQ ID NO: 3932 - RNA, 20 nt, Artificial Sequence
  Synthetic
gggcugggagggaggagggg

SEQ ID NO: 3933 - RNA, 20 nt, Artificial Sequence
  Synthetic
agaggaggacgacgaggaag

SEQ ID NO: 3934 - RNA, 20 nt, Artificial Sequence
  Synthetic
cgacgaggaagaggaagaag

SEQ ID NO: 3935 - RNA, 20 nt, Artificial Sequence
  Synthetic
ggaggaagaggaggacgacg

SEQ ID NO: 3936 - RNA, 20 nt, Artificial Sequence
  Synthetic
cgaggaagaggaagaagagg

SEQ ID NO: 3937 - RNA, 20 nt, Artificial Sequence
  Synthetic
ggaagaagaggaggaagagg

SEQ ID NO: 3938 - RNA, 20 nt, Artificial Sequence
  Synthetic
agaggaagaagaggaggaag

SEQ ID NO: 3939 - RNA, 20 nt, Artificial Sequence
  Synthetic
agaagaggaggaagaggagg

SEQ ID NO: 3940 - RNA, 20 nt, Artificial Sequence
  Synthetic
agaggaggaagaggaggagg

SEQ ID NO: 3941 - RNA, 20 nt, Artificial Sequence
  Synthetic
gaaccagaccacggcccguu

SEQ ID NO: 3942 - RNA, 20 nt, Artificial Sequence
  Synthetic
gaccuggaugccaaccucca

SEQ ID NO: 3943 - RNA, 17 nt, Artificial Sequence
  Synthetic
gauuagagcuccaugug

SEQ ID NO: 3944 - RNA, 20 nt, Artificial Sequence
  Synthetic
gauuguuuaucaacgucauc

SEQ ID NO: 3945 - RNA, 17 nt, Artificial Sequence
  Synthetic
gcacucaucccaggcgu

SEQ ID NO: 3946 - RNA, 20 nt, Artificial Sequence
  Synthetic
ggggauuagagcuccaugug

SEQ ID NO: 3947 - RNA, 17 nt, Artificial Sequence
  Synthetic
gugcagaauaugccccg

SEQ ID NO: 3948 - RNA, 17 nt, Artificial Sequence
  Synthetic
aaccagaccacggcccg

SEQ ID NO: 3949 - RNA, 20 nt, Artificial Sequence
  Synthetic
aauucccguuugcuuaagug

SEQ ID NO: 3950 - RNA, 17 nt, Artificial Sequence
  Synthetic
accagaccacggcccgu

SEQ ID NO: 3951 - RNA, 20 nt, Artificial Sequence
  Synthetic
augaaccagaccacggcccg

SEQ ID NO: 3952 - RNA, 20 nt, Artificial Sequence
  Synthetic
auucccguuugcuuaagugc

SEQ ID NO: 3953 - RNA, 17 nt, Artificial Sequence
  Synthetic
ccagaccacggcccguu

SEQ ID NO: 3954 - RNA, 17 nt, Artificial Sequence
  Synthetic
cccguuugcuuaagugc

SEQ ID NO: 3955 - RNA, 17 nt, Artificial Sequence
  Synthetic
ccuggaugccaaccucc

SEQ ID NO: 3956 - RNA, 17 nt, Artificial Sequence
  Synthetic
cuggaugccaaccucca

SEQ ID NO: 3957 - RNA, 17 nt, Artificial Sequence
  Synthetic
ucauccucuggcgugac

SEQ ID NO: 3958 - RNA, 17 nt, Artificial Sequence
  Synthetic
ucccguuugcuuaagug

SEQ ID NO: 3959 - RNA, 20 nt, Artificial Sequence
  Synthetic
ucgucauccucuggcgugac

SEQ ID NO: 3960 - RNA, 20 nt, Artificial Sequence
  Synthetic
ucugcacucaucccaggcgu

SEQ ID NO: 3961 - RNA, 17 nt, Artificial Sequence
  Synthetic
ucugguucaucaucugu

SEQ ID NO: 3962 - RNA, 20 nt, Artificial Sequence
  Synthetic
ugaaccagaccacggcccgu

SEQ ID NO: 3963 - RNA, 20 nt, Artificial Sequence
  Synthetic
ugaccuggaugccaaccucc

SEQ ID NO: 3964 - RNA, 20 nt, Artificial Sequence
  Synthetic
ugagugcagaauaugccccg

SEQ ID NO: 3965 - RNA, 17 nt, Artificial Sequence
  Synthetic
ugcacucaucccaggcg

SEQ ID NO: 3966 - RNA, 20 nt, Artificial Sequence
  Synthetic
uggucugguucaucaucugu

SEQ ID NO: 3967 - RNA, 17 nt, Artificial Sequence
  Synthetic
uguuuaucaacgucauc

SEQ ID NO: 3968 - RNA, 20 nt, Artificial Sequence
  Synthetic
uguuuaucaacgucaucuag

SEQ ID NO: 3969 - RNA, 17 nt, Artificial Sequence
  Synthetic
uuaucaacgucaucuag

SEQ ID NO: 3970 - RNA, 20 nt, Artificial Sequence
  Synthetic
uucugcacucaucccaggcg

SEQ ID NO: 3971 - RNA, 20 nt, Artificial Sequence
  Synthetic
uuguuuaucaacgucaucua

SEQ ID NO: 3972 - RNA, 17 nt, Artificial Sequence
  Synthetic
uuuaucaacgucaucua

SEQ ID NO: 3973 - RNA, 20 nt, Artificial Sequence
  Synthetic
gaaaaaagcauccaaucccg

SEQ ID NO: 3974 - RNA, 17 nt, Artificial Sequence
  Synthetic
gagaggccccuccagug

SEQ ID NO: 3975 - RNA, 20 nt, Artificial Sequence
  Synthetic
gagcuccaugugcagaacga

SEQ ID NO: 3976 - RNA, 17 nt, Artificial Sequence
  Synthetic
gaggaauuugccccaaa

SEQ ID NO: 3977 - RNA, 20 nt, Artificial Sequence
  Synthetic
gaggagaggccccuccagug

SEQ ID NO: 3978 - RNA, 20 nt, Artificial Sequence
  Synthetic
gaggaggucaugauccccuu

SEQ ID NO: 3979 - RNA, 17 nt, Artificial Sequence
  Synthetic
gaggucaugauccccuu

SEQ ID NO: 3980 - RNA, 17 nt, Artificial Sequence
  Synthetic
gcauccaggucacgcca

SEQ ID NO: 3981 - RNA, 20 nt, Artificial Sequence
  Synthetic
gccaccuuccccuucaccaa

SEQ ID NO: 3982 - RNA, 17 nt, Artificial Sequence
  Synthetic
gccagaugaacuuccca

SEQ ID NO: 3983 - RNA, 20 nt, Artificial Sequence
  Synthetic
gccagaugaacuucccauug

SEQ ID NO: 3984 - RNA, 20 nt, Artificial Sequence
  Synthetic
gcccguugggagcuccagaa

SEQ ID NO: 3985 - RNA, 20 nt, Artificial Sequence
  Synthetic
gccucugcuuagaaaaagcu

SEQ ID NO: 3986 - RNA, 17 nt, Artificial Sequence
  Synthetic
gcuccaugugcagaacg

SEQ ID NO: 3987 - RNA, 17 nt, Artificial Sequence
  Synthetic
gcucuaauccccacgcc

SEQ ID NO: 3988 - RNA, 17 nt, Artificial Sequence
  Synthetic
ggacauucuuauuuuua

SEQ ID NO: 3989 - RNA, 20 nt, Artificial Sequence
  Synthetic
ggagcucuaauccccacgcc

SEQ ID NO: 3990 - RNA, 20 nt, Artificial Sequence
  Synthetic
ggaucaugaccuccucaccu

SEQ ID NO: 3991 - RNA, 20 nt, Artificial Sequence
  Synthetic
ggaugccaaccuccacggga

SEQ ID NO: 3992 - RNA, 17 nt, Artificial Sequence
  Synthetic
ggcacugcccacaggug

SEQ ID NO: 3993 - RNA, 20 nt, Artificial Sequence
  Synthetic
ggcccguugggagcuccaga

SEQ ID NO: 3994 - RNA, 20 nt, Artificial Sequence
  Synthetic
gggggacauucuuauuuuua

SEQ ID NO: 3995 - RNA, 20 nt, Artificial Sequence
  Synthetic
gguuggcauccaggucacgc

SEQ ID NO: 3996 - RNA, 17 nt, Artificial Sequence
  Synthetic
gguuugccuugcuugcg

SEQ ID NO: 3997 - RNA, 17 nt, Artificial Sequence
  Synthetic
gugcagaacgaggggag

SEQ ID NO: 3998 - RNA, 20 nt, Artificial Sequence
  Synthetic
gugccagaugaacuucccau

SEQ ID NO: 3999 - RNA, 17 nt, Artificial Sequence
  Synthetic
aaaaagcauccaauccc

SEQ ID NO: 4000 - RNA, 20 nt, Artificial Sequence
  Synthetic
aaaaauaagaauguccccca

SEQ ID NO: 4001 - RNA, 17 nt, Artificial Sequence
  Synthetic
aaaagcauccaaucccg

SEQ ID NO: 4002 - RNA, 20 nt, Artificial Sequence
  Synthetic
aaaauaagaaugucccccaa

SEQ ID NO: 4003 - RNA, 20 nt, Artificial Sequence
  Synthetic
aaaccccagcacuuaagcaa

SEQ ID NO: 4004 - RNA, 20 nt, Artificial Sequence
  Synthetic
aaauaagaaugucccccaau

SEQ ID NO: 4005 - RNA, 20 nt, Artificial Sequence
  Synthetic
aaccccagcacuuaagcaaa

SEQ ID NO: 4006 - RNA, 17 nt, Artificial Sequence
  Synthetic
aauaagaauguccccca

SEQ ID NO: 4007 - RNA, 20 nt, Artificial Sequence
  Synthetic
accccagcacuuaagcaaac

SEQ ID NO: 4008 - RNA, 17 nt, Artificial Sequence
  Synthetic
accuuccccuucaccaa

SEQ ID NO: 4009 - RNA, 17 nt, Artificial Sequence
  Synthetic
agagcuccaugugcaga

SEQ ID NO: 4010 - RNA, 20 nt, Artificial Sequence
  Synthetic
agagcuccaugugcagaacg

SEQ ID NO: 4011 - RNA, 17 nt, Artificial Sequence
  Synthetic
agaugaacuucccauug

SEQ ID NO: 4012 - RNA, 17 nt, Artificial Sequence
  Synthetic
agccauucuuacagaug

SEQ ID NO: 4013 - RNA, 17 nt, Artificial Sequence
  Synthetic
agcuccaugugcagaac

SEQ ID NO: 4014 - RNA, 20 nt, Artificial Sequence
  Synthetic
agcuccaugugcagaacgag

SEQ ID NO: 4015 - RNA, 17 nt, Artificial Sequence
  Synthetic
agcucuaauccccacgc

SEQ ID NO: 4016 - RNA, 17 nt, Artificial Sequence
  Synthetic
aggaauuugccccaaac

SEQ ID NO: 4017 - RNA, 20 nt, Artificial Sequence
  Synthetic
aggaggucaugauccccuuc

SEQ ID NO: 4018 - RNA, 17 nt, Artificial Sequence
  Synthetic
aggucaugauccccuuc

SEQ ID NO: 4019 - RNA, 20 nt, Artificial Sequence
  Synthetic
agugccagaugaacuuccca

SEQ ID NO: 4020 - RNA, 17 nt, Artificial Sequence
  Synthetic
auaagaaugucccccaa

SEQ ID NO: 4021 - RNA, 17 nt, Artificial Sequence
  Synthetic
aucccaggcguggggau

SEQ ID NO: 4022 - RNA, 20 nt, Artificial Sequence
  Synthetic
auccccuucuggagcuccca

SEQ ID NO: 4023 - RNA, 20 nt, Artificial Sequence
  Synthetic
aucuggcacugcccacaggu

SEQ ID NO: 4024 - RNA, 20 nt, Artificial Sequence
  Synthetic
augcaauggcagccucugcu

SEQ ID NO: 4025 - RNA, 17 nt, Artificial Sequence
  Synthetic
augugcagaacgagggg

SEQ ID NO: 4026 - RNA, 20 nt, Artificial Sequence
  Synthetic
auuagagcuccaugugcaga

SEQ ID NO: 4027 - RNA, 20 nt, Artificial Sequence
  Synthetic
auucugcacucaucccaggc

SEQ ID NO: 4028 - RNA, 17 nt, Artificial Sequence
  Synthetic
auuuuuaucgagcacaa

SEQ ID NO: 4029 - RNA, 17 nt, Artificial Sequence
  Synthetic
caauggcagccucugcu

SEQ ID NO: 4030 - RNA, 17 nt, Artificial Sequence
  Synthetic
cacgccugggaugagug

SEQ ID NO: 4031 - RNA, 17 nt, Artificial Sequence
  Synthetic
cagaugaacuucccauu

SEQ ID NO: 4032 - RNA, 17 nt, Artificial Sequence
  Synthetic
caucucgauuggugaag

SEQ ID NO: 4033 - RNA, 17 nt, Artificial Sequence
  Synthetic
caugugcagaacgaggg

SEQ ID NO: 4034 - RNA, 20 nt, Artificial Sequence
  Synthetic
caugugcagaacgaggggag

SEQ ID NO: 4035 - RNA, 17 nt, Artificial Sequence
  Synthetic
ccacagcuuuuucuaag

SEQ ID NO: 4036 - RNA, 20 nt, Artificial Sequence
  Synthetic
ccacggcccguugggagcuc

SEQ ID NO: 4037 - RNA, 17 nt, Artificial Sequence
  Synthetic
ccagaugaacuucccau

SEQ ID NO: 4038 - RNA, 17 nt, Artificial Sequence
  Synthetic
ccagcacuuaagcaaac

SEQ ID NO: 4039 - RNA, 17 nt, Artificial Sequence
  Synthetic
cccagcacuuaagcaaa

SEQ ID NO: 4040 - RNA, 20 nt, Artificial Sequence
  Synthetic
ccccacgccugggaugagug

SEQ ID NO: 4041 - RNA, 17 nt, Artificial Sequence
  Synthetic
ccccagcacuuaagcaa

SEQ ID NO: 4042 - RNA, 17 nt, Artificial Sequence
  Synthetic
ccccuucaccaaucgag

SEQ ID NO: 4043 - RNA, 17 nt, Artificial Sequence
  Synthetic
cccguugggagcuccag

SEQ ID NO: 4044 - RNA, 17 nt, Artificial Sequence
  Synthetic
cccuucuggagcuccca

SEQ ID NO: 4045 - RNA, 17 nt, Artificial Sequence
  Synthetic
ccguugggagcuccaga

SEQ ID NO: 4046 - RNA, 17 nt, Artificial Sequence
  Synthetic
ccugugggcagugccag

SEQ ID NO: 4047 - RNA, 17 nt, Artificial Sequence
  Synthetic
cggcccguugggagcuc

SEQ ID NO: 4048 - RNA, 20 nt, Artificial Sequence
  Synthetic
cggcccguugggagcuccag

SEQ ID NO: 4049 - RNA, 17 nt, Artificial Sequence
  Synthetic
cguugggagcuccagaa

SEQ ID NO: 4050 - RNA, 20 nt, Artificial Sequence
  Synthetic
cguuugugcucgauaaaaau

SEQ ID NO: 4051 - RNA, 20 nt, Artificial Sequence
  Synthetic
cuagaggaauuugccccaaa

SEQ ID NO: 4052 - RNA, 20 nt, Artificial Sequence
  Synthetic
cucaucccaggcguggggau

SEQ ID NO: 4053 - RNA, 17 nt, Artificial Sequence
  Synthetic
cuccaugugcagaacga

SEQ ID NO: 4054 - RNA, 20 nt, Artificial Sequence
  Synthetic
cuccaugugcagaacgaggg

SEQ ID NO: 4055 - RNA, 17 nt, Artificial Sequence
  Synthetic
cuccccucguucugcac

SEQ ID NO: 4056 - RNA, 20 nt, Artificial Sequence
  Synthetic
cuccuccccucguucugcac

SEQ ID NO: 4057 - RNA, 20 nt, Artificial Sequence
  Synthetic
cucuaauccccacgccuggg

SEQ ID NO: 4058 - RNA, 17 nt, Artificial Sequence
  Synthetic
cugcacucaucccaggc

SEQ ID NO: 4059 - RNA, 20 nt, Artificial Sequence
  Synthetic
cuuauuuuuaucgagcacaa

SEQ ID NO: 4060 - RNA, 20 nt, Artificial Sequence
  Synthetic
cuuccccuucaccaaucgag

SEQ ID NO: 4061 - RNA, 17 nt, Artificial Sequence
  Synthetic
uaagaaugucccccaau

SEQ ID NO: 4062 - RNA, 17 nt, Artificial Sequence
  Synthetic
uaauccccacgccuggg

SEQ ID NO: 4063 - RNA, 20 nt, Artificial Sequence
  Synthetic
uagagcuccaugugcagaac

SEQ ID NO: 4064 - RNA, 20 nt, Artificial Sequence
  Synthetic
uagaggaauuugccccaaac

SEQ ID NO: 4065 - RNA, 20 nt, Artificial Sequence
  Synthetic
uauccacagcuuuuucuaag

SEQ ID NO: 4066 - RNA, 20 nt, Artificial Sequence
  Synthetic
ucaccugugggcagugccag

SEQ ID NO: 4067 - RNA, 17 nt, Artificial Sequence
  Synthetic
ucaucucgauuggugaa

SEQ ID NO: 4068 - RNA, 20 nt, Artificial Sequence
  Synthetic
ucaucuggcacugcccacag

SEQ ID NO: 4069 - RNA, 20 nt, Artificial Sequence
  Synthetic
ucaucuguaagaauggcuuc

SEQ ID NO: 4070 - RNA, 17 nt, Artificial Sequence
  Synthetic
ucaugaccuccucaccu

SEQ ID NO: 4071 - RNA, 17 nt, Artificial Sequence
  Synthetic
uccaugugcagaacgag

SEQ ID NO: 4072 - RNA, 20 nt, Artificial Sequence
  Synthetic
uccaugugcagaacgagggg

SEQ ID NO: 4073 - RNA, 17 nt, Artificial Sequence
  Synthetic
uccccucguucugcaca

SEQ ID NO: 4074 - RNA, 20 nt, Artificial Sequence
  Synthetic
uccuccccucguucugcaca

SEQ ID NO: 4075 - RNA, 17 nt, Artificial Sequence
  Synthetic
ucugcuuagaaaaagcu

SEQ ID NO: 4076 - RNA, 17 nt, Artificial Sequence
  Synthetic
ucuggcacugcccacag

SEQ ID NO: 4077 - RNA, 20 nt, Artificial Sequence
  Synthetic
ucuggcacugcccacaggug

SEQ ID NO: 4078 - RNA, 17 nt, Artificial Sequence
  Synthetic
ucuguaagaauggcuuc

SEQ ID NO: 4079 - RNA, 20 nt, Artificial Sequence
  Synthetic
ugaaaaaagcauccaauccc

SEQ ID NO: 4080 - RNA, 20 nt, Artificial Sequence
  Synthetic
ugaagccauucuuacagaug

SEQ ID NO: 4081 - RNA, 17 nt, Artificial Sequence
  Synthetic
ugccaaccuccacggga

SEQ ID NO: 4082 - RNA, 20 nt, Artificial Sequence
  Synthetic
ugccagaugaacuucccauu

SEQ ID NO: 4083 - RNA, 20 nt, Artificial Sequence
  Synthetic
ugcuuuuuucaucucgauug

SEQ ID NO: 4084 - RNA, 20 nt, Artificial Sequence
  Synthetic
uggagcucuaauccccacgc

SEQ ID NO: 4085 - RNA, 17 nt, Artificial Sequence
  Synthetic
uggcacugcccacaggu

SEQ ID NO: 4086 - RNA, 17 nt, Artificial Sequence
  Synthetic
uggcauccaggucacgc

SEQ ID NO: 4087 - RNA, 20 nt, Artificial Sequence
  Synthetic
ugggguuugccuugcuugcg

SEQ ID NO: 4088 - RNA, 20 nt, Artificial Sequence
  Synthetic
uuauuuuuaucgagcacaaa

SEQ ID NO: 4089 - RNA, 17 nt, Artificial Sequence
  Synthetic
uucaucucgauugguga

SEQ ID NO: 4090 - RNA, 20 nt, Artificial Sequence
  Synthetic
uuggcauccaggucacgcca

SEQ ID NO: 4091 - RNA, 17 nt, Artificial Sequence
  Synthetic
uugugcucgauaaaaau

SEQ ID NO: 4092 - RNA, 17 nt, Artificial Sequence
  Synthetic
uuucaucucgauuggug

SEQ ID NO: 4093 - RNA, 20 nt, Artificial Sequence
  Synthetic
uuucaucucgauuggugaag

SEQ ID NO: 4094 - RNA, 20 nt, Artificial Sequence
  Synthetic
uuuucaucucgauuggugaa

SEQ ID NO: 4095 - RNA, 17 nt, Artificial Sequence
  Synthetic
uuuuuaucgagcacaaa

SEQ ID NO: 4096 - RNA, 20 nt, Artificial Sequence
  Synthetic
uuuuucaucucgauugguga

SEQ ID NO: 4097 - RNA, 17 nt, Artificial Sequence
  Synthetic
uuuuuucaucucgauug

SEQ ID NO: 4098 - RNA, 20 nt, Artificial Sequence
  Synthetic
uuuuuucaucucgauuggug

SEQ ID NO: 4099 - RNA, 20 nt, Artificial Sequence
  Synthetic
ucgucggacuugaccgucau

SEQ ID NO: 4100 - RNA, 20 nt, Artificial Sequence
  Synthetic
gucgucggacuugaccguca

SEQ ID NO: 4101 - RNA, 20 nt, Artificial Sequence
  Synthetic
cgucgucggacuugaccguc

SEQ ID NO: 4102 - RNA, 20 nt, Artificial Sequence
  Synthetic
cgucggacuugaccgucaug

SEQ ID NO: 4103 - RNA, 20 nt, Artificial Sequence
  Synthetic
cccauauuagugguccgggc

SEQ ID NO: 4104 - RNA, 20 nt, Artificial Sequence
  Synthetic
gcgguccgacucgccggcca

SEQ ID NO: 4105 - RNA, 20 nt, Artificial Sequence
  Synthetic
cuccgaggagugcuccgacg

SEQ ID NO: 4106 - RNA, 20 nt, Artificial Sequence
  Synthetic
cccccauucggcguaguacc

SEQ ID NO: 4107 - RNA, 20 nt, Artificial Sequence
  Synthetic
ucuccgaggagugcuccgac

SEQ ID NO: 4108 - RNA, 20 nt, Artificial Sequence
  Synthetic
cccgcggguugguaucccuu

SEQ ID NO: 4109 - RNA, 20 nt, Artificial Sequence
  Synthetic
gcgaguacacguucuccgug

SEQ ID NO: 4110 - RNA, 20 nt, Artificial Sequence
  Synthetic
cccauucggcguaguaccca

SEQ ID NO: 4111 - RNA, 20 nt, Artificial Sequence
  Synthetic
cuccguguugggcaucgcgg

SEQ ID NO: 4112 - RNA, 20 nt, Artificial Sequence
  Synthetic
ccgcgcuuaugcuucucgcc

SEQ ID NO: 4113 - RNA, 20 nt, Artificial Sequence
  Synthetic
cgacgaagacucgguggccg

SEQ ID NO: 4114 - RNA, 20 nt, Artificial Sequence
  Synthetic
acccccaccgcauagagcgc

SEQ ID NO: 4115 - RNA, 20 nt, Artificial Sequence
  Synthetic
acuacgccgaaugggggugu

SEQ ID NO: 4116 - RNA, 20 nt, Artificial Sequence
  Synthetic
ccgggcccggaccacuaaua

SEQ ID NO: 4117 - RNA, 20 nt, Artificial Sequence
  Synthetic
cgcguagccggcgagccacu

SEQ ID NO: 4118 - RNA, 20 nt, Artificial Sequence
  Synthetic
ucggagcacuccucggagaa

SEQ ID NO: 4119 - RNA, 20 nt, Artificial Sequence
  Synthetic
cggagcacuccucggagaac

SEQ ID NO: 4120 - RNA, 20 nt, Artificial Sequence
  Synthetic
ucucuggguacuacgccgaa

SEQ ID NO: 4121 - RNA, 20 nt, Artificial Sequence
  Synthetic
ugccgcagaacucgcaugac

SEQ ID NO: 4122 - RNA, 20 nt, Artificial Sequence
  Synthetic
gauaccaacccgcgggguca

SEQ ID NO: 4123 - RNA, 20 nt, Artificial Sequence
  Synthetic
ggauaccaacccgcgggguc

SEQ ID NO: 4124 - RNA, 20 nt, Artificial Sequence
  Synthetic
gggauaccaacccgcggggu

SEQ ID NO: 4125 - RNA, 20 nt, Artificial Sequence
  Synthetic
cccccaccgcauagagcgcc

SEQ ID NO: 4126 - RNA, 20 nt, Artificial Sequence
  Synthetic
gguuggggucguucucgcuc

SEQ ID NO: 4127 - RNA, 20 nt, Artificial Sequence
  Synthetic
gcacgccccauauuaguggu

SEQ ID NO: 4128 - RNA, 20 nt, Artificial Sequence
  Synthetic
uaagcgcaucaagcucgaga

SEQ ID NO: 4129 - RNA, 20 nt, Artificial Sequence
  Synthetic
guucuccgaggagugcuccg

SEQ ID NO: 4130 - RNA, 20 nt, Artificial Sequence
  Synthetic
ucucgagcuugaugcgcuua

SEQ ID NO: 4131 - RNA, 20 nt, Artificial Sequence
  Synthetic
cuaagcgcaucaagcucgag

SEQ ID NO: 4132 - RNA, 20 nt, Artificial Sequence
  Synthetic
gucggagcacuccucggaga

SEQ ID NO: 4133 - RNA, 20 nt, Artificial Sequence
  Synthetic
uggccgcggcugcuccccgg

SEQ ID NO: 4134 - RNA, 20 nt, Artificial Sequence
  Synthetic
ccccaccgcauagagcgccu

SEQ ID NO: 4135 - RNA, 20 nt, Artificial Sequence
  Synthetic
ccugaagggauaccaacccg

SEQ ID NO: 4136 - RNA, 20 nt, Artificial Sequence
  Synthetic
gcgcuucuccacaccgcccg

SEQ ID NO: 4137 - RNA, 20 nt, Artificial Sequence
  Synthetic
gcgcccugcccgacgucaug

SEQ ID NO: 4138 - RNA, 20 nt, Artificial Sequence
  Synthetic
aacccggcaccagcgacuug

SEQ ID NO: 4139 - RNA, 20 nt, Artificial Sequence
  Synthetic
cucuggguacuacgccgaau

SEQ ID NO: 4140 - RNA, 20 nt, Artificial Sequence
  Synthetic
cccguucuccgggaucaggu

SEQ ID NO: 4141 - RNA, 20 nt, Artificial Sequence
  Synthetic
gaacgaccccaaccugaucc

SEQ ID NO: 4142 - RNA, 20 nt, Artificial Sequence
  Synthetic
acgccgaaugggggugugug

SEQ ID NO: 4143 - RNA, 20 nt, Artificial Sequence
  Synthetic
gucgcuggugccggguuccg

SEQ ID NO: 4144 - RNA, 20 nt, Artificial Sequence
  Synthetic
ccccgggcgagucggccucg

SEQ ID NO: 4145 - RNA, 20 nt, Artificial Sequence
  Synthetic
cggugcaccaccagguugcu

SEQ ID NO: 4146 - RNA, 20 nt, Artificial Sequence
  Synthetic
guccaccaccgagacaucac

SEQ ID NO: 4147 - RNA, 20 nt, Artificial Sequence
  Synthetic
uuaauggccgcggcugcucc

SEQ ID NO: 4148 - RNA, 20 nt, Artificial Sequence
  Synthetic
cucucuggguacuacgccga

SEQ ID NO: 4149 - RNA, 20 nt, Artificial Sequence
  Synthetic
gcgcaaacucccguucuccg

SEQ ID NO: 4150 - RNA, 20 nt, Artificial Sequence
  Synthetic
cccgggcccggaccacuaau

SEQ ID NO: 4151 - RNA, 20 nt, Artificial Sequence
  Synthetic
gcccccaggcgcucuaugcg

SEQ ID NO: 4152 - RNA, 20 nt, Artificial Sequence
  Synthetic
aucgccuuuugccuccucgu

SEQ ID NO: 4153 - RNA, 20 nt, Artificial Sequence
  Synthetic
ccucgucggagcacuccucg

SEQ ID NO: 4154 - RNA, 20 nt, Artificial Sequence
  Synthetic
gagcuugaugcgcuuagaga

SEQ ID NO: 4155 - RNA, 20 nt, Artificial Sequence
  Synthetic
ccccguucuccgggaucagg

SEQ ID NO: 4156 - RNA, 20 nt, Artificial Sequence
  Synthetic
cggccgcgaugcccaacacg

SEQ ID NO: 4157 - RNA, 20 nt, Artificial Sequence
  Synthetic
gccccccgaggccgacucgc

SEQ ID NO: 4158 - RNA, 20 nt, Artificial Sequence
  Synthetic
cccggccgcgaugcccaaca

SEQ ID NO: 4159 - RNA, 20 nt, Artificial Sequence
  Synthetic
cuccucgucggagcacuccu

SEQ ID NO: 4160 - RNA, 20 nt, Artificial Sequence
  Synthetic
gucucggugguggacuaaac

SEQ ID NO: 4161 - RNA, 20 nt, Artificial Sequence
  Synthetic
ccccaggcgcucuaugcggu

SEQ ID NO: 4162 - RNA, 20 nt, Artificial Sequence
  Synthetic
ggucgcacagguugcacuug

SEQ ID NO: 4163 - RNA, 20 nt, Artificial Sequence
  Synthetic
agucgcuggugccggguucc

SEQ ID NO: 4164 - RNA, 20 nt, Artificial Sequence
  Synthetic
cccggucaaguccaagucau

SEQ ID NO: 4165 - RNA, 20 nt, Artificial Sequence
  Synthetic
agaacgaccccaaccugauc

SEQ ID NO: 4166 - RNA, 20 nt, Artificial Sequence
  Synthetic
uccguguugggcaucgcggc

SEQ ID NO: 4167 - RNA, 20 nt, Artificial Sequence
  Synthetic
ccuccucgucggagcacucc

SEQ ID NO: 4168 - RNA, 20 nt, Artificial Sequence
  Synthetic
ucacuuggacccccaccgca

SEQ ID NO: 4169 - RNA, 20 nt, Artificial Sequence
  Synthetic
cccaaccugaucccggagaa

SEQ ID NO: 4170 - RNA, 20 nt, Artificial Sequence
  Synthetic
acuacggcuucgggcugagc

SEQ ID NO: 4171 - RNA, 20 nt, Artificial Sequence
  Synthetic
uuugcgcuucuccacaccgc

SEQ ID NO: 4172 - RNA, 20 nt, Artificial Sequence
  Synthetic
aagucgcuggugccggguuc

SEQ ID NO: 4173 - RNA, 20 nt, Artificial Sequence
  Synthetic
ccccaaccugaucccggaga

SEQ ID NO: 4174 - RNA, 20 nt, Artificial Sequence
  Synthetic
aagacucgguggccggcgag

SEQ ID NO: 4175 - RNA, 20 nt, Artificial Sequence
  Synthetic
gcgcggccaccuggccgagg

SEQ ID NO: 4176 - RNA, 20 nt, Artificial Sequence
  Synthetic
aaucgccuuuugccuccucg

SEQ ID NO: 4177 - RNA, 20 nt, Artificial Sequence
  Synthetic
acgaccccaaccugaucccg

SEQ ID NO: 4178 - RNA, 20 nt, Artificial Sequence
  Synthetic
gaucccggagaacggggacg

SEQ ID NO: 4179 - RNA, 20 nt, Artificial Sequence
  Synthetic
ggggcaggucgaacuccuuc

SEQ ID NO: 4180 - RNA, 20 nt, Artificial Sequence
  Synthetic
uggcuauggagccucccgcc

SEQ ID NO: 4181 - RNA, 20 nt, Artificial Sequence
  Synthetic
cccccaggcgcucuaugcgg

SEQ ID NO: 4182 - RNA, 20 nt, Artificial Sequence
  Synthetic
gcgguugaauccaauggcua

SEQ ID NO: 4183 - RNA, 20 nt, Artificial Sequence
  Synthetic
cuacggcuucgggcugagcc

SEQ ID NO: 4184 - RNA, 20 nt, Artificial Sequence
  Synthetic
acagcucgcggggcgcgguc

SEQ ID NO: 4185 - RNA, 20 nt, Artificial Sequence
  Synthetic
ccccccuguuuaguccacca

SEQ ID NO: 4186 - RNA, 20 nt, Artificial Sequence
  Synthetic
cgcaugacuuggacuugacc

SEQ ID NO: 4187 - RNA, 20 nt, Artificial Sequence
  Synthetic
cacggaaguccccugacccc

SEQ ID NO: 4188 - RNA, 20 nt, Artificial Sequence
  Synthetic
ccucccgccauggauuucuc

SEQ ID NO: 4189 - RNA, 20 nt, Artificial Sequence
  Synthetic
ucucggugguggacuaaaca

SEQ ID NO: 4190 - RNA, 20 nt, Artificial Sequence
  Synthetic
ugaacuuggccaccacggac

SEQ ID NO: 4191 - RNA, 20 nt, Artificial Sequence
  Synthetic
cuucucuaagcgcaucaagc

SEQ ID NO: 4192 - RNA, 20 nt, Artificial Sequence
  Synthetic
agcgcaaacucccguucucc

SEQ ID NO: 4193 - RNA, 20 nt, Artificial Sequence
  Synthetic
ucggugguggacuaaacagg

SEQ ID NO: 4194 - RNA, 20 nt, Artificial Sequence
  Synthetic
cgccaccacgagaacagcuc

SEQ ID NO: 4195 - RNA, 20 nt, Artificial Sequence
  Synthetic
cucccgccauggauuucucu

SEQ ID NO: 4196 - RNA, 20 nt, Artificial Sequence
  Synthetic
cgagcuugaugcgcuuagag

SEQ ID NO: 4197 - RNA, 20 nt, Artificial Sequence
  Synthetic
augcccugcaugacgucggg

SEQ ID NO: 4198 - RNA, 20 nt, Artificial Sequence
  Synthetic
ucucuaagcgcaucaagcuc

SEQ ID NO: 4199 - RNA, 20 nt, Artificial Sequence
  Synthetic
guccaagugaugucucggug

SEQ ID NO: 4200 - RNA, 20 nt, Artificial Sequence
  Synthetic
cccccgaggccgacucgccc

SEQ ID NO: 4201 - RNA, 20 nt, Artificial Sequence
  Synthetic
ccccgaggccgacucgcccg

SEQ ID NO: 4202 - RNA, 20 nt, Artificial Sequence
  Synthetic
gaaauuugaacgucuugccg

SEQ ID NO: 4203 - RNA, 20 nt, Artificial Sequence
  Synthetic
gucgcugcgucugcccucuu

SEQ ID NO: 4204 - RNA, 20 nt, Artificial Sequence
  Synthetic
uggaggcggcgcgccaccac

SEQ ID NO: 4205 - RNA, 20 nt, Artificial Sequence
  Synthetic
cuucucgagcuugaugcgcu

SEQ ID NO: 4206 - RNA, 20 nt, Artificial Sequence
  Synthetic
gaagcgcaaacucccguucu

SEQ ID NO: 4207 - RNA, 20 nt, Artificial Sequence
  Synthetic
gagagaggcuuccggccugg

SEQ ID NO: 4208 - RNA, 20 nt, Artificial Sequence
  Synthetic
uccccgggcgagucggccuc

SEQ ID NO: 4209 - RNA, 20 nt, Artificial Sequence
  Synthetic
caagucgcuggugccggguu

SEQ ID NO: 4210 - RNA, 20 nt, Artificial Sequence
  Synthetic
cauagagcgccugggggcgg

SEQ ID NO: 4211 - RNA, 20 nt, Artificial Sequence
  Synthetic
cucggugguggacuaaacag

SEQ ID NO: 4212 - RNA, 20 nt, Artificial Sequence
  Synthetic
ccccccgaggccgacucgcc

SEQ ID NO: 4213 - RNA, 20 nt, Artificial Sequence
  Synthetic
gguuucucuugcaacacgca

SEQ ID NO: 4214 - RNA, 20 nt, Artificial Sequence
  Synthetic
acuuggacuugaccgggggc

SEQ ID NO: 4215 - RNA, 20 nt, Artificial Sequence
  Synthetic
ugaucccggagaacggggac

SEQ ID NO: 4216 - RNA, 20 nt, Artificial Sequence
  Synthetic
ugucuggagucuccgaagcu

SEQ ID NO: 4217 - RNA, 20 nt, Artificial Sequence
  Synthetic
auggauuucucuaggagacu

SEQ ID NO: 4218 - RNA, 20 nt, Artificial Sequence
  Synthetic
ugcgguugaauccaauggcu

SEQ ID NO: 4219 - RNA, 20 nt, Artificial Sequence
  Synthetic
cuccccgggcgagucggccu

SEQ ID NO: 4220 - RNA, 20 nt, Artificial Sequence
  Synthetic
ccugaucccggagaacgggg

SEQ ID NO: 4221 - RNA, 20 nt, Artificial Sequence
  Synthetic
ugucucggugguggacuaaa

SEQ ID NO: 4222 - RNA, 20 nt, Artificial Sequence
  Synthetic
cggugguggacuaaacaggg

SEQ ID NO: 4223 - RNA, 20 nt, Artificial Sequence
  Synthetic
ugcccaccaagucgcuggug

SEQ ID NO: 4224 - RNA, 20 nt, Artificial Sequence
  Synthetic
cgugguggccaaguucaaga

SEQ ID NO: 4225 - RNA, 20 nt, Artificial Sequence
  Synthetic
caucacccgagugccuuuga

SEQ ID NO: 4226 - RNA, 20 nt, Artificial Sequence
  Synthetic
gcggcaagacguucaaauuu

SEQ ID NO: 4227 - RNA, 20 nt, Artificial Sequence
  Synthetic
aagggcucucgagcuuccau

SEQ ID NO: 4228 - RNA, 20 nt, Artificial Sequence
  Synthetic
gucuggagucuccgaagcua

SEQ ID NO: 4229 - RNA, 20 nt, Artificial Sequence
  Synthetic
ccccggccgcgaugcccaac

SEQ ID NO: 4230 - RNA, 20 nt, Artificial Sequence
  Synthetic
cugucaaaggcacucgggug

SEQ ID NO: 4231 - RNA, 20 nt, Artificial Sequence
  Synthetic
cuuggacuugaccgggggcu

SEQ ID NO: 4232 - RNA, 20 nt, Artificial Sequence
  Synthetic
gacuuggacuugaccggggg

SEQ ID NO: 4233 - RNA, 20 nt, Artificial Sequence
  Synthetic
ugcgucugcccucuuuugag

SEQ ID NO: 4234 - RNA, 20 nt, Artificial Sequence
  Synthetic
ggaggcaaaaggcgauuguc

SEQ ID NO: 4235 - RNA, 20 nt, Artificial Sequence
  Synthetic
gcaacacgcacagaacacuc

SEQ ID NO: 4236 - RNA, 20 nt, Artificial Sequence
  Synthetic
gcaguaaccuuugcauaggg

SEQ ID NO: 4237 - RNA, 20 nt, Artificial Sequence
  Synthetic
uggugcaccggcgcagccac

SEQ ID NO: 4238 - RNA, 20 nt, Artificial Sequence
  Synthetic
ugguggccaaguucaagagc

SEQ ID NO: 4239 - RNA, 20 nt, Artificial Sequence
  Synthetic
gcauaagcgcggccaccugg

SEQ ID NO: 4240 - RNA, 20 nt, Artificial Sequence
  Synthetic
uugcauagggcugggccggc

SEQ ID NO: 4241 - RNA, 20 nt, Artificial Sequence
  Synthetic
ccaaccugaucccggagaac

SEQ ID NO: 4242 - RNA, 20 nt, Artificial Sequence
  Synthetic
agauguguggcaguuuucgg

SEQ ID NO: 4243 - RNA, 20 nt, Artificial Sequence
  Synthetic
caguuuucggauggaagcuc

SEQ ID NO: 4244 - RNA, 20 nt, Artificial Sequence
  Synthetic
gcuccccgggcgagucggcc

SEQ ID NO: 4245 - RNA, 20 nt, Artificial Sequence
  Synthetic
ggguggacuacggcuucggg

SEQ ID NO: 4246 - RNA, 20 nt, Artificial Sequence
  Synthetic
uaucccuucaggacuaggug

SEQ ID NO: 4247 - RNA, 20 nt, Artificial Sequence
  Synthetic
aucucggggcgcagcggcac

SEQ ID NO: 4248 - RNA, 20 nt, Artificial Sequence
  Synthetic
cgcucuugaacuuggccacc

SEQ ID NO: 4249 - RNA, 20 nt, Artificial Sequence
  Synthetic
gcaccggcgcagccacacgg

SEQ ID NO: 4250 - RNA, 20 nt, Artificial Sequence
  Synthetic
gcuucucgcccaggaccugg

SEQ ID NO: 4251 - RNA, 20 nt, Artificial Sequence
  Synthetic
ucccggagaacggggacgag

SEQ ID NO: 4252 - RNA, 20 nt, Artificial Sequence
  Synthetic
cagcacccugucaaaggcac

SEQ ID NO: 4253 - RNA, 20 nt, Artificial Sequence
  Synthetic
cauucugcaccuaguccuga

SEQ ID NO: 4254 - RNA, 20 nt, Artificial Sequence
  Synthetic
cuuuaaccugcuaagaauac

SEQ ID NO: 4255 - RNA, 20 nt, Artificial Sequence
  Synthetic
gucucuccaccgccagcucc

SEQ ID NO: 4256 - RNA, 20 nt, Artificial Sequence
  Synthetic
ucucuccaccgccagcuccc

SEQ ID NO: 4257 - RNA, 20 nt, Artificial Sequence
  Synthetic
ugcuucucgcccaggaccug

SEQ ID NO: 4258 - RNA, 20 nt, Artificial Sequence
  Synthetic
gcgccgccuccaggcucagc

SEQ ID NO: 4259 - RNA, 20 nt, Artificial Sequence
  Synthetic
agaucccuccguccagcucc

SEQ ID NO: 4260 - RNA, 20 nt, Artificial Sequence
  Synthetic
cgagaggguggacuacggcu

SEQ ID NO: 4261 - RNA, 20 nt, Artificial Sequence
  Synthetic
cguccagcuccccgggcggu

SEQ ID NO: 4262 - RNA, 20 nt, Artificial Sequence
  Synthetic
ccagcucucuaagucuccua

SEQ ID NO: 4263 - RNA, 20 nt, Artificial Sequence
  Synthetic
ucgcaugacuuggacuugac

SEQ ID NO: 4264 - RNA, 20 nt, Artificial Sequence
  Synthetic
gcaccaugcccugcaugacg

SEQ ID NO: 4265 - RNA, 20 nt, Artificial Sequence
  Synthetic
aaggcgauugucuggagucu

SEQ ID NO: 4266 - RNA, 20 nt, Artificial Sequence
  Synthetic
gccuggaggccgcguagccg

SEQ ID NO: 4267 - RNA, 20 nt, Artificial Sequence
  Synthetic
gcggccaccuggccgaggcc

SEQ ID NO: 4268 - RNA, 20 nt, Artificial Sequence
  Synthetic
agaauaccaggaucaguauc

SEQ ID NO: 4269 - RNA, 20 nt, Artificial Sequence
  Synthetic
gauguguggcaguuuucgga

SEQ ID NO: 4270 - RNA, 20 nt, Artificial Sequence
  Synthetic
ucuccacaccgcccggggag

SEQ ID NO: 4271 - RNA, 20 nt, Artificial Sequence
  Synthetic
ccuggaggcggcgcgccacc

SEQ ID NO: 4272 - RNA, 20 nt, Artificial Sequence
  Synthetic
cugguauucuuagcagguua

SEQ ID NO: 4273 - RNA, 20 nt, Artificial Sequence
  Synthetic
uagagaaggggcucagcgag

SEQ ID NO: 4274 - RNA, 20 nt, Artificial Sequence
  Synthetic
gaguguucugugcguguugc

SEQ ID NO: 4275 - RNA, 20 nt, Artificial Sequence
  Synthetic
aauaaccccuuuaaccugcu

SEQ ID NO: 4276 - RNA, 20 nt, Artificial Sequence
  Synthetic
aaagcgcccuucugccaggc

SEQ ID NO: 4277 - RNA, 20 nt, Artificial Sequence
  Synthetic
guccagcuccccgggcggug

SEQ ID NO: 4278 - RNA, 20 nt, Artificial Sequence
  Synthetic
aagggcggcuugcuaccugg

SEQ ID NO: 4279 - RNA, 20 nt, Artificial Sequence
  Synthetic
gaaagcgcccuucugccagg

SEQ ID NO: 4280 - RNA, 20 nt, Artificial Sequence
  Synthetic
agggcggcuugcuaccuggc

SEQ ID NO: 4281 - RNA, 20 nt, Artificial Sequence
  Synthetic
cgcggggcgcggucgugggc

SEQ ID NO: 4282 - RNA, 20 nt, Artificial Sequence
  Synthetic
gcgaggccuuccaccagguc

SEQ ID NO: 4283 - RNA, 20 nt, Artificial Sequence
  Synthetic
acuucccgugccgcugcgcc

SEQ ID NO: 4284 - RNA, 20 nt, Artificial Sequence
  Synthetic
gcacagaacacucauggauu

SEQ ID NO: 4285 - RNA, 20 nt, Artificial Sequence
  Synthetic
ccagcuccccgggcggugug

SEQ ID NO: 4286 - RNA, 20 nt, Artificial Sequence
  Synthetic
accgcccggggagcuggacg

SEQ ID NO: 4287 - RNA, 20 nt, Artificial Sequence
  Synthetic
ugguugcaguaaccuuugca

SEQ ID NO: 4288 - RNA, 20 nt, Artificial Sequence
  Synthetic
aggagacuuagagagcuggc

SEQ ID NO: 4289 - RNA, 20 nt, Artificial Sequence
  Synthetic
accggcgcagccacacgggc

SEQ ID NO: 4290 - RNA, 20 nt, Artificial Sequence
  Synthetic
acauucugcaccuaguccug

SEQ ID NO: 4291 - RNA, 20 nt, Artificial Sequence
  Synthetic
guguucugugcguguugcaa

SEQ ID NO: 4292 - RNA, 20 nt, Artificial Sequence
  Synthetic
uggcccuggccacccaucac

SEQ ID NO: 4293 - RNA, 20 nt, Artificial Sequence
  Synthetic
ugcauagggcugggccggcc

SEQ ID NO: 4294 - RNA, 20 nt, Artificial Sequence
  Synthetic
aauaccaggaucaguaucga

SEQ ID NO: 4295 - RNA, 20 nt, Artificial Sequence
  Synthetic
uccugaagggauaccaaccc

SEQ ID NO: 4296 - RNA, 20 nt, Artificial Sequence
  Synthetic
cuccuagagaaauccauggc

SEQ ID NO: 4297 - RNA, 20 nt, Artificial Sequence
  Synthetic
uggcgguggagagaccgucg

SEQ ID NO: 4298 - RNA, 20 nt, Artificial Sequence
  Synthetic
ggauuucucuaggagacuua

SEQ ID NO: 4299 - RNA, 20 nt, Artificial Sequence
  Synthetic
cucgcaugacuuggacuuga

SEQ ID NO: 4300 - RNA, 20 nt, Artificial Sequence
  Synthetic
gaucucggggcgcagcggca

SEQ ID NO: 4301 - RNA, 20 nt, Artificial Sequence
  Synthetic
ggugguggacuaaacagggg

SEQ ID NO: 4302 - RNA, 20 nt, Artificial Sequence
  Synthetic
aggccucgcugaagugcugc

SEQ ID NO: 4303 - RNA, 20 nt, Artificial Sequence
  Synthetic
ccaccagguugcucugaaau

SEQ ID NO: 4304 - RNA, 20 nt, Artificial Sequence
  Synthetic
accgcauagagcgccugggg

SEQ ID NO: 4305 - RNA, 20 nt, Artificial Sequence
  Synthetic
ccagcaagcugaagcgccac

SEQ ID NO: 4306 - RNA, 20 nt, Artificial Sequence
  Synthetic
ggccucgcugaagugcugca

SEQ ID NO: 4307 - RNA, 20 nt, Artificial Sequence
  Synthetic
cgugcacccaggccagcaag

SEQ ID NO: 4308 - RNA, 20 nt, Artificial Sequence
  Synthetic
ggcgggaggcuccauagcca

SEQ ID NO: 4309 - RNA, 20 nt, Artificial Sequence
  Synthetic
aggaggcaaaaggcgauugu

SEQ ID NO: 4310 - RNA, 20 nt, Artificial Sequence
  Synthetic
aaagaucccuuccuuagcuu

SEQ ID NO: 4311 - RNA, 20 nt, Artificial Sequence
  Synthetic
ggagucuccgaagcuaagga

SEQ ID NO: 4312 - RNA, 20 nt, Artificial Sequence
  Synthetic
gcgcuuagagaaggggcuca

SEQ ID NO: 4313 - RNA, 20 nt, Artificial Sequence
  Synthetic
cagcuuuuuggacaggcccc

SEQ ID NO: 4314 - RNA, 20 nt, Artificial Sequence
  Synthetic
gcacucgggugauggguggc

SEQ ID NO: 4315 - RNA, 20 nt, Artificial Sequence
  Synthetic
cacgcccacgaccgcgcccc

SEQ ID NO: 4316 - RNA, 20 nt, Artificial Sequence
  Synthetic
aaguuguacauguguagcug

SEQ ID NO: 4317 - RNA, 20 nt, Artificial Sequence
  Synthetic
aguccgugguggccaaguuc

SEQ ID NO: 4318 - RNA, 20 nt, Artificial Sequence
  Synthetic
cccggagaacggggacgagg

SEQ ID NO: 4319 - RNA, 20 nt, Artificial Sequence
  Synthetic
cgggcaggcccagcucaaaa

SEQ ID NO: 4320 - RNA, 20 nt, Artificial Sequence
  Synthetic
ugguauucuuagcagguuaa

SEQ ID NO: 4321 - RNA, 20 nt, Artificial Sequence
  Synthetic
uugucugcaauaugaauccc

SEQ ID NO: 4322 - RNA, 20 nt, Artificial Sequence
  Synthetic
gucuccuagagaaauccaug

SEQ ID NO: 4323 - RNA, 20 nt, Artificial Sequence
  Synthetic
uggacuugaccgggggcugg

SEQ ID NO: 4324 - RNA, 20 nt, Artificial Sequence
  Synthetic
uggagucuccgaagcuaagg

SEQ ID NO: 4325 - RNA, 20 nt, Artificial Sequence
  Synthetic
ugagcugggccugcccgggc

SEQ ID NO: 4326 - RNA, 20 nt, Artificial Sequence
  Synthetic
caaagaucccuuccuuagcu

SEQ ID NO: 4327 - RNA, 20 nt, Artificial Sequence
  Synthetic
ugccacacaucuugagcucu

SEQ ID NO: 4328 - RNA, 20 nt, Artificial Sequence
  Synthetic
ccgcccggggagcuggacgg

SEQ ID NO: 4329 - RNA, 20 nt, Artificial Sequence
  Synthetic
agagaaggggcucagcgagc

SEQ ID NO: 4330 - RNA, 20 nt, Artificial Sequence
  Synthetic
ggagacuuagagagcuggca

SEQ ID NO: 4331 - RNA, 20 nt, Artificial Sequence
  Synthetic
gaaucccauggagagguggc

SEQ ID NO: 4332 - RNA, 20 nt, Artificial Sequence
  Synthetic
cgcugaagugcugcauggag

SEQ ID NO: 4333 - RNA, 20 nt, Artificial Sequence
  Synthetic
aggacauucugcaccuaguc

SEQ ID NO: 4334 - RNA, 20 nt, Artificial Sequence
  Synthetic
aaucccauggagagguggcu

SEQ ID NO: 4335 - RNA, 20 nt, Artificial Sequence
  Synthetic
ugagcucucuggguacuacg

SEQ ID NO: 4336 - RNA, 20 nt, Artificial Sequence
  Synthetic
gggccacagggacacuugcg

SEQ ID NO: 4337 - RNA, 20 nt, Artificial Sequence
  Synthetic
uaggagacuuagagagcugg

SEQ ID NO: 4338 - RNA, 20 nt, Artificial Sequence
  Synthetic
ccuuugacagggugcugcgg

SEQ ID NO: 4339 - RNA, 20 nt, Artificial Sequence
  Synthetic
uggccgaggccgagggccac

SEQ ID NO: 4340 - RNA, 20 nt, Artificial Sequence
  Synthetic
ggaagggaucuuugagcugc

SEQ ID NO: 4341 - RNA, 20 nt, Artificial Sequence
  Synthetic
ucuaaguagauucuuaaucc

SEQ ID NO: 4342 - RNA, 20 nt, Artificial Sequence
  Synthetic
ggggcgcagcggcacgggaa

SEQ ID NO: 4343 - RNA, 20 nt, Artificial Sequence
  Synthetic
cuggccgaggccgagggcca

SEQ ID NO: 4344 - RNA, 20 nt, Artificial Sequence
  Synthetic
cucaagauguguggcaguuu

SEQ ID NO: 4345 - RNA, 20 nt, Artificial Sequence
  Synthetic
cgaagcuaaggaagggaucu

SEQ ID NO: 4346 - RNA, 20 nt, Artificial Sequence
  Synthetic
ugccagcucucuaagucucc

SEQ ID NO: 4347 - RNA, 20 nt, Artificial Sequence
  Synthetic
ucuccuagagaaauccaugg

SEQ ID NO: 4348 - RNA, 20 nt, Artificial Sequence
  Synthetic
gccaccacgagaacagcucg

SEQ ID NO: 4349 - RNA, 20 nt, Artificial Sequence
  Synthetic
ucugcaauaugaaucccaug

SEQ ID NO: 4350 - RNA, 20 nt, Artificial Sequence
  Synthetic
cagcuccaugcagcacuuca

SEQ ID NO: 4351 - RNA, 20 nt, Artificial Sequence
  Synthetic
gccuguccaaaaagcugcug

SEQ ID NO: 4352 - RNA, 20 nt, Artificial Sequence
  Synthetic
uaagaauaccaggaucagua

SEQ ID NO: 4353 - RNA, 20 nt, Artificial Sequence
  Synthetic
ggaucucggggcgcagcggc

SEQ ID NO: 4354 - RNA, 20 nt, Artificial Sequence
  Synthetic
ggcaguuuucggauggaagc

SEQ ID NO: 4355 - RNA, 20 nt, Artificial Sequence
  Synthetic
cggucgugggcgugggcgac

SEQ ID NO: 4356 - RNA, 20 nt, Artificial Sequence
  Synthetic
gcaucgcggccgggggcagg

SEQ ID NO: 4357 - RNA, 20 nt, Artificial Sequence
  Synthetic
aaucuacuuagaaagcgaac

SEQ ID NO: 4358 - RNA, 20 nt, Artificial Sequence
  Synthetic
aagggguuauugucugcaau

SEQ ID NO: 4359 - RNA, 20 nt, Artificial Sequence
  Synthetic
ggacuugaccgggggcuggg

SEQ ID NO: 4360 - RNA, 20 nt, Artificial Sequence
  Synthetic
ucauggauuaagaaucuacu

SEQ ID NO: 4361 - RNA, 20 nt, Artificial Sequence
  Synthetic
agaggcuuccggccuggcag

SEQ ID NO: 4362 - RNA, 20 nt, Artificial Sequence
  Synthetic
ggccuuccaccagguccugg

SEQ ID NO: 4363 - RNA, 20 nt, Artificial Sequence
  Synthetic
uggcgcuucagcuugcuggc

SEQ ID NO: 4364 - RNA, 20 nt, Artificial Sequence
  Synthetic
ccgcauagagcgccuggggg

SEQ ID NO: 4365 - RNA, 20 nt, Artificial Sequence
  Synthetic
ggaccugguggaaggccucg

SEQ ID NO: 4366 - RNA, 20 nt, Artificial Sequence
  Synthetic
ccuuccaccagguccugggc

SEQ ID NO: 4367 - RNA, 20 nt, Artificial Sequence
  Synthetic
ugucugcaauaugaauccca

SEQ ID NO: 4368 - RNA, 20 nt, Artificial Sequence
  Synthetic
ggagcuggacggagggaucu

SEQ ID NO: 4369 - RNA, 20 nt, Artificial Sequence
  Synthetic
gacuugaccgggggcuggga

SEQ ID NO: 4370 - RNA, 20 nt, Artificial Sequence
  Synthetic
uccuucccagccaccucucc

SEQ ID NO: 4371 - RNA, 20 nt, Artificial Sequence
  Synthetic
cucuuuugagcugggccugc

SEQ ID NO: 4372 - RNA, 20 nt, Artificial Sequence
  Synthetic
ugcgcuucuccacaccgccc

SEQ ID NO: 4373 - RNA, 20 nt, Artificial Sequence
  Synthetic
gcaagagaaaccaugcacug

SEQ ID NO: 4374 - RNA, 20 nt, Artificial Sequence
  Synthetic
gggagcuggacggagggauc

SEQ ID NO: 4375 - RNA, 20 nt, Artificial Sequence
  Synthetic
guuccggggagcuggcggug

SEQ ID NO: 4376 - RNA, 20 nt, Artificial Sequence
  Synthetic
ugaaucccauggagaggugg

SEQ ID NO: 4377 - RNA, 20 nt, Artificial Sequence
  Synthetic
cggguuccggggagcuggcg

SEQ ID NO: 4378 - RNA, 20 nt, Artificial Sequence
  Synthetic
guggacuaaacaggggggga

SEQ ID NO: 4379 - RNA, 20 nt, Artificial Sequence
  Synthetic
ggcugcccagcagcagcuuu

SEQ ID NO: 4380 - RNA, 20 nt, Artificial Sequence
  Synthetic
gaagggaucuuugagcugcc

SEQ ID NO: 4381 - RNA, 20 nt, Artificial Sequence
  Synthetic
ccuucccagccaccucucca

SEQ ID NO: 4382 - RNA, 20 nt, Artificial Sequence
  Synthetic
gcgcagcggcacgggaagug

SEQ ID NO: 4383 - RNA, 20 nt, Artificial Sequence
  Synthetic
ggguuccggggagcuggcgg

SEQ ID NO: 4384 - RNA, 20 nt, Artificial Sequence
  Synthetic
uccuccucguccccguucuc

SEQ ID NO: 4385 - RNA, 20 nt, Artificial Sequence
  Synthetic
gcagcggcacgggaagugga

SEQ ID NO: 4386 - RNA, 20 nt, Artificial Sequence
  Synthetic
ugcugggcagccccagcucg

SEQ ID NO: 4387 - RNA, 20 nt, Artificial Sequence
  Synthetic
gggcgcagcggcacgggaag

SEQ ID NO: 4388 - RNA, 20 nt, Artificial Sequence
  Synthetic
acaccgcccggggagcugga

SEQ ID NO: 4389 - RNA, 20 nt, Artificial Sequence
  Synthetic
cccauggagagguggcuggg

SEQ ID NO: 4390 - RNA, 20 nt, Artificial Sequence
  Synthetic
uuccuccucguccccguucu

SEQ ID NO: 4391 - RNA, 20 nt, Artificial Sequence
  Synthetic
aucuacuuagaaagcgaaca

SEQ ID NO: 4392 - RNA, 20 nt, Artificial Sequence
  Synthetic
cccgggcaggcccagcucaa

SEQ ID NO: 4393 - RNA, 20 nt, Artificial Sequence
  Synthetic
cacaccgcccggggagcugg

SEQ ID NO: 4394 - RNA, 20 nt, Artificial Sequence
  Synthetic
acuaaacagggggggagugg

SEQ ID NO: 4395 - RNA, 20 nt, Artificial Sequence
  Synthetic
gaccgggggcugggagggag

SEQ ID NO: 4396 - RNA, 20 nt, Artificial Sequence
  Synthetic
gggccggccuggggacagcg

SEQ ID NO: 4397 - RNA, 20 nt, Artificial Sequence
  Synthetic
gcauagggcugggccggccu

SEQ ID NO: 4398 - RNA, 20 nt, Artificial Sequence
  Synthetic
auuaagaaucuacuuagaaa

SEQ ID NO: 4399 - RNA, 20 nt, Artificial Sequence
  Synthetic
cuaaacagggggggaguggg

SEQ ID NO: 4400 - RNA, 20 nt, Artificial Sequence
  Synthetic
uugaccgggggcugggaggg

SEQ ID NO: 4401 - RNA, 20 nt, Artificial Sequence
  Synthetic
cgcggucgugggcgugggcg

SEQ ID NO: 4402 - RNA, 20 nt, Artificial Sequence
  Synthetic
gagggagggggggcgucgcc

SEQ ID NO: 4403 - RNA, 20 nt, Artificial Sequence
  Synthetic
ggagaacggggacgaggagg

SEQ ID NO: 4404 - RNA, 20 nt, Artificial Sequence
  Synthetic
cuugaccgggggcugggagg

SEQ ID NO: 4405 - RNA, 20 nt, Artificial Sequence
  Synthetic
ggagggagggggggcgucgc

SEQ ID NO: 4406 - RNA, 20 nt, Artificial Sequence
  Synthetic
accgggggcugggagggagg

SEQ ID NO: 4407 - RNA, 20 nt, Artificial Sequence
  Synthetic
cgcagcggcacgggaagugg

SEQ ID NO: 4408 - RNA, 20 nt, Artificial Sequence
  Synthetic
gcggauugcagaggagggag

SEQ ID NO: 4409 - RNA, 20 nt, Artificial Sequence
  Synthetic
ggagggggggcgucgccagg

SEQ ID NO: 4410 - RNA, 20 nt, Artificial Sequence
  Synthetic
ggcggauugcagaggaggga

SEQ ID NO: 4411 - RNA, 20 nt, Artificial Sequence
  Synthetic
gaggggcggauugcagagga

SEQ ID NO: 4412 - RNA, 20 nt, Artificial Sequence
  Synthetic
ggggcggauugcagaggagg

SEQ ID NO: 4413 - RNA, 20 nt, Artificial Sequence
  Synthetic
gaggagcugacggagagcga

SEQ ID NO: 4414 - RNA, 20 nt, Artificial Sequence
  Synthetic
uccgaaaacugccacacauc

SEQ ID NO: 4415 - RNA, 20 nt, Artificial Sequence
  Synthetic
cggauugcagaggagggagg

SEQ ID NO: 4416 - RNA, 20 nt, Artificial Sequence
  Synthetic
ggaggggcggauugcagagg

SEQ ID NO: 4417 - RNA, 20 nt, Artificial Sequence
  Synthetic
gggcggauugcagaggaggg

SEQ ID NO: 4418 - RNA, 20 nt, Artificial Sequence
  Synthetic
aggaggggcggauugcagag

SEQ ID NO: 4419 - RNA, 20 nt, Artificial Sequence
  Synthetic
agaacggggacgaggaggaa

SEQ ID NO: 4420 - RNA, 20 nt, Artificial Sequence
  Synthetic
gagggaggaggggcggauug

SEQ ID NO: 4421 - RNA, 20 nt, Artificial Sequence
  Synthetic
uugcgcuucuccacaccgcc

SEQ ID NO: 4422 - RNA, 20 nt, Artificial Sequence
  Synthetic
agcugacggagagcgagagg

SEQ ID NO: 4423 - RNA, 20 nt, Artificial Sequence
  Synthetic
aggaggagcugacggagagc

SEQ ID NO: 4424 - RNA, 20 nt, Artificial Sequence
  Synthetic
ggggcugggagggaggaggg

SEQ ID NO: 4425 - RNA, 20 nt, Artificial Sequence
  Synthetic
gggaggaggggcggauugca

SEQ ID NO: 4426 - RNA, 20 nt, Artificial Sequence
  Synthetic
ccguguugggcaucgcggcc

SEQ ID NO: 4427 - RNA, 20 nt, Artificial Sequence
  Synthetic
gaacggggacgaggaggaag

SEQ ID NO: 4428 - RNA, 20 nt, Artificial Sequence
  Synthetic
ggaggaggggcggauugcag

SEQ ID NO: 4429 - RNA, 20 nt, Artificial Sequence
  Synthetic
ggaggaggagcugacggaga

SEQ ID NO: 4430 - RNA, 20 nt, Artificial Sequence
  Synthetic
acggggacgaggaggaagag

SEQ ID NO: 4431 - RNA, 20 nt, Artificial Sequence
  Synthetic
aggaggaggaggagcugacg

SEQ ID NO: 4432 - RNA, 20 nt, Artificial Sequence
  Synthetic
acgacgaggaagaggaagaa

SEQ ID NO: 4433 - RNA, 20 nt, Artificial Sequence
  Synthetic
acgaggaagaggaagaagag

SEQ ID NO: 4434 - RNA, 20 nt, Artificial Sequence
  Synthetic
aggaggaagaggaggacgac

SEQ ID NO: 4435 - RNA, 20 nt, Artificial Sequence
  Synthetic
aagaggaggacgacgaggaa

SEQ ID NO: 4436 - RNA, 20 nt, Artificial Sequence
  Synthetic
agaggaggaggaggagcuga

SEQ ID NO: 4437 - RNA, 20 nt, Artificial Sequence
  Synthetic
ggaggaagaggaggacgacg

SEQ ID NO: 4438 - RNA, 20 nt, Artificial Sequence
  Synthetic
cgaggaggaagaggaggacg

SEQ ID NO: 4439 - RNA, 20 nt, Artificial Sequence
  Synthetic
cgaggaagaggaagaagagg

SEQ ID NO: 4440 - RNA, 20 nt, Artificial Sequence
  Synthetic
aagaggaggaggaggagcug

SEQ ID NO: 4441 - RNA, 20 nt, Artificial Sequence
  Synthetic
cgacgaggaagaggaagaag

SEQ ID NO: 4442 - RNA, 20 nt, Artificial Sequence
  Synthetic
ggaggacgacgaggaagagg

SEQ ID NO: 4443 - RNA, 20 nt, Artificial Sequence
  Synthetic
agaggaggacgacgaggaag

SEQ ID NO: 4444 - RNA, 20 nt, Artificial Sequence
  Synthetic
ggacgacgaggaagaggaag

SEQ ID NO: 4445 - RNA, 20 nt, Artificial Sequence
  Synthetic
ggaagaggaggacgacgagg

SEQ ID NO: 4446 - RNA, 20 nt, Artificial Sequence
  Synthetic
aggaagaagaggaggaagag

SEQ ID NO: 4447 - RNA, 20 nt, Artificial Sequence
  Synthetic
aagaggaagaagaggaggaa

SEQ ID NO: 4448 - RNA, 20 nt, Artificial Sequence
  Synthetic
ggaagaggaagaagaggagg

SEQ ID NO: 4449 - RNA, 20 nt, Artificial Sequence
  Synthetic
aagaagaggaggaagaggag

SEQ ID NO: 4450 - RNA, 20 nt, Artificial Sequence
  Synthetic
aagaggaggaagaggaggag

SEQ ID NO: 4451 - RNA, 20 nt, Artificial Sequence
  Synthetic
agaggaagaagaggaggaag

SEQ ID NO: 4452 - RNA, 20 nt, Artificial Sequence
  Synthetic
ggaagaagaggaggaagagg

SEQ ID NO: 4453 - RNA, 20 nt, Artificial Sequence
  Synthetic
agaagaggaggaagaggagg

SEQ ID NO: 4454 - RNA, 20 nt, Artificial Sequence
  Synthetic
agaggaggaagaggaggagg

SEQ ID NO: 4455 - RNA, 17 nt, Artificial Sequence
  Synthetic
ucggacuugaccgucau

SEQ ID NO: 4456 - RNA, 17 nt, Artificial Sequence
  Synthetic
gucggacuugaccguca

SEQ ID NO: 4457 - RNA, 17 nt, Artificial Sequence
  Synthetic
cgucggacuugaccguc

SEQ ID NO: 4458 - RNA, 17 nt, Artificial Sequence
  Synthetic
cggacuugaccgucaug

SEQ ID NO: 4459 - RNA, 17 nt, Artificial Sequence
  Synthetic
auauuagugguccgggc

SEQ ID NO: 4460 - RNA, 17 nt, Artificial Sequence
  Synthetic
guccgacucgccggcca

SEQ ID NO: 4461 - RNA, 17 nt, Artificial Sequence
  Synthetic
cgaggagugcuccgacg

SEQ ID NO: 4462 - RNA, 17 nt, Artificial Sequence
  Synthetic
ccauucggcguaguacc

SEQ ID NO: 4463 - RNA, 17 nt, Artificial Sequence
  Synthetic
ccgaggagugcuccgac

SEQ ID NO: 4464 - RNA, 17 nt, Artificial Sequence
  Synthetic
gcggguugguaucccuu

SEQ ID NO: 4465 - RNA, 17 nt, Artificial Sequence
  Synthetic
aguacacguucuccgug

SEQ ID NO: 4466 - RNA, 17 nt, Artificial Sequence
  Synthetic
auucggcguaguaccca

SEQ ID NO: 4467 - RNA, 17 nt, Artificial Sequence
  Synthetic
cguguugggcaucgcgg

SEQ ID NO: 4468 - RNA, 17 nt, Artificial Sequence
  Synthetic
cgcuuaugcuucucgcc

SEQ ID NO: 4469 - RNA, 17 nt, Artificial Sequence
  Synthetic
cgaagacucgguggccg

SEQ ID NO: 4470 - RNA, 17 nt, Artificial Sequence
  Synthetic
cccaccgcauagagcgc

SEQ ID NO: 4471 - RNA, 17 nt, Artificial Sequence
  Synthetic
acgccgaaugggggugu

SEQ ID NO: 4472 - RNA, 17 nt, Artificial Sequence
  Synthetic
ggcccggaccacuaaua

SEQ ID NO: 4473 - RNA, 17 nt, Artificial Sequence
  Synthetic
guagccggcgagccacu

SEQ ID NO: 4474 - RNA, 17 nt, Artificial Sequence
  Synthetic
gagcacuccucggagaa

SEQ ID NO: 4475 - RNA, 17 nt, Artificial Sequence
  Synthetic
agcacuccucggagaac

SEQ ID NO: 4476 - RNA, 17 nt, Artificial Sequence
  Synthetic
cuggguacuacgccgaa

SEQ ID NO: 4477 - RNA, 17 nt, Artificial Sequence
  Synthetic
cgcagaacucgcaugac

SEQ ID NO: 4478 - RNA, 17 nt, Artificial Sequence
  Synthetic
accaacccgcgggguca

SEQ ID NO: 4479 - RNA, 17 nt, Artificial Sequence
  Synthetic
uaccaacccgcgggguc

SEQ ID NO: 4480 - RNA, 17 nt, Artificial Sequence
  Synthetic
auaccaacccgcggggu

SEQ ID NO: 4481 - RNA, 17 nt, Artificial Sequence
  Synthetic
ccaccgcauagagcgcc

SEQ ID NO: 4482 - RNA, 17 nt, Artificial Sequence
  Synthetic
uggggucguucucgcuc

SEQ ID NO: 4483 - RNA, 17 nt, Artificial Sequence
  Synthetic
cgccccauauuaguggu

SEQ ID NO: 4484 - RNA, 17 nt, Artificial Sequence
  Synthetic
gcgcaucaagcucgaga

SEQ ID NO: 4485 - RNA, 17 nt, Artificial Sequence
  Synthetic
cuccgaggagugcuccg

SEQ ID NO: 4486 - RNA, 17 nt, Artificial Sequence
  Synthetic
cgagcuugaugcgcuua

SEQ ID NO: 4487 - RNA, 17 nt, Artificial Sequence
  Synthetic
agcgcaucaagcucgag

SEQ ID NO: 4488 - RNA, 17 nt, Artificial Sequence
  Synthetic
ggagcacuccucggaga

SEQ ID NO: 4489 - RNA, 17 nt, Artificial Sequence
  Synthetic
ccgcggcugcuccccgg

SEQ ID NO: 4490 - RNA, 17 nt, Artificial Sequence
  Synthetic
caccgcauagagcgccu

SEQ ID NO: 4491 - RNA, 17 nt, Artificial Sequence
  Synthetic
gaagggauaccaacccg

SEQ ID NO: 4492 - RNA, 17 nt, Artificial Sequence
  Synthetic
cuucuccacaccgcccg

SEQ ID NO: 4493 - RNA, 17 nt, Artificial Sequence
  Synthetic
cccugcccgacgucaug

SEQ ID NO: 4494 - RNA, 17 nt, Artificial Sequence
  Synthetic
ccggcaccagcgacuug

SEQ ID NO: 4495 - RNA, 17 nt, Artificial Sequence
  Synthetic
uggguacuacgccgaau

SEQ ID NO: 4496 - RNA, 17 nt, Artificial Sequence
  Synthetic
guucuccgggaucaggu

SEQ ID NO: 4497 - RNA, 17 nt, Artificial Sequence
  Synthetic
cgaccccaaccugaucc

SEQ ID NO: 4498 - RNA, 17 nt, Artificial Sequence
  Synthetic
ccgaaugggggugugug

SEQ ID NO: 4499 - RNA, 17 nt, Artificial Sequence
  Synthetic
gcuggugccggguuccg

SEQ ID NO: 4500 - RNA, 17 nt, Artificial Sequence
  Synthetic
cgggcgagucggccucg

SEQ ID NO: 4501 - RNA, 17 nt, Artificial Sequence
  Synthetic
ugcaccaccagguugcu

SEQ ID NO: 4502 - RNA, 17 nt, Artificial Sequence
  Synthetic
caccaccgagacaucac

SEQ ID NO: 4503 - RNA, 17 nt, Artificial Sequence
  Synthetic
auggccgcggcugcucc

SEQ ID NO: 4504 - RNA, 17 nt, Artificial Sequence
  Synthetic
ucuggguacuacgccga

SEQ ID NO: 4505 - RNA, 17 nt, Artificial Sequence
  Synthetic
caaacucccguucuccg

SEQ ID NO: 4506 - RNA, 17 nt, Artificial Sequence
  Synthetic
gggcccggaccacuaau

SEQ ID NO: 4507 - RNA, 17 nt, Artificial Sequence
  Synthetic
cccaggcgcucuaugcg

SEQ ID NO: 4508 - RNA, 17 nt, Artificial Sequence
  Synthetic
gccuuuugccuccucgu

SEQ ID NO: 4509 - RNA, 17 nt, Artificial Sequence
  Synthetic
cgucggagcacuccucg

SEQ ID NO: 4510 - RNA, 17 nt, Artificial Sequence
  Synthetic
cuugaugcgcuuagaga

SEQ ID NO: 4511 - RNA, 17 nt, Artificial Sequence
  Synthetic
cguucuccgggaucagg

SEQ ID NO: 4512 - RNA, 17 nt, Artificial Sequence
  Synthetic
ccgcgaugcccaacacg

SEQ ID NO: 4513 - RNA, 17 nt, Artificial Sequence
  Synthetic
ccccgaggccgacucgc

SEQ ID NO: 4514 - RNA, 17 nt, Artificial Sequence
  Synthetic
ggccgcgaugcccaaca

SEQ ID NO: 4515 - RNA, 17 nt, Artificial Sequence
  Synthetic
cucgucggagcacuccu

SEQ ID NO: 4516 - RNA, 17 nt, Artificial Sequence
  Synthetic
ucggugguggacuaaac

SEQ ID NO: 4517 - RNA, 17 nt, Artificial Sequence
  Synthetic
caggcgcucuaugcggu

SEQ ID NO: 4518 - RNA, 17 nt, Artificial Sequence
  Synthetic
cgcacagguugcacuug

SEQ ID NO: 4519 - RNA, 17 nt, Artificial Sequence
  Synthetic
cgcuggugccggguucc

SEQ ID NO: 4520 - RNA, 17 nt, Artificial Sequence
  Synthetic
ggucaaguccaagucau

SEQ ID NO: 4521 - RNA, 17 nt, Artificial Sequence
  Synthetic
acgaccccaaccugauc

SEQ ID NO: 4522 - RNA, 17 nt, Artificial Sequence
  Synthetic
guguugggcaucgcggc

SEQ ID NO: 4523 - RNA, 17 nt, Artificial Sequence
  Synthetic
ccucgucggagcacucc

SEQ ID NO: 4524 - RNA, 17 nt, Artificial Sequence
  Synthetic
cuuggacccccaccgca

SEQ ID NO: 4525 - RNA, 17 nt, Artificial Sequence
  Synthetic
aaccugaucccggagaa

SEQ ID NO: 4526 - RNA, 17 nt, Artificial Sequence
  Synthetic
acggcuucgggcugagc

SEQ ID NO: 4527 - RNA, 17 nt, Artificial Sequence
  Synthetic
gcgcuucuccacaccgc

SEQ ID NO: 4528 - RNA, 17 nt, Artificial Sequence
  Synthetic
ucgcuggugccggguuc

SEQ ID NO: 4529 - RNA, 17 nt, Artificial Sequence
  Synthetic
caaccugaucccggaga

SEQ ID NO: 4530 - RNA, 17 nt, Artificial Sequence
  Synthetic
acucgguggccggcgag

SEQ ID NO: 4531 - RNA, 17 nt, Artificial Sequence
  Synthetic
cggccaccuggccgagg

SEQ ID NO: 4532 - RNA, 17 nt, Artificial Sequence
  Synthetic
cgccuuuugccuccucg

SEQ ID NO: 4533 - RNA, 17 nt, Artificial Sequence
  Synthetic
accccaaccugaucccg

SEQ ID NO: 4534 - RNA, 17 nt, Artificial Sequence
  Synthetic
cccggagaacggggacg

SEQ ID NO: 4535 - RNA, 17 nt, Artificial Sequence
  Synthetic
gcaggucgaacuccuuc

SEQ ID NO: 4536 - RNA, 17 nt, Artificial Sequence
  Synthetic
cuauggagccucccgcc

SEQ ID NO: 4537 - RNA, 17 nt, Artificial Sequence
  Synthetic
ccaggcgcucuaugcgg

SEQ ID NO: 4538 - RNA, 17 nt, Artificial Sequence
  Synthetic
guugaauccaauggcua

SEQ ID NO: 4539 - RNA, 17 nt, Artificial Sequence
  Synthetic
cggcuucgggcugagcc

SEQ ID NO: 4540 - RNA, 17 nt, Artificial Sequence
  Synthetic
gcucgcggggcgcgguc

SEQ ID NO: 4541 - RNA, 17 nt, Artificial Sequence
  Synthetic
cccuguuuaguccacca

SEQ ID NO: 4542 - RNA, 17 nt, Artificial Sequence
  Synthetic
augacuuggacuugacc

SEQ ID NO: 4543 - RNA, 17 nt, Artificial Sequence
  Synthetic
ggaaguccccugacccc

SEQ ID NO: 4544 - RNA, 17 nt, Artificial Sequence
  Synthetic
cccgccauggauuucuc

SEQ ID NO: 4545 - RNA, 17 nt, Artificial Sequence
  Synthetic
cggugguggacuaaaca

SEQ ID NO: 4546 - RNA, 17 nt, Artificial Sequence
  Synthetic
acuuggccaccacggac

SEQ ID NO: 4547 - RNA, 17 nt, Artificial Sequence
  Synthetic
cucuaagcgcaucaagc

SEQ ID NO: 4548 - RNA, 17 nt, Artificial Sequence
  Synthetic
gcaaacucccguucucc

SEQ ID NO: 4549 - RNA, 17 nt, Artificial Sequence
  Synthetic
gugguggacuaaacagg

SEQ ID NO: 4550 - RNA, 17 nt, Artificial Sequence
  Synthetic
caccacgagaacagcuc

SEQ ID NO: 4551 - RNA, 17 nt, Artificial Sequence
  Synthetic
ccgccauggauuucucu

SEQ ID NO: 4552 - RNA, 17 nt, Artificial Sequence
  Synthetic
gcuugaugcgcuuagag

SEQ ID NO: 4553 - RNA, 17 nt, Artificial Sequence
  Synthetic
cccugcaugacgucggg

SEQ ID NO: 4554 - RNA, 17 nt, Artificial Sequence
  Synthetic
cuaagcgcaucaagcuc

SEQ ID NO: 4555 - RNA, 17 nt, Artificial Sequence
  Synthetic
caagugaugucucggug

SEQ ID NO: 4556 - RNA, 17 nt, Artificial Sequence
  Synthetic
ccgaggccgacucgccc

SEQ ID NO: 4557 - RNA, 17 nt, Artificial Sequence
  Synthetic
cgaggccgacucgcccg

SEQ ID NO: 4558 - RNA, 17 nt, Artificial Sequence
  Synthetic
auuugaacgucuugccg

SEQ ID NO: 4559 - RNA, 17 nt, Artificial Sequence
  Synthetic
gcugcgucugcccucuu

SEQ ID NO: 4560 - RNA, 17 nt, Artificial Sequence
  Synthetic
aggcggcgcgccaccac

SEQ ID NO: 4561 - RNA, 17 nt, Artificial Sequence
  Synthetic
cucgagcuugaugcgcu

SEQ ID NO: 4562 - RNA, 17 nt, Artificial Sequence
  Synthetic
gcgcaaacucccguucu

SEQ ID NO: 4563 - RNA, 17 nt, Artificial Sequence
  Synthetic
agaggcuuccggccugg

SEQ ID NO: 4564 - RNA, 17 nt, Artificial Sequence
  Synthetic
ccgggcgagucggccuc

SEQ ID NO: 4565 - RNA, 17 nt, Artificial Sequence
  Synthetic
gucgcuggugccggguu

SEQ ID NO: 4566 - RNA, 17 nt, Artificial Sequence
  Synthetic
agagcgccugggggcgg

SEQ ID NO: 4567 - RNA, 17 nt, Artificial Sequence
  Synthetic
ggugguggacuaaacag

SEQ ID NO: 4568 - RNA, 17 nt, Artificial Sequence
  Synthetic
cccgaggccgacucgcc

SEQ ID NO: 4569 - RNA, 17 nt, Artificial Sequence
  Synthetic
uucucuugcaacacgca

SEQ ID NO: 4570 - RNA, 17 nt, Artificial Sequence
  Synthetic
uggacuugaccgggggc

SEQ ID NO: 4571 - RNA, 17 nt, Artificial Sequence
  Synthetic
ucccggagaacggggac

SEQ ID NO: 4572 - RNA, 17 nt, Artificial Sequence
  Synthetic
cuggagucuccgaagcu

SEQ ID NO: 4573 - RNA, 17 nt, Artificial Sequence
  Synthetic
gauuucucuaggagacu

SEQ ID NO: 4574 - RNA, 17 nt, Artificial Sequence
  Synthetic
gguugaauccaauggcu

SEQ ID NO: 4575 - RNA, 17 nt, Artificial Sequence
  Synthetic
cccgggcgagucggccu

SEQ ID NO: 4576 - RNA, 17 nt, Artificial Sequence
  Synthetic
gaucccggagaacgggg

SEQ ID NO: 4577 - RNA, 17 nt, Artificial Sequence
  Synthetic
cucggugguggacuaaa

SEQ ID NO: 4578 - RNA, 17 nt, Artificial Sequence
  Synthetic
ugguggacuaaacaggg

SEQ ID NO: 4579 - RNA, 17 nt, Artificial Sequence
  Synthetic
ccaccaagucgcuggug

SEQ ID NO: 4580 - RNA, 17 nt, Artificial Sequence
  Synthetic
gguggccaaguucaaga

SEQ ID NO: 4581 - RNA, 17 nt, Artificial Sequence
  Synthetic
cacccgagugccuuuga

SEQ ID NO: 4582 - RNA, 17 nt, Artificial Sequence
  Synthetic
gcaagacguucaaauuu

SEQ ID NO: 4583 - RNA, 17 nt, Artificial Sequence
  Synthetic
ggcucucgagcuuccau

SEQ ID NO: 4584 - RNA, 17 nt, Artificial Sequence
  Synthetic
uggagucuccgaagcua

SEQ ID NO: 4585 - RNA, 17 nt, Artificial Sequence
  Synthetic
cggccgcgaugcccaac

SEQ ID NO: 4586 - RNA, 17 nt, Artificial Sequence
  Synthetic
ucaaaggcacucgggug

SEQ ID NO: 4587 - RNA, 17 nt, Artificial Sequence
  Synthetic
ggacuugaccgggggcu

SEQ ID NO: 4588 - RNA, 17 nt, Artificial Sequence
  Synthetic
uuggacuugaccggggg

SEQ ID NO: 4589 - RNA, 17 nt, Artificial Sequence
  Synthetic
gucugcccucuuuugag

SEQ ID NO: 4590 - RNA, 17 nt, Artificial Sequence
  Synthetic
ggcaaaaggcgauuguc

SEQ ID NO: 4591 - RNA, 17 nt, Artificial Sequence
  Synthetic
acacgcacagaacacuc

SEQ ID NO: 4592 - RNA, 17 nt, Artificial Sequence
  Synthetic
guaaccuuugcauaggg

SEQ ID NO: 4593 - RNA, 17 nt, Artificial Sequence
  Synthetic
ugcaccggcgcagccac

SEQ ID NO: 4594 - RNA, 17 nt, Artificial Sequence
  Synthetic
uggccaaguucaagagc

SEQ ID NO: 4595 - RNA, 17 nt, Artificial Sequence
  Synthetic
uaagcgcggccaccugg

SEQ ID NO: 4596 - RNA, 17 nt, Artificial Sequence
  Synthetic
cauagggcugggccggc

SEQ ID NO: 4597 - RNA, 17 nt, Artificial Sequence
  Synthetic
accugaucccggagaac

SEQ ID NO: 4598 - RNA, 17 nt, Artificial Sequence
  Synthetic
uguguggcaguuuucgg

SEQ ID NO: 4599 - RNA, 17 nt, Artificial Sequence
  Synthetic
uuuucggauggaagcuc

SEQ ID NO: 4600 - RNA, 17 nt, Artificial Sequence
  Synthetic
ccccgggcgagucggcc

SEQ ID NO: 4601 - RNA, 17 nt, Artificial Sequence
  Synthetic
uggacuacggcuucggg

SEQ ID NO: 4602 - RNA, 17 nt, Artificial Sequence
  Synthetic
cccuucaggacuaggug

SEQ ID NO: 4603 - RNA, 17 nt, Artificial Sequence
  Synthetic
ucggggcgcagcggcac

SEQ ID NO: 4604 - RNA, 17 nt, Artificial Sequence
  Synthetic
ucuugaacuuggccacc

SEQ ID NO: 4605 - RNA, 17 nt, Artificial Sequence
  Synthetic
ccggcgcagccacacgg

SEQ ID NO: 4606 - RNA, 17 nt, Artificial Sequence
  Synthetic
ucucgcccaggaccugg

SEQ ID NO: 4607 - RNA, 17 nt, Artificial Sequence
  Synthetic
cggagaacggggacgag

SEQ ID NO: 4608 - RNA, 17 nt, Artificial Sequence
  Synthetic
cacccugucaaaggcac

SEQ ID NO: 4609 - RNA, 17 nt, Artificial Sequence
  Synthetic
ucugcaccuaguccuga

SEQ ID NO: 4610 - RNA, 17 nt, Artificial Sequence
  Synthetic
uaaccugcuaagaauac

SEQ ID NO: 4611 - RNA, 17 nt, Artificial Sequence
  Synthetic
ucuccaccgccagcucc

SEQ ID NO: 4612 - RNA, 17 nt, Artificial Sequence
  Synthetic
cuccaccgccagcuccc

SEQ ID NO: 4613 - RNA, 17 nt, Artificial Sequence
  Synthetic
uucucgcccaggaccug

SEQ ID NO: 4614 - RNA, 17 nt, Artificial Sequence
  Synthetic
ccgccuccaggcucagc

SEQ ID NO: 4615 - RNA, 17 nt, Artificial Sequence
  Synthetic
ucccuccguccagcucc

SEQ ID NO: 4616 - RNA, 17 nt, Artificial Sequence
  Synthetic
gaggguggacuacggcu

SEQ ID NO: 4617 - RNA, 17 nt, Artificial Sequence
  Synthetic
ccagcuccccgggcggu

SEQ ID NO: 4618 - RNA, 17 nt, Artificial Sequence
  Synthetic
gcucucuaagucuccua

SEQ ID NO: 4619 - RNA, 17 nt, Artificial Sequence
  Synthetic
caugacuuggacuugac

SEQ ID NO: 4620 - RNA, 17 nt, Artificial Sequence
  Synthetic
ccaugcccugcaugacg

SEQ ID NO: 4621 - RNA, 17 nt, Artificial Sequence
  Synthetic
gcgauugucuggagucu

SEQ ID NO: 4622 - RNA, 17 nt, Artificial Sequence
  Synthetic
uggaggccgcguagccg

SEQ ID NO: 4623 - RNA, 17 nt, Artificial Sequence
  Synthetic
gccaccuggccgaggcc

SEQ ID NO: 4624 - RNA, 17 nt, Artificial Sequence
  Synthetic
auaccaggaucaguauc

SEQ ID NO: 4625 - RNA, 17 nt, Artificial Sequence
  Synthetic
guguggcaguuuucgga

SEQ ID NO: 4626 - RNA, 17 nt, Artificial Sequence
  Synthetic
ccacaccgcccggggag

SEQ ID NO: 4627 - RNA, 17 nt, Artificial Sequence
  Synthetic
ggaggcggcgcgccacc

SEQ ID NO: 4628 - RNA, 17 nt, Artificial Sequence
  Synthetic
guauucuuagcagguua

SEQ ID NO: 4629 - RNA, 17 nt, Artificial Sequence
  Synthetic
agaaggggcucagcgag

SEQ ID NO: 4630 - RNA, 17 nt, Artificial Sequence
  Synthetic
uguucugugcguguugc

SEQ ID NO: 4631 - RNA, 17 nt, Artificial Sequence
  Synthetic
aaccccuuuaaccugcu

SEQ ID NO: 4632 - RNA, 17 nt, Artificial Sequence
  Synthetic
gcgcccuucugccaggc

SEQ ID NO: 4633 - RNA, 17 nt, Artificial Sequence
  Synthetic
cagcuccccgggcggug

SEQ ID NO: 4634 - RNA, 17 nt, Artificial Sequence
  Synthetic
ggcggcuugcuaccugg

SEQ ID NO: 4635 - RNA, 17 nt, Artificial Sequence
  Synthetic
agcgcccuucugccagg

SEQ ID NO: 4636 - RNA, 17 nt, Artificial Sequence
  Synthetic
gcggcuugcuaccuggc

SEQ ID NO: 4637 - RNA, 17 nt, Artificial Sequence
  Synthetic
ggggcgcggucgugggc

SEQ ID NO: 4638 - RNA, 17 nt, Artificial Sequence
  Synthetic
aggccuuccaccagguc

SEQ ID NO: 4639 - RNA, 17 nt, Artificial Sequence
  Synthetic
ucccgugccgcugcgcc

SEQ ID NO: 4640 - RNA, 17 nt, Artificial Sequence
  Synthetic
cagaacacucauggauu

SEQ ID NO: 4641 - RNA, 17 nt, Artificial Sequence
  Synthetic
gcuccccgggcggugug

SEQ ID NO: 4642 - RNA, 17 nt, Artificial Sequence
  Synthetic
gcccggggagcuggacg

SEQ ID NO: 4643 - RNA, 17 nt, Artificial Sequence
  Synthetic
uugcaguaaccuuugca

SEQ ID NO: 4644 - RNA, 17 nt, Artificial Sequence
  Synthetic
agacuuagagagcuggc

SEQ ID NO: 4645 - RNA, 17 nt, Artificial Sequence
  Synthetic
ggcgcagccacacgggc

SEQ ID NO: 4646 - RNA, 17 nt, Artificial Sequence
  Synthetic
uucugcaccuaguccug

SEQ ID NO: 4647 - RNA, 17 nt, Artificial Sequence
  Synthetic
uucugugcguguugcaa

SEQ ID NO: 4648 - RNA, 17 nt, Artificial Sequence
  Synthetic
cccuggccacccaucac

SEQ ID NO: 4649 - RNA, 17 nt, Artificial Sequence
  Synthetic
auagggcugggccggcc

SEQ ID NO: 4650 - RNA, 17 nt, Artificial Sequence
  Synthetic
accaggaucaguaucga

SEQ ID NO: 4651 - RNA, 17 nt, Artificial Sequence
  Synthetic
ugaagggauaccaaccc

SEQ ID NO: 4652 - RNA, 17 nt, Artificial Sequence
  Synthetic
cuagagaaauccauggc

SEQ ID NO: 4653 - RNA, 17 nt, Artificial Sequence
  Synthetic
cgguggagagaccgucg

SEQ ID NO: 4654 - RNA, 17 nt, Artificial Sequence
  Synthetic
uuucucuaggagacuua

SEQ ID NO: 4655 - RNA, 17 nt, Artificial Sequence
  Synthetic
gcaugacuuggacuuga

SEQ ID NO: 4656 - RNA, 17 nt, Artificial Sequence
  Synthetic
cucggggcgcagcggca

SEQ ID NO: 4657 - RNA, 17 nt, Artificial Sequence
  Synthetic
gguggacuaaacagggg

SEQ ID NO: 4658 - RNA, 17 nt, Artificial Sequence
  Synthetic
ccucgcugaagugcugc

SEQ ID NO: 4659 - RNA, 17 nt, Artificial Sequence
  Synthetic
ccagguugcucugaaau

SEQ ID NO: 4660 - RNA, 17 nt, Artificial Sequence
  Synthetic
gcauagagcgccugggg

SEQ ID NO: 4661 - RNA, 17 nt, Artificial Sequence
  Synthetic
gcaagcugaagcgccac

SEQ ID NO: 4662 - RNA, 17 nt, Artificial Sequence
  Synthetic
cucgcugaagugcugca

SEQ ID NO: 4663 - RNA, 17 nt, Artificial Sequence
  Synthetic
gcacccaggccagcaag

SEQ ID NO: 4664 - RNA, 17 nt, Artificial Sequence
  Synthetic
gggaggcuccauagcca

SEQ ID NO: 4665 - RNA, 17 nt, Artificial Sequence
  Synthetic
aggcaaaaggcgauugu

SEQ ID NO: 4666 - RNA, 17 nt, Artificial Sequence
  Synthetic
gaucccuuccuuagcuu

SEQ ID NO: 4667 - RNA, 17 nt, Artificial Sequence
  Synthetic
gucuccgaagcuaagga

SEQ ID NO: 4668 - RNA, 17 nt, Artificial Sequence
  Synthetic
cuuagagaaggggcuca

SEQ ID NO: 4669 - RNA, 17 nt, Artificial Sequence
  Synthetic
cuuuuuggacaggcccc

SEQ ID NO: 4670 - RNA, 17 nt, Artificial Sequence
  Synthetic
cucgggugauggguggc

SEQ ID NO: 4671 - RNA, 17 nt, Artificial Sequence
  Synthetic
gcccacgaccgcgcccc

SEQ ID NO: 4672 - RNA, 17 nt, Artificial Sequence
  Synthetic
uuguacauguguagcug

SEQ ID NO: 4673 - RNA, 17 nt, Artificial Sequence
  Synthetic
ccgugguggccaaguuc

SEQ ID NO: 4674 - RNA, 17 nt, Artificial Sequence
  Synthetic
ggagaacggggacgagg

SEQ ID NO: 4675 - RNA, 17 nt, Artificial Sequence
  Synthetic
gcaggcccagcucaaaa

SEQ ID NO: 4676 - RNA, 17 nt, Artificial Sequence
  Synthetic
uauucuuagcagguuaa

SEQ ID NO: 4677 - RNA, 17 nt, Artificial Sequence
  Synthetic
ucugcaauaugaauccc

SEQ ID NO: 4678 - RNA, 17 nt, Artificial Sequence
  Synthetic
uccuagagaaauccaug

SEQ ID NO: 4679 - RNA, 17 nt, Artificial Sequence
  Synthetic
acuugaccgggggcugg

SEQ ID NO: 4680 - RNA, 17 nt, Artificial Sequence
  Synthetic
agucuccgaagcuaagg

SEQ ID NO: 4681 - RNA, 17 nt, Artificial Sequence
  Synthetic
gcugggccugcccgggc

SEQ ID NO: 4682 - RNA, 17 nt, Artificial Sequence
  Synthetic
agaucccuuccuuagcu

SEQ ID NO: 4683 - RNA, 17 nt, Artificial Sequence
  Synthetic
cacacaucuugagcucu

SEQ ID NO: 4684 - RNA, 17 nt, Artificial Sequence
  Synthetic
cccggggagcuggacgg

SEQ ID NO: 4685 - RNA, 17 nt, Artificial Sequence
  Synthetic
gaaggggcucagcgagc

SEQ ID NO: 4686 - RNA, 17 nt, Artificial Sequence
  Synthetic
gacuuagagagcuggca

SEQ ID NO: 4687 - RNA, 17 nt, Artificial Sequence
  Synthetic
ucccauggagagguggc

SEQ ID NO: 4688 - RNA, 17 nt, Artificial Sequence
  Synthetic
ugaagugcugcauggag

SEQ ID NO: 4689 - RNA, 17 nt, Artificial Sequence
  Synthetic
acauucugcaccuaguc

SEQ ID NO: 4690 - RNA, 17 nt, Artificial Sequence
  Synthetic
cccauggagagguggcu

SEQ ID NO: 4691 - RNA, 17 nt, Artificial Sequence
  Synthetic
gcucucuggguacuacg

SEQ ID NO: 4692 - RNA, 17 nt, Artificial Sequence
  Synthetic
ccacagggacacuugcg

SEQ ID NO: 4693 - RNA, 17 nt, Artificial Sequence
  Synthetic
gagacuuagagagcugg

SEQ ID NO: 4694 - RNA, 17 nt, Artificial Sequence
  Synthetic
uugacagggugcugcgg

SEQ ID NO: 4695 - RNA, 17 nt, Artificial Sequence
  Synthetic
ccgaggccgagggccac

SEQ ID NO: 4696 - RNA, 17 nt, Artificial Sequence
  Synthetic
agggaucuuugagcugc

SEQ ID NO: 4697 - RNA, 17 nt, Artificial Sequence
  Synthetic
aaguagauucuuaaucc

SEQ ID NO: 4698 - RNA, 17 nt, Artificial Sequence
  Synthetic
gcgcagcggcacgggaa

SEQ ID NO: 4699 - RNA, 17 nt, Artificial Sequence
  Synthetic
gccgaggccgagggcca

SEQ ID NO: 4700 - RNA, 17 nt, Artificial Sequence
  Synthetic
aagauguguggcaguuu

SEQ ID NO: 4701 - RNA, 17 nt, Artificial Sequence
  Synthetic
agcuaaggaagggaucu

SEQ ID NO: 4702 - RNA, 17 nt, Artificial Sequence
  Synthetic
cagcucucuaagucucc

SEQ ID NO: 4703 - RNA, 17 nt, Artificial Sequence
  Synthetic
ccuagagaaauccaugg

SEQ ID NO: 4704 - RNA, 17 nt, Artificial Sequence
  Synthetic
accacgagaacagcucg

SEQ ID NO: 4705 - RNA, 17 nt, Artificial Sequence
  Synthetic
gcaauaugaaucccaug

SEQ ID NO: 4706 - RNA, 17 nt, Artificial Sequence
  Synthetic
cuccaugcagcacuuca

SEQ ID NO: 4707 - RNA, 17 nt, Artificial Sequence
  Synthetic
uguccaaaaagcugcug

SEQ ID NO: 4708 - RNA, 17 nt, Artificial Sequence
  Synthetic
gaauaccaggaucagua

SEQ ID NO: 4709 - RNA, 17 nt, Artificial Sequence
  Synthetic
ucucggggcgcagcggc

SEQ ID NO: 4710 - RNA, 17 nt, Artificial Sequence
  Synthetic
aguuuucggauggaagc

SEQ ID NO: 4711 - RNA, 17 nt, Artificial Sequence
  Synthetic
ucgugggcgugggcgac

SEQ ID NO: 4712 - RNA, 17 nt, Artificial Sequence
  Synthetic
ucgcggccgggggcagg

SEQ ID NO: 4713 - RNA, 17 nt, Artificial Sequence
  Synthetic
cuacuuagaaagcgaac

SEQ ID NO: 4714 - RNA, 17 nt, Artificial Sequence
  Synthetic
ggguuauugucugcaau

SEQ ID NO: 4715 - RNA, 17 nt, Artificial Sequence
  Synthetic
cuugaccgggggcuggg

SEQ ID NO: 4716 - RNA, 17 nt, Artificial Sequence
  Synthetic
uggauuaagaaucuacu

SEQ ID NO: 4717 - RNA, 17 nt, Artificial Sequence
  Synthetic
ggcuuccggccuggcag

SEQ ID NO: 4718 - RNA, 17 nt, Artificial Sequence
  Synthetic
cuuccaccagguccugg

SEQ ID NO: 4719 - RNA, 17 nt, Artificial Sequence
  Synthetic
cgcuucagcuugcuggc

SEQ ID NO: 4720 - RNA, 17 nt, Artificial Sequence
  Synthetic
cauagagcgccuggggg

SEQ ID NO: 4721 - RNA, 17 nt, Artificial Sequence
  Synthetic
ccugguggaaggccucg

SEQ ID NO: 4722 - RNA, 17 nt, Artificial Sequence
  Synthetic
uccaccagguccugggc

SEQ ID NO: 4723 - RNA, 17 nt, Artificial Sequence
  Synthetic
cugcaauaugaauccca

SEQ ID NO: 4724 - RNA, 17 nt, Artificial Sequence
  Synthetic
gcuggacggagggaucu

SEQ ID NO: 4725 - RNA, 17 nt, Artificial Sequence
  Synthetic
uugaccgggggcuggga

SEQ ID NO: 4726 - RNA, 17 nt, Artificial Sequence
  Synthetic
uucccagccaccucucc

SEQ ID NO: 4727 - RNA, 17 nt, Artificial Sequence
  Synthetic
uuuugagcugggccugc

SEQ ID NO: 4728 - RNA, 17 nt, Artificial Sequence
  Synthetic
gcuucuccacaccgccc

SEQ ID NO: 4729 - RNA, 17 nt, Artificial Sequence
  Synthetic
agagaaaccaugcacug

SEQ ID NO: 4730 - RNA, 17 nt, Artificial Sequence
  Synthetic
agcuggacggagggauc

SEQ ID NO: 4731 - RNA, 17 nt, Artificial Sequence
  Synthetic
ccggggagcuggcggug

SEQ ID NO: 4732 - RNA, 17 nt, Artificial Sequence
  Synthetic
aucccauggagaggugg

SEQ ID NO: 4733 - RNA, 17 nt, Artificial Sequence
  Synthetic
guuccggggagcuggcg

SEQ ID NO: 4734 - RNA, 17 nt, Artificial Sequence
  Synthetic
gacuaaacaggggggga

SEQ ID NO: 4735 - RNA, 17 nt, Artificial Sequence
  Synthetic
ugcccagcagcagcuuu

SEQ ID NO: 4736 - RNA, 17 nt, Artificial Sequence
  Synthetic
gggaucuuugagcugcc

SEQ ID NO: 4737 - RNA, 17 nt, Artificial Sequence
  Synthetic
ucccagccaccucucca

SEQ ID NO: 4738 - RNA, 17 nt, Artificial Sequence
  Synthetic
cagcggcacgggaagug

SEQ ID NO: 4739 - RNA, 17 nt, Artificial Sequence
  Synthetic
uuccggggagcuggcgg

SEQ ID NO: 4740 - RNA, 17 nt, Artificial Sequence
  Synthetic
uccucguccccguucuc

SEQ ID NO: 4741 - RNA, 17 nt, Artificial Sequence
  Synthetic
gcggcacgggaagugga

SEQ ID NO: 4742 - RNA, 17 nt, Artificial Sequence
  Synthetic
ugggcagccccagcucg

SEQ ID NO: 4743 - RNA, 17 nt, Artificial Sequence
  Synthetic
cgcagcggcacgggaag

SEQ ID NO: 4744 - RNA, 17 nt, Artificial Sequence
  Synthetic
ccgcccggggagcugga

SEQ ID NO: 4745 - RNA, 17 nt, Artificial Sequence
  Synthetic
auggagagguggcuggg

SEQ ID NO: 4746 - RNA, 17 nt, Artificial Sequence
  Synthetic
cuccucguccccguucu

SEQ ID NO: 4747 - RNA, 17 nt, Artificial Sequence
  Synthetic
uacuuagaaagcgaaca

SEQ ID NO: 4748 - RNA, 17 nt, Artificial Sequence
  Synthetic
gggcaggcccagcucaa

SEQ ID NO: 4749 - RNA, 17 nt, Artificial Sequence
  Synthetic
accgcccggggagcugg

SEQ ID NO: 4750 - RNA, 17 nt, Artificial Sequence
  Synthetic
aaacagggggggagugg

SEQ ID NO: 4751 - RNA, 17 nt, Artificial Sequence
  Synthetic
cgggggcugggagggag

SEQ ID NO: 4752 - RNA, 17 nt, Artificial Sequence
  Synthetic
ccggccuggggacagcg

SEQ ID NO: 4753 - RNA, 17 nt, Artificial Sequence
  Synthetic
uagggcugggccggccu

SEQ ID NO: 4754 - RNA, 17 nt, Artificial Sequence
  Synthetic
aagaaucuacuuagaaa

SEQ ID NO: 4755 - RNA, 17 nt, Artificial Sequence
  Synthetic
aacagggggggaguggg

SEQ ID NO: 4756 - RNA, 17 nt, Artificial Sequence
  Synthetic
accgggggcugggaggg

SEQ ID NO: 4757 - RNA, 17 nt, Artificial Sequence
  Synthetic
ggucgugggcgugggcg

SEQ ID NO: 4758 - RNA, 17 nt, Artificial Sequence
  Synthetic
ggagggggggcgucgcc

SEQ ID NO: 4759 - RNA, 17 nt, Artificial Sequence
  Synthetic
gaacggggacgaggagg

SEQ ID NO: 4760 - RNA, 17 nt, Artificial Sequence
  Synthetic
gaccgggggcugggagg

SEQ ID NO: 4761 - RNA, 17 nt, Artificial Sequence
  Synthetic
gggagggggggcgucgc

SEQ ID NO: 4762 - RNA, 17 nt, Artificial Sequence
  Synthetic
gggggcugggagggagg

SEQ ID NO: 4763 - RNA, 17 nt, Artificial Sequence
  Synthetic
agcggcacgggaagugg

SEQ ID NO: 4764 - RNA, 17 nt, Artificial Sequence
  Synthetic
gauugcagaggagggag

SEQ ID NO: 4765 - RNA, 17 nt, Artificial Sequence
  Synthetic
gggggggcgucgccagg

SEQ ID NO: 4766 - RNA, 17 nt, Artificial Sequence
  Synthetic
ggauugcagaggaggga

SEQ ID NO: 4767 - RNA, 17 nt, Artificial Sequence
  Synthetic
gggcggauugcagagga

SEQ ID NO: 4768 - RNA, 17 nt, Artificial Sequence
  Synthetic
gcggauugcagaggagg

SEQ ID NO: 4769 - RNA, 17 nt, Artificial Sequence
  Synthetic
gagcugacggagagcga

SEQ ID NO: 4770 - RNA, 17 nt, Artificial Sequence
  Synthetic
gaaaacugccacacauc

SEQ ID NO: 4771 - RNA, 17 nt, Artificial Sequence
  Synthetic
auugcagaggagggagg

SEQ ID NO: 4772 - RNA, 17 nt, Artificial Sequence
  Synthetic
ggggcggauugcagagg

SEQ ID NO: 4773 - RNA, 17 nt, Artificial Sequence
  Synthetic
cggauugcagaggaggg

SEQ ID NO: 4774 - RNA, 17 nt, Artificial Sequence
  Synthetic
aggggcggauugcagag

SEQ ID NO: 4775 - RNA, 17 nt, Artificial Sequence
  Synthetic
acggggacgaggaggaa

SEQ ID NO: 4776 - RNA, 17 nt, Artificial Sequence
  Synthetic
ggaggaggggcggauug

SEQ ID NO: 4777 - RNA, 17 nt, Artificial Sequence
  Synthetic
cgcuucuccacaccgcc

SEQ ID NO: 4778 - RNA, 17 nt, Artificial Sequence
  Synthetic
ugacggagagcgagagg

SEQ ID NO: 4779 - RNA, 17 nt, Artificial Sequence
  Synthetic
aggagcugacggagagc

SEQ ID NO: 4780 - RNA, 17 nt, Artificial Sequence
  Synthetic
gcugggagggaggaggg

SEQ ID NO: 4781 - RNA, 17 nt, Artificial Sequence
  Synthetic
aggaggggcggauugca

SEQ ID NO: 4782 - RNA, 17 nt, Artificial Sequence
  Synthetic
uguugggcaucgcggcc

SEQ ID NO: 4783 - RNA, 17 nt, Artificial Sequence
  Synthetic
cggggacgaggaggaag

SEQ ID NO: 4784 - RNA, 17 nt, Artificial Sequence
  Synthetic
ggaggggcggauugcag

SEQ ID NO: 4785 - RNA, 17 nt, Artificial Sequence
  Synthetic
ggaggagcugacggaga

SEQ ID NO: 4786 - RNA, 17 nt, Artificial Sequence
  Synthetic
gggacgaggaggaagag

SEQ ID NO: 4787 - RNA, 17 nt, Artificial Sequence
  Synthetic
aggaggaggagcugacg

SEQ ID NO: 4788 - RNA, 17 nt, Artificial Sequence
  Synthetic
acgaggaagaggaagaa

SEQ ID NO: 4789 - RNA, 17 nt, Artificial Sequence
  Synthetic
aggaagaggaagaagag

SEQ ID NO: 4790 - RNA, 17 nt, Artificial Sequence
  Synthetic
aggaagaggaggacgac

SEQ ID NO: 4791 - RNA, 17 nt, Artificial Sequence
  Synthetic
aggaggacgacgaggaa

SEQ ID NO: 4792 - RNA, 17 nt, Artificial Sequence
  Synthetic
ggaggaggaggagcuga

SEQ ID NO: 4793 - RNA, 17 nt, Artificial Sequence
  Synthetic
ggaagaggaggacgacg

SEQ ID NO: 4794 - RNA, 17 nt, Artificial Sequence
  Synthetic
ggaggaagaggaggacg

SEQ ID NO: 4795 - RNA, 17 nt, Artificial Sequence
  Synthetic
ggaagaggaagaagagg

SEQ ID NO: 4796 - RNA, 17 nt, Artificial Sequence
  Synthetic
aggaggaggaggagcug

SEQ ID NO: 4797 - RNA, 17 nt, Artificial Sequence
  Synthetic
cgaggaagaggaagaag

SEQ ID NO: 4798 - RNA, 17 nt, Artificial Sequence
  Synthetic
ggacgacgaggaagagg

SEQ ID NO: 4799 - RNA, 17 nt, Artificial Sequence
  Synthetic
ggaggacgacgaggaag

SEQ ID NO: 4800 - RNA, 17 nt, Artificial Sequence
  Synthetic
cgacgaggaagaggaag

SEQ ID NO: 4801 - RNA, 17 nt, Artificial Sequence
  Synthetic
agaggaggacgacgagg

SEQ ID NO: 4802 - RNA, 17 nt, Artificial Sequence
  Synthetic
aagaagaggaggaagag

SEQ ID NO: 4803 - RNA, 17 nt, Artificial Sequence
  Synthetic
aggaagaagaggaggaa

SEQ ID NO: 4804 - RNA, 17 nt, Artificial Sequence
  Synthetic
agaggaagaagaggagg

SEQ ID NO: 4805 - RNA, 17 nt, Artificial Sequence
  Synthetic
aagaggaggaagaggag

SEQ ID NO: 4806 - RNA, 17 nt, Artificial Sequence
  Synthetic
aggaggaagaggaggag

SEQ ID NO: 4807 - RNA, 17 nt, Artificial Sequence
  Synthetic
ggaagaagaggaggaag

SEQ ID NO: 4808 - RNA, 17 nt, Artificial Sequence
  Synthetic
agaagaggaggaagagg

SEQ ID NO: 4809 - RNA, 17 nt, Artificial Sequence
  Synthetic
agaggaggaagaggagg

SEQ ID NO: 4810 - RNA, 17 nt, Artificial Sequence
  Synthetic
ggaggaagaggaggagg

SEQ ID NO: 4811 - RNA, 20 nt, Artificial Sequence
  Synthetic
uucugcacucaucccaggcg

SEQ ID NO: 4812 - RNA, 20 nt, Artificial Sequence
  Synthetic
auccaggucacgccagagga

SEQ ID NO: 4813 - RNA, 20 nt, Artificial Sequence
  Synthetic
ugaccuggaugccaaccucc

SEQ ID NO: 4814 - RNA, 20 nt, Artificial Sequence
  Synthetic
gggauuggaugcuuuuuuca

SEQ ID NO: 4815 - RNA, 17 nt, Artificial Sequence
  Synthetic
ugcacucaucccaggcg

SEQ ID NO: 4816 - RNA, 17 nt, Artificial Sequence
  Synthetic
caggucacgccagagga

SEQ ID NO: 4817 - RNA, 17 nt, Artificial Sequence
  Synthetic
ccuggaugccaaccucc

SEQ ID NO: 4818 - RNA, 17 nt, Artificial Sequence
  Synthetic
auuggaugcuuuuuuca

SEQ ID NO: 4819 - RNA, 17 nt, Artificial Sequence
  Synthetic
gcuauggagccucccgc

SEQ ID NO: 4820 - RNA, 17 nt, Artificial Sequence
  Synthetic
gacuugaccgucauggg

SEQ ID NO: 4821 - RNA, 17 nt, Artificial Sequence
  Synthetic
uccgacgaggaggcaaa

SEQ ID NO: 4822 - RNA, 17 nt, Artificial Sequence
  Synthetic
cgggaggcuccauagcc

SEQ ID NO: 4823 - RNA, 17 nt, Artificial Sequence
  Synthetic
uccguguucgcuuucua

SEQ ID NO: 4824 - RNA, 17 nt, Artificial Sequence
  Synthetic
aacacgcacagaacacu

SEQ ID NO: 4825 - RNA, 17 nt, Artificial Sequence
  Synthetic
uucccagccaccucucc

SEQ ID NO: 4826 - RNA, 17 nt, Artificial Sequence
  Synthetic
ggcugggagggaggagg

SEQ ID NO: 4827 - RNA, 20 nt, Artificial Sequence
  Synthetic
ucggacuugaccgucauggg

SEQ ID NO: 4828 - RNA, 20 nt, Artificial Sequence
  Synthetic
auggcuauggagccucccgc

SEQ ID NO: 4829 - RNA, 20 nt, Artificial Sequence
  Synthetic
ugcuccgacgaggaggcaaa

SEQ ID NO: 4830 - RNA, 20 nt, Artificial Sequence
  Synthetic
uggcgggaggcuccauagcc

SEQ ID NO: 4831 - RNA, 20 nt, Artificial Sequence
  Synthetic
ugcaacacgcacagaacacu

SEQ ID NO: 4832 - RNA, 20 nt, Artificial Sequence
  Synthetic
acuuccguguucgcuuucua

SEQ ID NO: 4833 - RNA, 20 nt, Artificial Sequence
  Synthetic
uccuucccagccaccucucc

SEQ ID NO: 4834 - RNA, 20 nt, Artificial Sequence
  Synthetic
gggggcugggagggaggagg

SEQ ID NO: 4835 - RNA, 20 nt, Artificial Sequence
  Synthetic
gaaaauacuuacuguacugc

SEQ ID NO: 4836 - RNA, 17 nt, Artificial Sequence
  Synthetic
gaaagcaguguaaggcu

SEQ ID NO: 4837 - RNA, 20 nt, Artificial Sequence
  Synthetic
ggcuguuuuggaauguagag

SEQ ID NO: 4838 - RNA, 20 nt, Artificial Sequence
  Synthetic
gugcuacuuauacaauucac

SEQ ID NO: 4839 - RNA, 20 nt, Artificial Sequence
  Synthetic
aaacuauuuacagccauaac

SEQ ID NO: 4840 - RNA, 20 nt, Artificial Sequence
  Synthetic
aaauacuuacuguacugcag

SEQ ID NO: 4841 - RNA, 20 nt, Artificial Sequence
  Synthetic
aacuauuuacagccauaaca

SEQ ID NO: 4842 - RNA, 17 nt, Artificial Sequence
  Synthetic
aauacuuacuguacugc

SEQ ID NO: 4843 - RNA, 17 nt, Artificial Sequence
  Synthetic
acaacuuguguugcacu

SEQ ID NO: 4844 - RNA, 17 nt, Artificial Sequence
  Synthetic
auacuuacuguacugca

SEQ ID NO: 4845 - RNA, 20 nt, Artificial Sequence
  Synthetic
auucacuggaaacccuguua

SEQ ID NO: 4846 - RNA, 17 nt, Artificial Sequence
  Synthetic
auuuaagacgggaaaac

SEQ ID NO: 4847 - RNA, 17 nt, Artificial Sequence
  Synthetic
cacuggaaacccuguua

SEQ ID NO: 4848 - RNA, 17 nt, Artificial Sequence
  Synthetic
cuacuuauacaauucac

SEQ ID NO: 4849 - RNA, 17 nt, Artificial Sequence
  Synthetic
cuauuuacagccauaac

SEQ ID NO: 4850 - RNA, 20 nt, Artificial Sequence
  Synthetic
uaagaaagcaguguaaggcu

SEQ ID NO: 4851 - RNA, 20 nt, Artificial Sequence
  Synthetic
uacacaacuuguguugcacu

SEQ ID NO: 4852 - RNA, 20 nt, Artificial Sequence
  Synthetic
uacuguacugcaggggaauu

SEQ ID NO: 4853 - RNA, 17 nt, Artificial Sequence
  Synthetic
uacuuacuguacugcag

SEQ ID NO: 4854 - RNA, 17 nt, Artificial Sequence
  Synthetic
uguacugcaggggaauu

SEQ ID NO: 4855 - RNA, 17 nt, Artificial Sequence
  Synthetic
gaauguagagaggcaga

SEQ ID NO: 4856 - RNA, 17 nt, Artificial Sequence
  Synthetic
ggaauguagagaggcag

SEQ ID NO: 4857 - RNA, 20 nt, Artificial Sequence
  Synthetic
guaaguauuuucuuucauug

SEQ ID NO: 4858 - RNA, 20 nt, Artificial Sequence
  Synthetic
guaauuaagaaagcagugua

SEQ ID NO: 4859 - RNA, 17 nt, Artificial Sequence
  Synthetic
guauuuucuuucauugg

SEQ ID NO: 4860 - RNA, 17 nt, Artificial Sequence
  Synthetic
aaaauaauuagaauaaa

SEQ ID NO: 4861 - RNA, 20 nt, Artificial Sequence
  Synthetic
aaaauacuuacuguacugca

SEQ ID NO: 4862 - RNA, 20 nt, Artificial Sequence
  Synthetic
aaaauuuaagacgggaaaac

SEQ ID NO: 4863 - RNA, 17 nt, Artificial Sequence
  Synthetic
aaguauuuucuuucauu

SEQ ID NO: 4864 - RNA, 17 nt, Artificial Sequence
  Synthetic
aauguagagaggcagag

SEQ ID NO: 4865 - RNA, 17 nt, Artificial Sequence
  Synthetic
acauaaaaauuuaagac

SEQ ID NO: 4866 - RNA, 17 nt, Artificial Sequence
  Synthetic
agaaagcaguguaaggc

SEQ ID NO: 4867 - RNA, 17 nt, Artificial Sequence
  Synthetic
agaauaaaaggcuguuu

SEQ ID NO: 4868 - RNA, 20 nt, Artificial Sequence
  Synthetic
aguaaaauaauuagaauaaa

SEQ ID NO: 4869 - RNA, 20 nt, Artificial Sequence
  Synthetic
aguaaguauuuucuuucauu

SEQ ID NO: 4870 - RNA, 17 nt, Artificial Sequence
  Synthetic
aguauuuucuuucauug

SEQ ID NO: 4871 - RNA, 17 nt, Artificial Sequence
  Synthetic
auuaagaaagcagugua

SEQ ID NO: 4872 - RNA, 20 nt, Artificial Sequence
  Synthetic
auuagaauaaaaggcuguuu

SEQ ID NO: 4873 - RNA, 20 nt, Artificial Sequence
  Synthetic
auuauuuuacuagugaauua

SEQ ID NO: 4874 - RNA, 17 nt, Artificial Sequence
  Synthetic
auuuuacuagugaauua

SEQ ID NO: 4875 - RNA, 17 nt, Artificial Sequence
  Synthetic
cacauaaaaauuuaaga

SEQ ID NO: 4876 - RNA, 20 nt, Artificial Sequence
  Synthetic
caguaaguauuuucuuucau

SEQ ID NO: 4877 - RNA, 20 nt, Artificial Sequence
  Synthetic
cucacauaaaaauuuaagac

SEQ ID NO: 4878 - RNA, 17 nt, Artificial Sequence
  Synthetic
uaaguauuuucuuucau

SEQ ID NO: 4879 - RNA, 20 nt, Artificial Sequence
  Synthetic
uaaguauuuucuuucauugg

SEQ ID NO: 4880 - RNA, 17 nt, Artificial Sequence
  Synthetic
uauuuacagccauaaca

SEQ ID NO: 4881 - RNA, 20 nt, Artificial Sequence
  Synthetic
ucucacauaaaaauuuaaga

SEQ ID NO: 4882 - RNA, 20 nt, Artificial Sequence
  Synthetic
uggaauguagagaggcagag

SEQ ID NO: 4883 - RNA, 17 nt, Artificial Sequence
  Synthetic
uguuuuggaauguagag

SEQ ID NO: 4884 - RNA, 20 nt, Artificial Sequence
  Synthetic
uuaagaaagcaguguaaggc

SEQ ID NO: 4885 - RNA, 20 nt, Artificial Sequence
  Synthetic
uuggaauguagagaggcaga

SEQ ID NO: 4886 - RNA, 20 nt, Artificial Sequence
  Synthetic
uuuggaauguagagaggcag

SEQ ID NO: 4887 - RNA, 20 nt, Artificial Sequence
  Synthetic
gaggggcugauauaacuucu

SEQ ID NO: 4888 - RNA, 17 nt, Artificial Sequence
  Synthetic
gcuacuuauacaauuca

SEQ ID NO: 4889 - RNA, 17 nt, Artificial Sequence
  Synthetic
gggcugauauaacuucu

SEQ ID NO: 4890 - RNA, 20 nt, Artificial Sequence
  Synthetic
gucuuaaauuuuuaugugag

SEQ ID NO: 4891 - RNA, 20 nt, Artificial Sequence
  Synthetic
gugcuacuuauacaauucac

SEQ ID NO: 4892 - RNA, 17 nt, Artificial Sequence
  Synthetic
aacacaaguuguguaga

SEQ ID NO: 4893 - RNA, 17 nt, Artificial Sequence
  Synthetic
acuauuuacagccauaa

SEQ ID NO: 4894 - RNA, 17 nt, Artificial Sequence
  Synthetic
agcacacugcuguaauu

SEQ ID NO: 4895 - RNA, 20 nt, Artificial Sequence
  Synthetic
agugcuacuuauacaauuca

SEQ ID NO: 4896 - RNA, 17 nt, Artificial Sequence
  Synthetic
auaguuugcuuccccca

SEQ ID NO: 4897 - RNA, 20 nt, Artificial Sequence
  Synthetic
augagcacacugcuguaauu

SEQ ID NO: 4898 - RNA, 20 nt, Artificial Sequence
  Synthetic
caaacuauuuacagccauaa

SEQ ID NO: 4899 - RNA, 20 nt, Artificial Sequence
  Synthetic
cagccauaacaggguuucca

SEQ ID NO: 4900 - RNA, 17 nt, Artificial Sequence
  Synthetic
ccauaacaggguuucca

SEQ ID NO: 4901 - RNA, 17 nt, Artificial Sequence
  Synthetic
cuacuuauacaauucac

SEQ ID NO: 4902 - RNA, 20 nt, Artificial Sequence
  Synthetic
cuuuggcuauugauacugau

SEQ ID NO: 4903 - RNA, 20 nt, Artificial Sequence
  Synthetic
uaaauaguuugcuuccccca

SEQ ID NO: 4904 - RNA, 20 nt, Artificial Sequence
  Synthetic
uaguuugcuucccccaauga

SEQ ID NO: 4905 - RNA, 20 nt, Artificial Sequence
  Synthetic
ugcaacacaaguuguguaga

SEQ ID NO: 4906 - RNA, 17 nt, Artificial Sequence
  Synthetic
uggaauguagagaggca

SEQ ID NO: 4907 - RNA, 17 nt, Artificial Sequence
  Synthetic
uggcuauugauacugau

SEQ ID NO: 4908 - RNA, 17 nt, Artificial Sequence
  Synthetic
uuugcuucccccaauga

SEQ ID NO: 4909 - RNA, 20 nt, Artificial Sequence
  Synthetic
uuuuggaauguagagaggca

SEQ ID NO: 4910 - RNA, 20 nt, Artificial Sequence
  Synthetic
gaaaauacuuacuguacugc

SEQ ID NO: 4911 - RNA, 17 nt, Artificial Sequence
  Synthetic
gaauuguauaaguagca

SEQ ID NO: 4912 - RNA, 20 nt, Artificial Sequence
  Synthetic
gaguucugugucagcaaaaa

SEQ ID NO: 4913 - RNA, 20 nt, Artificial Sequence
  Synthetic
ggaaaacaggaagaugcauu

SEQ ID NO: 4914 - RNA, 17 nt, Artificial Sequence
  Synthetic
ggaauguagagaggcag

SEQ ID NO: 4915 - RNA, 17 nt, Artificial Sequence
  Synthetic
ggcuguuuuggaaugua

SEQ ID NO: 4916 - RNA, 17 nt, Artificial Sequence
  Synthetic
guaaguauuuucuuuca

SEQ ID NO: 4917 - RNA, 20 nt, Artificial Sequence
  Synthetic
guaaguauuuucuuucauug

SEQ ID NO: 4918 - RNA, 17 nt, Artificial Sequence
  Synthetic
guauuuucuuucauugg

SEQ ID NO: 4919 - RNA, 20 nt, Artificial Sequence
  Synthetic
aaaaauuuaagacgggaaaa

SEQ ID NO: 4920 - RNA, 20 nt, Artificial Sequence
  Synthetic
aaaacaggaagaugcauucu

SEQ ID NO: 4921 - RNA, 17 nt, Artificial Sequence
  Synthetic
aaaacuagaaaguuuua

SEQ ID NO: 4922 - RNA, 20 nt, Artificial Sequence
  Synthetic
aaaauacuuacuguacugca

SEQ ID NO: 4923 - RNA, 20 nt, Artificial Sequence
  Synthetic
aaaauuuaagacgggaaaac

SEQ ID NO: 4924 - RNA, 17 nt, Artificial Sequence
  Synthetic
aaacaggaagaugcauu

SEQ ID NO: 4925 - RNA, 20 nt, Artificial Sequence
  Synthetic
aaaggcuguuuuggaaugua

SEQ ID NO: 4926 - RNA, 17 nt, Artificial Sequence
  Synthetic
aaauacuuacuguacug

SEQ ID NO: 4927 - RNA, 20 nt, Artificial Sequence
  Synthetic
aaauacuuacuguacugcag

SEQ ID NO: 4928 - RNA, 17 nt, Artificial Sequence
  Synthetic
aagaaagcaguguaagg

SEQ ID NO: 4929 - RNA, 17 nt, Artificial Sequence
  Synthetic
aaggcuguuuuggaaug

SEQ ID NO: 4930 - RNA, 17 nt, Artificial Sequence
  Synthetic
aaguauuuucuuucauu

SEQ ID NO: 4931 - RNA, 17 nt, Artificial Sequence
  Synthetic
aauacuuacuguacugc

SEQ ID NO: 4932 - RNA, 20 nt, Artificial Sequence
  Synthetic
aauuagaauaaaaggcuguu

SEQ ID NO: 4933 - RNA, 20 nt, Artificial Sequence
  Synthetic
aauuauuuuacuagugaauu

SEQ ID NO: 4934 - RNA, 17 nt, Artificial Sequence
  Synthetic
aauuuaagacgggaaaa

SEQ ID NO: 4935 - RNA, 17 nt, Artificial Sequence
  Synthetic
acaggaagaugcauucu

SEQ ID NO: 4936 - RNA, 20 nt, Artificial Sequence
  Synthetic
acaguaaguauuuucuuuca

SEQ ID NO: 4937 - RNA, 17 nt, Artificial Sequence
  Synthetic
acauaaaaauuuaagac

SEQ ID NO: 4938 - RNA, 20 nt, Artificial Sequence
  Synthetic
acuuucuaguuuugcuuaac

SEQ ID NO: 4939 - RNA, 20 nt, Artificial Sequence
  Synthetic
agaaaauacuuacuguacug

SEQ ID NO: 4940 - RNA, 17 nt, Artificial Sequence
  Synthetic
agaauaaaaggcuguuu

SEQ ID NO: 4941 - RNA, 20 nt, Artificial Sequence
  Synthetic
agcaaaacuagaaaguuuua

SEQ ID NO: 4942 - RNA, 20 nt, Artificial Sequence
  Synthetic
aguaaguauuuucuuucauu

SEQ ID NO: 4943 - RNA, 17 nt, Artificial Sequence
  Synthetic
aguauuuucuuucauug

SEQ ID NO: 4944 - RNA, 20 nt, Artificial Sequence
  Synthetic
agugaauuguauaaguagca

SEQ ID NO: 4945 - RNA, 17 nt, Artificial Sequence
  Synthetic
auacuuacuguacugca

SEQ ID NO: 4946 - RNA, 20 nt, Artificial Sequence
  Synthetic
aucucacauaaaaauuuaag

SEQ ID NO: 4947 - RNA, 20 nt, Artificial Sequence
  Synthetic
auuaagaaagcaguguaagg

SEQ ID NO: 4948 - RNA, 20 nt, Artificial Sequence
  Synthetic
auuagaauaaaaggcuguuu

SEQ ID NO: 4949 - RNA, 20 nt, Artificial Sequence
  Synthetic
auuauuuuacuagugaauua

SEQ ID NO: 4950 - RNA, 17 nt, Artificial Sequence
  Synthetic
auuuaagacgggaaaac

SEQ ID NO: 4951 - RNA, 17 nt, Artificial Sequence
  Synthetic
auuuuacuagugaauua

SEQ ID NO: 4952 - RNA, 20 nt, Artificial Sequence
  Synthetic
auuuucauguuaagcaaaac

SEQ ID NO: 4953 - RNA, 17 nt, Artificial Sequence
  Synthetic
cacauaaaaauuuaaga

SEQ ID NO: 4954 - RNA, 20 nt, Artificial Sequence
  Synthetic
caguaaguauuuucuuucau

SEQ ID NO: 4955 - RNA, 17 nt, Artificial Sequence
  Synthetic
ccgucuuaaauuuuuau

SEQ ID NO: 4956 - RNA, 20 nt, Artificial Sequence
  Synthetic
cucacauaaaaauuuaagac

SEQ ID NO: 4957 - RNA, 20 nt, Artificial Sequence
  Synthetic
uaaaaggcuguuuuggaaug

SEQ ID NO: 4958 - RNA, 17 nt, Artificial Sequence
  Synthetic
uaaguauuuucuuucau

SEQ ID NO: 4959 - RNA, 20 nt, Artificial Sequence
  Synthetic
uaaguauuuucuuucauugg

SEQ ID NO: 4960 - RNA, 20 nt, Artificial Sequence
  Synthetic
uaauucacuaguaaaauaau

SEQ ID NO: 4961 - RNA, 17 nt, Artificial Sequence
  Synthetic
uacuuacuguacugcag

SEQ ID NO: 4962 - RNA, 17 nt, Artificial Sequence
  Synthetic
uagaauaaaaggcuguu

SEQ ID NO: 4963 - RNA, 17 nt, Artificial Sequence
  Synthetic
uauuuuacuagugaauu

SEQ ID NO: 4964 - RNA, 17 nt, Artificial Sequence
  Synthetic
ucacauaaaaauuuaag

SEQ ID NO: 4965 - RNA, 20 nt, Artificial Sequence
  Synthetic
ucucacauaaaaauuuaaga

SEQ ID NO: 4966 - RNA, 20 nt, Artificial Sequence
  Synthetic
uguuucauuuuuugcugaca

SEQ ID NO: 4967 - RNA, 20 nt, Artificial Sequence
  Synthetic
uguuuuggaauguagagagg

SEQ ID NO: 4968 - RNA, 17 nt, Artificial Sequence
  Synthetic
uuaaauuuuuaugugag

SEQ ID NO: 4969 - RNA, 20 nt, Artificial Sequence
  Synthetic
uuauucuaauuauuuuacua

SEQ ID NO: 4970 - RNA, 17 nt, Artificial Sequence
  Synthetic
uucacuaguaaaauaau

SEQ ID NO: 4971 - RNA, 17 nt, Artificial Sequence
  Synthetic
uucauguuaagcaaaac

SEQ ID NO: 4972 - RNA, 17 nt, Artificial Sequence
  Synthetic
uucauuuuuugcugaca

SEQ ID NO: 4973 - RNA, 20 nt, Artificial Sequence
  Synthetic
uucccgucuuaaauuuuuau

SEQ ID NO: 4974 - RNA, 17 nt, Artificial Sequence
  Synthetic
uucuaauuauuuuacua

SEQ ID NO: 4975 - RNA, 17 nt, Artificial Sequence
  Synthetic
uucuaguuuugcuuaac

SEQ ID NO: 4976 - RNA, 17 nt, Artificial Sequence
  Synthetic
uucugugucagcaaaaa

SEQ ID NO: 4977 - RNA, 17 nt, Artificial Sequence
  Synthetic
uuuggaauguagagagg

SEQ ID NO: 4978 - RNA, 20 nt, Artificial Sequence
  Synthetic
uuuggaauguagagaggcag

SEQ ID NO: 4979 - RNA, 20 nt, Artificial Sequence
  Synthetic
uuuggaucuuuggcuauuga

SEQ ID NO: 4980 - RNA, 17 nt, Artificial Sequence
  Synthetic
ggaucuuuggcuauuga

SEQ ID NO: 4981 - RNA, 20 nt, Artificial Sequence
  Synthetic
gacgacggcucgguucacau

SEQ ID NO: 4982 - RNA, 20 nt, Artificial Sequence
  Synthetic
gacgccagacgcggcccccg

SEQ ID NO: 4983 - RNA, 20 nt, Artificial Sequence
  Synthetic
gccuugcuugcggcgagaca

SEQ ID NO: 4984 - RNA, 20 nt, Artificial Sequence
  Synthetic
ggcuccgcggacgccagacg

SEQ ID NO: 4985 - RNA, 17 nt, Artificial Sequence
  Synthetic
gacggcucgguucacau

SEQ ID NO: 4986 - RNA, 17 nt, Artificial Sequence
  Synthetic
gccgcgucuggcguccg

SEQ ID NO: 4987 - RNA, 17 nt, Artificial Sequence
  Synthetic
gcgggcggacgacggcu

SEQ ID NO: 4988 - RNA, 20 nt, Artificial Sequence
  Synthetic
acacggcaaugguuccagau

SEQ ID NO: 4989 - RNA, 20 nt, Artificial Sequence
  Synthetic
accaugucucgccgcaagca

SEQ ID NO: 4990 - RNA, 20 nt, Artificial Sequence
  Synthetic
acgacggcucgguucacauc

SEQ ID NO: 4991 - RNA, 20 nt, Artificial Sequence
  Synthetic
auucccguuugcuuaagugc

SEQ ID NO: 4992 - RNA, 20 nt, Artificial Sequence
  Synthetic
cauuuuagaguccgcgugug

SEQ ID NO: 4993 - RNA, 20 nt, Artificial Sequence
  Synthetic
cggacgccagacgcggcccc

SEQ ID NO: 4994 - RNA, 20 nt, Artificial Sequence
  Synthetic
cgguucacaucgggagagcc

SEQ ID NO: 4995 - RNA, 20 nt, Artificial Sequence
  Synthetic
cuccugacguucaaguucgc

SEQ ID NO: 4996 - RNA, 20 nt, Artificial Sequence
  Synthetic
uaauaaucacgagagcgcgc

SEQ ID NO: 4997 - RNA, 20 nt, Artificial Sequence
  Synthetic
uccugacguucaaguucgca

SEQ ID NO: 4998 - RNA, 20 nt, Artificial Sequence
  Synthetic
ucgguucacaucgggagagc

SEQ ID NO: 4999 - RNA, 20 nt, Artificial Sequence
  Synthetic
ucuuuuaccucgacucucgg

SEQ ID NO: 5000 - RNA, 20 nt, Artificial Sequence
  Synthetic
ugcuugcggcgagacauggu

SEQ ID NO: 5001 - RNA, 20 nt, Artificial Sequence
  Synthetic
uuuagaguccgcgugugugg

SEQ ID NO: 5002 - RNA, 17 nt, Artificial Sequence
  Synthetic
acggcucgguucacauc

SEQ ID NO: 5003 - RNA, 17 nt, Artificial Sequence
  Synthetic
augucucgccgcaagca

SEQ ID NO: 5004 - RNA, 17 nt, Artificial Sequence
  Synthetic
cugacguucaaguucgc

SEQ ID NO: 5005 - RNA, 17 nt, Artificial Sequence
  Synthetic
uaaucacgagagcgcgc

SEQ ID NO: 5006 - RNA, 17 nt, Artificial Sequence
  Synthetic
uccgcggacgccagacg

SEQ ID NO: 5007 - RNA, 17 nt, Artificial Sequence
  Synthetic
ugacguucaaguucgca

SEQ ID NO: 5008 - RNA, 17 nt, Artificial Sequence
  Synthetic
uuagaguccgcgugugu

SEQ ID NO: 5009 - RNA, 17 nt, Artificial Sequence
  Synthetic
uugcggcgagacauggu

SEQ ID NO: 5010 - RNA, 17 nt, Artificial Sequence
  Synthetic
uugcuugcggcgagaca

SEQ ID NO: 5011 - RNA, 17 nt, Artificial Sequence
  Synthetic
uuuaccucgacucucgg

SEQ ID NO: 5012 - RNA, 17 nt, Artificial Sequence
  Synthetic
uuuagaguccgcgugug

SEQ ID NO: 5013 - RNA, 20 nt, Artificial Sequence
  Synthetic
gaaaaaacccucaucccauc

SEQ ID NO: 5014 - RNA, 17 nt, Artificial Sequence
  Synthetic
gaaagggguggcagggg

SEQ ID NO: 5015 - RNA, 20 nt, Artificial Sequence
  Synthetic
gaacuugaacgucaggaguc

SEQ ID NO: 5016 - RNA, 17 nt, Artificial Sequence
  Synthetic
gaacuugcagcucaggg

SEQ ID NO: 5017 - RNA, 17 nt, Artificial Sequence
  Synthetic
gaagaaagggguggcag

SEQ ID NO: 5018 - RNA, 20 nt, Artificial Sequence
  Synthetic
gaagaaagggguggcagggg

SEQ ID NO: 5019 - RNA, 20 nt, Artificial Sequence
  Synthetic
gaaggggaagcucacaccaa

SEQ ID NO: 5020 - RNA, 17 nt, Artificial Sequence
  Synthetic
gaaggggaggagggaag

SEQ ID NO: 5021 - RNA, 20 nt, Artificial Sequence
  Synthetic
gaauugugggagagccguca

SEQ ID NO: 5022 - RNA, 20 nt, Artificial Sequence
  Synthetic
gacaagccaauggccagugc

SEQ ID NO: 5023 - RNA, 20 nt, Artificial Sequence
  Synthetic
gacagagacacacaaaacau

SEQ ID NO: 5024 - RNA, 17 nt, Artificial Sequence
  Synthetic
gacaugaaaaagagacc

SEQ ID NO: 5025 - RNA, 20 nt, Artificial Sequence
  Synthetic
gacauggugggcugcggggc

SEQ ID NO: 5026 - RNA, 17 nt, Artificial Sequence
  Synthetic
gacgcggcccccggggg

SEQ ID NO: 5027 - RNA, 17 nt, Artificial Sequence
  Synthetic
gacuagaagcaaaagcg

SEQ ID NO: 5028 - RNA, 20 nt, Artificial Sequence
  Synthetic
gacuagaagcaaaagcgagg

SEQ ID NO: 5029 - RNA, 17 nt, Artificial Sequence
  Synthetic
gagaagaaagggguggc

SEQ ID NO: 5030 - RNA, 17 nt, Artificial Sequence
  Synthetic
gagaaggggaggaggga

SEQ ID NO: 5031 - RNA, 20 nt, Artificial Sequence
  Synthetic
gagacacacaaaacaugggc

SEQ ID NO: 5032 - RNA, 17 nt, Artificial Sequence
  Synthetic
gagacauggugggcugc

SEQ ID NO: 5033 - RNA, 20 nt, Artificial Sequence
  Synthetic
gagagaagaaagggguggca

SEQ ID NO: 5034 - RNA, 17 nt, Artificial Sequence
  Synthetic
gagagaagagagauaga

SEQ ID NO: 5035 - RNA, 20 nt, Artificial Sequence
  Synthetic
gagagaaggggaggagggaa

SEQ ID NO: 5036 - RNA, 20 nt, Artificial Sequence
  Synthetic
gagagagagaagagagauag

SEQ ID NO: 5037 - RNA, 17 nt, Artificial Sequence
  Synthetic
gagagagaugaaaaaaa

SEQ ID NO: 5038 - RNA, 17 nt, Artificial Sequence
  Synthetic
gagcaggagagaagggg

SEQ ID NO: 5039 - RNA, 20 nt, Artificial Sequence
  Synthetic
gagcaggagagaaggggagg

SEQ ID NO: 5040 - RNA, 17 nt, Artificial Sequence
  Synthetic
gagccggguuagaaaga

SEQ ID NO: 5041 - RNA, 17 nt, Artificial Sequence
  Synthetic
gaggggagggggcgcug

SEQ ID NO: 5042 - RNA, 20 nt, Artificial Sequence
  Synthetic
gaggggcgggccgaggggag

SEQ ID NO: 5043 - RNA, 17 nt, Artificial Sequence
  Synthetic
gagggggaggugcgggg

SEQ ID NO: 5044 - RNA, 20 nt, Artificial Sequence
  Synthetic
gagggggaggugcggggcgg

SEQ ID NO: 5045 - RNA, 17 nt, Artificial Sequence
  Synthetic
gagguaaaagagauaaa

SEQ ID NO: 5046 - RNA, 17 nt, Artificial Sequence
  Synthetic
gaguccgcguguguggg

SEQ ID NO: 5047 - RNA, 20 nt, Artificial Sequence
  Synthetic
gagucuccuucuuucuaacc

SEQ ID NO: 5048 - RNA, 17 nt, Artificial Sequence
  Synthetic
gaugaagauauuuucuc

SEQ ID NO: 5049 - RNA, 20 nt, Artificial Sequence
  Synthetic
gcaaaagcgagggggagaga

SEQ ID NO: 5050 - RNA, 20 nt, Artificial Sequence
  Synthetic
gcaccucccccuccccgcac

SEQ ID NO: 5051 - RNA, 20 nt, Artificial Sequence
  Synthetic
gcacuugaacuugcagcuca

SEQ ID NO: 5052 - RNA, 17 nt, Artificial Sequence
  Synthetic
gcagggaagaugaauug

SEQ ID NO: 5053 - RNA, 20 nt, Artificial Sequence
  Synthetic
gcagggcgagcaggagagaa

SEQ ID NO: 5054 - RNA, 17 nt, Artificial Sequence
  Synthetic
gcaggggugggaggaaa

SEQ ID NO: 5055 - RNA, 20 nt, Artificial Sequence
  Synthetic
gcaggggugggaggaaaggg

SEQ ID NO: 5056 - RNA, 20 nt, Artificial Sequence
  Synthetic
gccaauggccagugcgggga

SEQ ID NO: 5057 - RNA, 20 nt, Artificial Sequence
  Synthetic
gccaccccuuucuucucucc

SEQ ID NO: 5058 - RNA, 17 nt, Artificial Sequence
  Synthetic
gccagacgcggcccccg

SEQ ID NO: 5059 - RNA, 20 nt, Artificial Sequence
  Synthetic
gccccagcgcccccuccccu

SEQ ID NO: 5060 - RNA, 17 nt, Artificial Sequence
  Synthetic
gcccccgggggaggggc

SEQ ID NO: 5061 - RNA, 17 nt, Artificial Sequence
  Synthetic
gcccgccccucccccgg

SEQ ID NO: 5062 - RNA, 20 nt, Artificial Sequence
  Synthetic
gccgaggggagggggcgcug

SEQ ID NO: 5063 - RNA, 20 nt, Artificial Sequence
  Synthetic
gccgcggcgguggcguggcc

SEQ ID NO: 5064 - RNA, 17 nt, Artificial Sequence
  Synthetic
gccgggagagaagaaag

SEQ ID NO: 5065 - RNA, 20 nt, Artificial Sequence
  Synthetic
gccgggagagaagaaagggg

SEQ ID NO: 5066 - RNA, 20 nt, Artificial Sequence
  Synthetic
gcgagacauggugggcugcg

SEQ ID NO: 5067 - RNA, 20 nt, Artificial Sequence
  Synthetic
gcgcagggaagaugaauugu

SEQ ID NO: 5068 - RNA, 17 nt, Artificial Sequence
  Synthetic
gcgccgcggcgguggcg

SEQ ID NO: 5069 - RNA, 17 nt, Artificial Sequence
  Synthetic
gcgcucgcugcggccac

SEQ ID NO: 5070 - RNA, 20 nt, Artificial Sequence
  Synthetic
gcggcccccgggggaggggc

SEQ ID NO: 5071 - RNA, 20 nt, Artificial Sequence
  Synthetic
gcggcgcucgcugcggccac

SEQ ID NO: 5072 - RNA, 17 nt, Artificial Sequence
  Synthetic
gcggcggcggcggcggc

SEQ ID NO: 5073 - RNA, 20 nt, Artificial Sequence
  Synthetic
gcggcggcggcggcggcggc

SEQ ID NO: 5074 - RNA, 20 nt, Artificial Sequence
  Synthetic
gcggcggcggcggcggcggg

SEQ ID NO: 5075 - RNA, 17 nt, Artificial Sequence
  Synthetic
gcggcggcggcggcggg

SEQ ID NO: 5076 - RNA, 20 nt, Artificial Sequence
  Synthetic
gcggcgggcggacgacggcu

SEQ ID NO: 5077 - RNA, 17 nt, Artificial Sequence
  Synthetic
gcggcgguggcguggcc

SEQ ID NO: 5078 - RNA, 17 nt, Artificial Sequence
  Synthetic
gcgggcggcggcggcgg

SEQ ID NO: 5079 - RNA, 20 nt, Artificial Sequence
  Synthetic
gcgggcggcggcggcggcgg

SEQ ID NO: 5080 - RNA, 17 nt, Artificial Sequence
  Synthetic
gcggggagggggaggug

SEQ ID NO: 5081 - RNA, 20 nt, Artificial Sequence
  Synthetic
gcguggccgggagagaagaa

SEQ ID NO: 5082 - RNA, 17 nt, Artificial Sequence
  Synthetic
gcucccccccacacacg

SEQ ID NO: 5083 - RNA, 20 nt, Artificial Sequence
  Synthetic
gcugggguuugccuugcuug

SEQ ID NO: 5084 - RNA, 20 nt, Artificial Sequence
  Synthetic
ggacaagccaauggccagug

SEQ ID NO: 5085 - RNA, 17 nt, Artificial Sequence
  Synthetic
ggacacacaucaggggc

SEQ ID NO: 5086 - RNA, 20 nt, Artificial Sequence
  Synthetic
ggacagagacacacaaaaca

SEQ ID NO: 5087 - RNA, 20 nt, Artificial Sequence
  Synthetic
ggacgccagacgcggccccc

SEQ ID NO: 5088 - RNA, 20 nt, Artificial Sequence
  Synthetic
ggacuagaagcaaaagcgag

SEQ ID NO: 5089 - RNA, 20 nt, Artificial Sequence
  Synthetic
ggagagaagaaagggguggc

SEQ ID NO: 5090 - RNA, 20 nt, Artificial Sequence
  Synthetic
ggagagaaggggaggaggga

SEQ ID NO: 5091 - RNA, 20 nt, Artificial Sequence
  Synthetic
ggagagccggguuagaaaga

SEQ ID NO: 5092 - RNA, 20 nt, Artificial Sequence
  Synthetic
ggaggggcgggccgagggga

SEQ ID NO: 5093 - RNA, 20 nt, Artificial Sequence
  Synthetic
ggagggggaggugcggggcg

SEQ ID NO: 5094 - RNA, 20 nt, Artificial Sequence
  Synthetic
ggagggggcgcuggggccgc

SEQ ID NO: 5095 - RNA, 20 nt, Artificial Sequence
  Synthetic
ggcagggcgagcaggagaga

SEQ ID NO: 5096 - RNA, 17 nt, Artificial Sequence
  Synthetic
ggcaggggugggaggaa

SEQ ID NO: 5097 - RNA, 17 nt, Artificial Sequence
  Synthetic
ggccacuggugagcccg

SEQ ID NO: 5098 - RNA, 17 nt, Artificial Sequence
  Synthetic
ggcccccgggggagggg

SEQ ID NO: 5099 - RNA, 17 nt, Artificial Sequence
  Synthetic
ggcccgccccucccccg

SEQ ID NO: 5100 - RNA, 20 nt, Artificial Sequence
  Synthetic
ggccgaggggagggggcgcu

SEQ ID NO: 5101 - RNA, 17 nt, Artificial Sequence
  Synthetic
ggccgcagcgagcgccg

SEQ ID NO: 5102 - RNA, 20 nt, Artificial Sequence
  Synthetic
ggccgcagcgagcgccgcgg

SEQ ID NO: 5103 - RNA, 17 nt, Artificial Sequence
  Synthetic
ggccgcgggcucaccag

SEQ ID NO: 5104 - RNA, 17 nt, Artificial Sequence
  Synthetic
ggccgggagagaagaaa

SEQ ID NO: 5105 - RNA, 20 nt, Artificial Sequence
  Synthetic
ggcgagacauggugggcugc

SEQ ID NO: 5106 - RNA, 17 nt, Artificial Sequence
  Synthetic
ggcgagcaggagagaag

SEQ ID NO: 5107 - RNA, 20 nt, Artificial Sequence
  Synthetic
ggcgagcaggagagaagggg

SEQ ID NO: 5108 - RNA, 20 nt, Artificial Sequence
  Synthetic
ggcgcagggaagaugaauug

SEQ ID NO: 5109 - RNA, 17 nt, Artificial Sequence
  Synthetic
ggcggcggcggcggcgg

SEQ ID NO: 5110 - RNA, 20 nt, Artificial Sequence
  Synthetic
ggcggcggcggcggcggcgg

SEQ ID NO: 5111 - RNA, 17 nt, Artificial Sequence
  Synthetic
ggcgggccgaggggagg

SEQ ID NO: 5112 - RNA, 17 nt, Artificial Sequence
  Synthetic
ggcugcggggcgggcgg

SEQ ID NO: 5113 - RNA, 20 nt, Artificial Sequence
  Synthetic
ggcugcggggcgggcggcgg

SEQ ID NO: 5114 - RNA, 17 nt, Artificial Sequence
  Synthetic
gggagagaagaaagggg

SEQ ID NO: 5115 - RNA, 17 nt, Artificial Sequence
  Synthetic
gggaggaaagggugggg

SEQ ID NO: 5116 - RNA, 17 nt, Artificial Sequence
  Synthetic
gggaggggcgggccgag

SEQ ID NO: 5117 - RNA, 20 nt, Artificial Sequence
  Synthetic
gggaggggcgggccgagggg

SEQ ID NO: 5118 - RNA, 20 nt, Artificial Sequence
  Synthetic
gggagggggaggugcggggc

SEQ ID NO: 5119 - RNA, 20 nt, Artificial Sequence
  Synthetic
gggagggggcgcuggggccg

SEQ ID NO: 5120 - RNA, 17 nt, Artificial Sequence
  Synthetic
gggaggugcggggcggg

SEQ ID NO: 5121 - RNA, 20 nt, Artificial Sequence
  Synthetic
gggccgaggggagggggcgc

SEQ ID NO: 5122 - RNA, 17 nt, Artificial Sequence
  Synthetic
gggcgagcaggagagaa

SEQ ID NO: 5123 - RNA, 17 nt, Artificial Sequence
  Synthetic
gggcgggccgaggggag

SEQ ID NO: 5124 - RNA, 17 nt, Artificial Sequence
  Synthetic
ggggaagcucacaccaa

SEQ ID NO: 5125 - RNA, 17 nt, Artificial Sequence
  Synthetic
ggggaggggcgggccga

SEQ ID NO: 5126 - RNA, 17 nt, Artificial Sequence
  Synthetic
ggggagggggaggugcg

SEQ ID NO: 5127 - RNA, 20 nt, Artificial Sequence
  Synthetic
ggggagggggaggugcgggg

SEQ ID NO: 5128 - RNA, 17 nt, Artificial Sequence
  Synthetic
ggggaggugcggggcgg

SEQ ID NO: 5129 - RNA, 20 nt, Artificial Sequence
  Synthetic
ggggccgcgucuggcguccg

SEQ ID NO: 5130 - RNA, 17 nt, Artificial Sequence
  Synthetic
ggggcgggccgagggga

SEQ ID NO: 5131 - RNA, 17 nt, Artificial Sequence
  Synthetic
ggggcgggcggcggcgg

SEQ ID NO: 5132 - RNA, 20 nt, Artificial Sequence
  Synthetic
ggggcgggcggcggcggcgg

SEQ ID NO: 5133 - RNA, 17 nt, Artificial Sequence
  Synthetic
gggggaggggcgggccg

SEQ ID NO: 5134 - RNA, 17 nt, Artificial Sequence
  Synthetic
gggggaggugcggggcg

SEQ ID NO: 5135 - RNA, 17 nt, Artificial Sequence
  Synthetic
gggggcgcuggggccgc

SEQ ID NO: 5136 - RNA, 17 nt, Artificial Sequence
  Synthetic
gggguggcagggguggg

SEQ ID NO: 5137 - RNA, 17 nt, Artificial Sequence
  Synthetic
ggggugggaggaaaggg

SEQ ID NO: 5138 - RNA, 20 nt, Artificial Sequence
  Synthetic
ggggugggaggaaagggugg

SEQ ID NO: 5139 - RNA, 17 nt, Artificial Sequence
  Synthetic
gggguuugccuugcuug

SEQ ID NO: 5140 - RNA, 17 nt, Artificial Sequence
  Synthetic
gggugggaggaaagggu

SEQ ID NO: 5141 - RNA, 20 nt, Artificial Sequence
  Synthetic
gggugggaggaaaggguggg

SEQ ID NO: 5142 - RNA, 17 nt, Artificial Sequence
  Synthetic
gguaaaagagauaaagg

SEQ ID NO: 5143 - RNA, 20 nt, Artificial Sequence
  Synthetic
gguggcaggggugggaggaa

SEQ ID NO: 5144 - RNA, 17 nt, Artificial Sequence
  Synthetic
ggugggaggaaagggug

SEQ ID NO: 5145 - RNA, 20 nt, Artificial Sequence
  Synthetic
ggugggaggaaagggugggg

SEQ ID NO: 5146 - RNA, 17 nt, Artificial Sequence
  Synthetic
gguuccagaugggauga

SEQ ID NO: 5147 - RNA, 20 nt, Artificial Sequence
  Synthetic
guauuauuucuaauuuauuu

SEQ ID NO: 5148 - RNA, 20 nt, Artificial Sequence
  Synthetic
gucgagguaaaagagauaaa

SEQ ID NO: 5149 - RNA, 20 nt, Artificial Sequence
  Synthetic
gugcggggagggggaggugc

SEQ ID NO: 5150 - RNA, 20 nt, Artificial Sequence
  Synthetic
gugcggggcggggggcuccg

SEQ ID NO: 5151 - RNA, 20 nt, Artificial Sequence
  Synthetic
guggcaggggugggaggaaa

SEQ ID NO: 5152 - RNA, 20 nt, Artificial Sequence
  Synthetic
guggccgggagagaagaaag

SEQ ID NO: 5153 - RNA, 17 nt, Artificial Sequence
  Synthetic
gugggaggaaagggugg

SEQ ID NO: 5154 - RNA, 17 nt, Artificial Sequence
  Synthetic
gugggcugcggggcggg

SEQ ID NO: 5155 - RNA, 20 nt, Artificial Sequence
  Synthetic
gugggcugcggggcgggcgg

SEQ ID NO: 5156 - RNA, 17 nt, Artificial Sequence
  Synthetic
gugugugggggggagca

SEQ ID NO: 5157 - RNA, 20 nt, Artificial Sequence
  Synthetic
aaaaaaaaaaaaaaaaaaag

SEQ ID NO: 5158 - RNA, 20 nt, Artificial Sequence
  Synthetic
aaaaaaaaaaaaaaaaaaga

SEQ ID NO: 5159 - RNA, 17 nt, Artificial Sequence
  Synthetic
aaaaaaaaaaaaaaaag

SEQ ID NO: 5160 - RNA, 17 nt, Artificial Sequence
  Synthetic
aaaaaaaaaaaaaaaga

SEQ ID NO: 5161 - RNA, 20 nt, Artificial Sequence
  Synthetic
aaaacaugggcagggcgagc

SEQ ID NO: 5162 - RNA, 17 nt, Artificial Sequence
  Synthetic
aaaacccucaucccauc

SEQ ID NO: 5163 - RNA, 17 nt, Artificial Sequence
  Synthetic
aaaaccuccgagagucg

SEQ ID NO: 5164 - RNA, 17 nt, Artificial Sequence
  Synthetic
aaaagcgagggggagag

SEQ ID NO: 5165 - RNA, 17 nt, Artificial Sequence
  Synthetic
aaagcgagggggagaga

SEQ ID NO: 5166 - RNA, 17 nt, Artificial Sequence
  Synthetic
aaagggguggcaggggu

SEQ ID NO: 5167 - RNA, 20 nt, Artificial Sequence
  Synthetic
aaagggguggcagggguggg

SEQ ID NO: 5168 - RNA, 20 nt, Artificial Sequence
  Synthetic
aaauaauacaaagauggcgc

SEQ ID NO: 5169 - RNA, 20 nt, Artificial Sequence
  Synthetic
aaccccagcacuuaagcaaa

SEQ ID NO: 5170 - RNA, 17 nt, Artificial Sequence
  Synthetic
aacgucaggagucugga

SEQ ID NO: 5171 - RNA, 20 nt, Artificial Sequence
  Synthetic
aagaaagggguggcaggggu

SEQ ID NO: 5172 - RNA, 20 nt, Artificial Sequence
  Synthetic
aagagaccaggacaagccaa

SEQ ID NO: 5173 - RNA, 17 nt, Artificial Sequence
  Synthetic
aagccaauggccagugc

SEQ ID NO: 5174 - RNA, 17 nt, Artificial Sequence
  Synthetic
aagcgagggggagagag

SEQ ID NO: 5175 - RNA, 17 nt, Artificial Sequence
  Synthetic
aagugcauacacggcaa

SEQ ID NO: 5176 - RNA, 20 nt, Artificial Sequence
  Synthetic
aauaauacaaagauggcgca

SEQ ID NO: 5177 - RNA, 17 nt, Artificial Sequence
  Synthetic
aauacaaagauggcgca

SEQ ID NO: 5178 - RNA, 20 nt, Artificial Sequence
  Synthetic
aauggacacacaucaggggc

SEQ ID NO: 5179 - RNA, 17 nt, Artificial Sequence
  Synthetic
aauggccagugcgggga

SEQ ID NO: 5180 - RNA, 20 nt, Artificial Sequence
  Synthetic
aaugguuccagaugggauga

SEQ ID NO: 5181 - RNA, 17 nt, Artificial Sequence
  Synthetic
aauuaaauaaaauuaaa

SEQ ID NO: 5182 - RNA, 20 nt, Artificial Sequence
  Synthetic
aauuagaaauaauacaaaga

SEQ ID NO: 5183 - RNA, 20 nt, Artificial Sequence
  Synthetic
aauuuauuuuggaugucaaa

SEQ ID NO: 5184 - RNA, 20 nt, Artificial Sequence
  Synthetic
acaagccaauggccagugcg

SEQ ID NO: 5185 - RNA, 17 nt, Artificial Sequence
  Synthetic
acacacaaaacaugggc

SEQ ID NO: 5186 - RNA, 20 nt, Artificial Sequence
  Synthetic
acaccaauggacacacauca

SEQ ID NO: 5187 - RNA, 17 nt, Artificial Sequence
  Synthetic
acaugggcagggcgagc

SEQ ID NO: 5188 - RNA, 17 nt, Artificial Sequence
  Synthetic
accaauggacacacauc

SEQ ID NO: 5189 - RNA, 20 nt, Artificial Sequence
  Synthetic
accccagcacuuaagcaaac

SEQ ID NO: 5190 - RNA, 17 nt, Artificial Sequence
  Synthetic
accccuuucuucucucc

SEQ ID NO: 5191 - RNA, 17 nt, Artificial Sequence
  Synthetic
acgccagacgcggcccc

SEQ ID NO: 5192 - RNA, 20 nt, Artificial Sequence
  Synthetic
acgccagacgcggcccccgg

SEQ ID NO: 5193 - RNA, 17 nt, Artificial Sequence
  Synthetic
acgcggcccccggggga

SEQ ID NO: 5194 - RNA, 17 nt, Artificial Sequence
  Synthetic
acggcaaugguuccaga

SEQ ID NO: 5195 - RNA, 17 nt, Artificial Sequence
  Synthetic
acuagaagcaaaagcga

SEQ ID NO: 5196 - RNA, 20 nt, Artificial Sequence
  Synthetic
acugaugaagauauuuucuc

SEQ ID NO: 5197 - RNA, 17 nt, Artificial Sequence
  Synthetic
acuugaacuugcagcuc

SEQ ID NO: 5198 - RNA, 20 nt, Artificial Sequence
  Synthetic
acuugaacuugcagcucagg

SEQ ID NO: 5199 - RNA, 20 nt, Artificial Sequence
  Synthetic
agaaaaaccuccgagagucg

SEQ ID NO: 5200 - RNA, 17 nt, Artificial Sequence
  Synthetic
agaagaaagggguggca

SEQ ID NO: 5201 - RNA, 17 nt, Artificial Sequence
  Synthetic
agaaggggaggagggaa

SEQ ID NO: 5202 - RNA, 20 nt, Artificial Sequence
  Synthetic
agacacacaaaacaugggca

SEQ ID NO: 5203 - RNA, 17 nt, Artificial Sequence
  Synthetic
agacauggugggcugcg

SEQ ID NO: 5204 - RNA, 20 nt, Artificial Sequence
  Synthetic
agacauggugggcugcgggg

SEQ ID NO: 5205 - RNA, 17 nt, Artificial Sequence
  Synthetic
agaccaggacaagccaa

SEQ ID NO: 5206 - RNA, 20 nt, Artificial Sequence
  Synthetic
agacgcggcccccgggggag

SEQ ID NO: 5207 - RNA, 20 nt, Artificial Sequence
  Synthetic
agagaagaaagggguggcag

SEQ ID NO: 5208 - RNA, 20 nt, Artificial Sequence
  Synthetic
agagaaggggaggagggaag

SEQ ID NO: 5209 - RNA, 17 nt, Artificial Sequence
  Synthetic
agagacacacaaaacau

SEQ ID NO: 5210 - RNA, 17 nt, Artificial Sequence
  Synthetic
agagagaagagagauag

SEQ ID NO: 5211 - RNA, 20 nt, Artificial Sequence
  Synthetic
agagagagaagagagauaga

SEQ ID NO: 5212 - RNA, 20 nt, Artificial Sequence
  Synthetic
agagagagagaugaaaaaaa

SEQ ID NO: 5213 - RNA, 17 nt, Artificial Sequence
  Synthetic
agaguccgcgugugugg

SEQ ID NO: 5214 - RNA, 20 nt, Artificial Sequence
  Synthetic
agcaaaagcgagggggagag

SEQ ID NO: 5215 - RNA, 20 nt, Artificial Sequence
  Synthetic
agcaggagagaaggggagga

SEQ ID NO: 5216 - RNA, 17 nt, Artificial Sequence
  Synthetic
agccaauggccagugcg

SEQ ID NO: 5217 - RNA, 20 nt, Artificial Sequence
  Synthetic
agccaauggccagugcgggg

SEQ ID NO: 5218 - RNA, 20 nt, Artificial Sequence
  Synthetic
agccccugauguguguccau

SEQ ID NO: 5219 - RNA, 17 nt, Artificial Sequence
  Synthetic
agcgagcgccgcggcgg

SEQ ID NO: 5220 - RNA, 17 nt, Artificial Sequence
  Synthetic
agcugcaaguucaagug

SEQ ID NO: 5221 - RNA, 20 nt, Artificial Sequence
  Synthetic
aggacuagaagcaaaagcga

SEQ ID NO: 5222 - RNA, 17 nt, Artificial Sequence
  Synthetic
aggagagaaggggagga

SEQ ID NO: 5223 - RNA, 17 nt, Artificial Sequence
  Synthetic
agggcgagcaggagaga

SEQ ID NO: 5224 - RNA, 17 nt, Artificial Sequence
  Synthetic
aggggcgggccgagggg

SEQ ID NO: 5225 - RNA, 20 nt, Artificial Sequence
  Synthetic
aggggcgggccgaggggagg

SEQ ID NO: 5226 - RNA, 17 nt, Artificial Sequence
  Synthetic
agggggaggugcggggc

SEQ ID NO: 5227 - RNA, 20 nt, Artificial Sequence
  Synthetic
agggggaggugcggggcggg

SEQ ID NO: 5228 - RNA, 17 nt, Artificial Sequence
  Synthetic
agggggcgcuggggccg

SEQ ID NO: 5229 - RNA, 20 nt, Artificial Sequence
  Synthetic
aggggugggaggaaagggug

SEQ ID NO: 5230 - RNA, 17 nt, Artificial Sequence
  Synthetic
agguaaaagagauaaag

SEQ ID NO: 5231 - RNA, 17 nt, Artificial Sequence
  Synthetic
aguccgcgugugugggg

SEQ ID NO: 5232 - RNA, 20 nt, Artificial Sequence
  Synthetic
agucgagguaaaagagauaa

SEQ ID NO: 5233 - RNA, 20 nt, Artificial Sequence
  Synthetic
agugcggggagggggaggug

SEQ ID NO: 5234 - RNA, 20 nt, Artificial Sequence
  Synthetic
aguggccgcagcgagcgccg

SEQ ID NO: 5235 - RNA, 20 nt, Artificial Sequence
  Synthetic
auaauuauuauuacuauuau

SEQ ID NO: 5236 - RNA, 20 nt, Artificial Sequence
  Synthetic
aucucuuuuaccucgacucu

SEQ ID NO: 5237 - RNA, 17 nt, Artificial Sequence
  Synthetic
auggccagugcggggag

SEQ ID NO: 5238 - RNA, 17 nt, Artificial Sequence
  Synthetic
auggugggcugcggggc

SEQ ID NO: 5239 - RNA, 20 nt, Artificial Sequence
  Synthetic
auggugggcugcggggcggg

SEQ ID NO: 5240 - RNA, 17 nt, Artificial Sequence
  Synthetic
auuauuauuacuauuau

SEQ ID NO: 5241 - RNA, 20 nt, Artificial Sequence
  Synthetic
auuuuagaguccgcgugugu

SEQ ID NO: 5242 - RNA, 20 nt, Artificial Sequence
  Synthetic
caaaagcgagggggagagag

SEQ ID NO: 5243 - RNA, 20 nt, Artificial Sequence
  Synthetic
caaaagugcauacacggcaa

SEQ ID NO: 5244 - RNA, 17 nt, Artificial Sequence
  Synthetic
caagccaauggccagug

SEQ ID NO: 5245 - RNA, 17 nt, Artificial Sequence
  Synthetic
caauggacacacaucag

SEQ ID NO: 5246 - RNA, 17 nt, Artificial Sequence
  Synthetic
caauggccagugcgggg

SEQ ID NO: 5247 - RNA, 20 nt, Artificial Sequence
  Synthetic
caauggccagugcggggagg

SEQ ID NO: 5248 - RNA, 20 nt, Artificial Sequence
  Synthetic
caaugguuccagaugggaug

SEQ ID NO: 5249 - RNA, 17 nt, Artificial Sequence
  Synthetic
cacacaaaacaugggca

SEQ ID NO: 5250 - RNA, 20 nt, Artificial Sequence
  Synthetic
cacaccaauggacacacauc

SEQ ID NO: 5251 - RNA, 20 nt, Artificial Sequence
  Synthetic
caccaauggacacacaucag

SEQ ID NO: 5252 - RNA, 20 nt, Artificial Sequence
  Synthetic
caccgccgcggcgcucgcug

SEQ ID NO: 5253 - RNA, 20 nt, Artificial Sequence
  Synthetic
cacuggccauuggcuugucc

SEQ ID NO: 5254 - RNA, 20 nt, Artificial Sequence
  Synthetic
cacuugaacuugcagcucag

SEQ ID NO: 5255 - RNA, 20 nt, Artificial Sequence
  Synthetic
cagacgcggcccccggggga

SEQ ID NO: 5256 - RNA, 17 nt, Artificial Sequence
  Synthetic
cagagacacacaaaaca

SEQ ID NO: 5257 - RNA, 20 nt, Artificial Sequence
  Synthetic
caggacuagaagcaaaagcg

SEQ ID NO: 5258 - RNA, 17 nt, Artificial Sequence
  Synthetic
caggagagaaggggagg

SEQ ID NO: 5259 - RNA, 17 nt, Artificial Sequence
  Synthetic
cagggaagaugaauugu

SEQ ID NO: 5260 - RNA, 20 nt, Artificial Sequence
  Synthetic
cagggcgagcaggagagaag

SEQ ID NO: 5261 - RNA, 20 nt, Artificial Sequence
  Synthetic
caggggugggaggaaagggu

SEQ ID NO: 5262 - RNA, 17 nt, Artificial Sequence
  Synthetic
cauggugggcugcgggg

SEQ ID NO: 5263 - RNA, 17 nt, Artificial Sequence
  Synthetic
ccaauggacacacauca

SEQ ID NO: 5264 - RNA, 20 nt, Artificial Sequence
  Synthetic
ccaauggccagugcggggag

SEQ ID NO: 5265 - RNA, 17 nt, Artificial Sequence
  Synthetic
ccagacgcggcccccgg

SEQ ID NO: 5266 - RNA, 20 nt, Artificial Sequence
  Synthetic
ccagacgcggcccccggggg

SEQ ID NO: 5267 - RNA, 17 nt, Artificial Sequence
  Synthetic
ccagcacuuaagcaaac

SEQ ID NO: 5268 - RNA, 17 nt, Artificial Sequence
  Synthetic
ccagcgcccccuccccu

SEQ ID NO: 5269 - RNA, 17 nt, Artificial Sequence
  Synthetic
ccagugcggggaggggg

SEQ ID NO: 5270 - RNA, 17 nt, Artificial Sequence
  Synthetic
cccagcacuuaagcaaa

SEQ ID NO: 5271 - RNA, 17 nt, Artificial Sequence
  Synthetic
cccccgggggccgcguc

SEQ ID NO: 5272 - RNA, 20 nt, Artificial Sequence
  Synthetic
ccccuccccgcacuggccau

SEQ ID NO: 5273 - RNA, 20 nt, Artificial Sequence
  Synthetic
cccgggggaggggcgggccg

SEQ ID NO: 5274 - RNA, 17 nt, Artificial Sequence
  Synthetic
cccguuugcuuaagugc

SEQ ID NO: 5275 - RNA, 20 nt, Artificial Sequence
  Synthetic
cccucggcccgccccucccc

SEQ ID NO: 5276 - RNA, 17 nt, Artificial Sequence
  Synthetic
cccugauguguguccau

SEQ ID NO: 5277 - RNA, 17 nt, Artificial Sequence
  Synthetic
ccgaggggagggggcgc

SEQ ID NO: 5278 - RNA, 20 nt, Artificial Sequence
  Synthetic
ccgcgugugugggggggagc

SEQ ID NO: 5279 - RNA, 20 nt, Artificial Sequence
  Synthetic
ccgggggaggggcgggccga

SEQ ID NO: 5280 - RNA, 17 nt, Artificial Sequence
  Synthetic
ccguuugcuuaagugcu

SEQ ID NO: 5281 - RNA, 20 nt, Artificial Sequence
  Synthetic
ccucccccgggggccgcguc

SEQ ID NO: 5282 - RNA, 17 nt, Artificial Sequence
  Synthetic
ccucccccuccccgcac

SEQ ID NO: 5283 - RNA, 20 nt, Artificial Sequence
  Synthetic
ccucggcccgccccuccccc

SEQ ID NO: 5284 - RNA, 20 nt, Artificial Sequence
  Synthetic
ccugcucccccccacacacg

SEQ ID NO: 5285 - RNA, 17 nt, Artificial Sequence
  Synthetic
cgagacauggugggcug

SEQ ID NO: 5286 - RNA, 20 nt, Artificial Sequence
  Synthetic
cgagcgccgcggcgguggcg

SEQ ID NO: 5287 - RNA, 17 nt, Artificial Sequence
  Synthetic
cgaggggagggggcgcu

SEQ ID NO: 5288 - RNA, 17 nt, Artificial Sequence
  Synthetic
cgagguaaaagagauaa

SEQ ID NO: 5289 - RNA, 20 nt, Artificial Sequence
  Synthetic
cgagguaaaagagauaaagg

SEQ ID NO: 5290 - RNA, 20 nt, Artificial Sequence
  Synthetic
cgcacuugaacuugcagcuc

SEQ ID NO: 5291 - RNA, 17 nt, Artificial Sequence
  Synthetic
cgcagcgagcgccgcgg

SEQ ID NO: 5292 - RNA, 20 nt, Artificial Sequence
  Synthetic
cgcagcgagcgccgcggcgg

SEQ ID NO: 5293 - RNA, 17 nt, Artificial Sequence
  Synthetic
cgccagacgcggccccc

SEQ ID NO: 5294 - RNA, 17 nt, Artificial Sequence
  Synthetic
cgccgcggcgcucgcug

SEQ ID NO: 5295 - RNA, 20 nt, Artificial Sequence
  Synthetic
cgccgcggcgguggcguggc

SEQ ID NO: 5296 - RNA, 17 nt, Artificial Sequence
  Synthetic
cgcggcccccgggggag

SEQ ID NO: 5297 - RNA, 20 nt, Artificial Sequence
  Synthetic
cgcggcccccgggggagggg

SEQ ID NO: 5298 - RNA, 17 nt, Artificial Sequence
  Synthetic
cgcggcgguggcguggc

SEQ ID NO: 5299 - RNA, 20 nt, Artificial Sequence
  Synthetic
cgcgugugugggggggagca

SEQ ID NO: 5300 - RNA, 17 nt, Artificial Sequence
  Synthetic
cggcaaugguuccagau

SEQ ID NO: 5301 - RNA, 17 nt, Artificial Sequence
  Synthetic
cggccacgccaccgccg

SEQ ID NO: 5302 - RNA, 17 nt, Artificial Sequence
  Synthetic
cggcccgccccuccccc

SEQ ID NO: 5303 - RNA, 20 nt, Artificial Sequence
  Synthetic
cggcgagacauggugggcug

SEQ ID NO: 5304 - RNA, 20 nt, Artificial Sequence
  Synthetic
cggcggcggcgggcggacga

SEQ ID NO: 5305 - RNA, 17 nt, Artificial Sequence
  Synthetic
cggcggcgggcggacga

SEQ ID NO: 5306 - RNA, 17 nt, Artificial Sequence
  Synthetic
cggggagggggaggugc

SEQ ID NO: 5307 - RNA, 17 nt, Artificial Sequence
  Synthetic
cggggcggggggcuccg

SEQ ID NO: 5308 - RNA, 20 nt, Artificial Sequence
  Synthetic
cgggggaggggcgggccgag

SEQ ID NO: 5309 - RNA, 20 nt, Artificial Sequence
  Synthetic
cguggccgggagagaagaaa

SEQ ID NO: 5310 - RNA, 17 nt, Artificial Sequence
  Synthetic
cgugugugggggggagc

SEQ ID NO: 5311 - RNA, 17 nt, Artificial Sequence
  Synthetic
cguuugcuuaagugcug

SEQ ID NO: 5312 - RNA, 17 nt, Artificial Sequence
  Synthetic
cuagaagcaaaagcgag

SEQ ID NO: 5313 - RNA, 17 nt, Artificial Sequence
  Synthetic
cuccccgcacuggccau

SEQ ID NO: 5314 - RNA, 20 nt, Artificial Sequence
  Synthetic
cucggcccgccccucccccg

SEQ ID NO: 5315 - RNA, 20 nt, Artificial Sequence
  Synthetic
cugagcugcaaguucaagug

SEQ ID NO: 5316 - RNA, 17 nt, Artificial Sequence
  Synthetic
cugcgaacuugaacguc

SEQ ID NO: 5317 - RNA, 20 nt, Artificial Sequence
  Synthetic
cuggacaugaaaaagagacc

SEQ ID NO: 5318 - RNA, 20 nt, Artificial Sequence
  Synthetic
cugucucaaaagugcauaca

SEQ ID NO: 5319 - RNA, 17 nt, Artificial Sequence
  Synthetic
cuugaacgucaggaguc

SEQ ID NO: 5320 - RNA, 17 nt, Artificial Sequence
  Synthetic
cuugaacuugcagcuca

SEQ ID NO: 5321 - RNA, 20 nt, Artificial Sequence
  Synthetic
cuugaacuugcagcucaggg

SEQ ID NO: 5322 - RNA, 17 nt, Artificial Sequence
  Synthetic
cuugcggcgagacaugg

SEQ ID NO: 5323 - RNA, 17 nt, Artificial Sequence
  Synthetic
guucacaucgggagagc

SEQ ID NO: 5324 - RNA, 17 nt, Artificial Sequence
  Synthetic
uaauacaaagauggcgc

SEQ ID NO: 5325 - RNA, 20 nt, Artificial Sequence
  Synthetic
uaauuauuauuacuauuauu

SEQ ID NO: 5326 - RNA, 20 nt, Artificial Sequence
  Synthetic
uacacggcaaugguuccaga

SEQ ID NO: 5327 - RNA, 17 nt, Artificial Sequence
  Synthetic
uagaaauaauacaaaga

SEQ ID NO: 5328 - RNA, 17 nt, Artificial Sequence
  Synthetic
uagaagcaaaagcgagg

SEQ ID NO: 5329 - RNA, 17 nt, Artificial Sequence
  Synthetic
uagaguccgcgugugug

SEQ ID NO: 5330 - RNA, 20 nt, Artificial Sequence
  Synthetic
uagaguccgcgugugugggg

SEQ ID NO: 5331 - RNA, 20 nt, Artificial Sequence
  Synthetic
ucccggccacgccaccgccg

SEQ ID NO: 5332 - RNA, 20 nt, Artificial Sequence
  Synthetic
ucccguuugcuuaagugcug

SEQ ID NO: 5333 - RNA, 20 nt, Artificial Sequence
  Synthetic
ucccugcgaacuugaacguc

SEQ ID NO: 5334 - RNA, 20 nt, Artificial Sequence
  Synthetic
ucgagguaaaagagauaaag

SEQ ID NO: 5335 - RNA, 17 nt, Artificial Sequence
  Synthetic
ucggcccgccccucccc

SEQ ID NO: 5336 - RNA, 20 nt, Artificial Sequence
  Synthetic
ucggcccgccccucccccgg

SEQ ID NO: 5337 - RNA, 17 nt, Artificial Sequence
  Synthetic
ucucaaaagugcauaca

SEQ ID NO: 5338 - RNA, 17 nt, Artificial Sequence
  Synthetic
ucuccuucuuucuaacc

SEQ ID NO: 5339 - RNA, 17 nt, Artificial Sequence
  Synthetic
ucuuuuaccucgacucu

SEQ ID NO: 5340 - RNA, 17 nt, Artificial Sequence
  Synthetic
ugaacuugcagcucagg

SEQ ID NO: 5341 - RNA, 20 nt, Artificial Sequence
  Synthetic
ugcggccacuggugagcccg

SEQ ID NO: 5342 - RNA, 20 nt, Artificial Sequence
  Synthetic
ugcggggagggggaggugcg

SEQ ID NO: 5343 - RNA, 17 nt, Artificial Sequence
  Synthetic
ugcggggcgggcggcgg

SEQ ID NO: 5344 - RNA, 20 nt, Artificial Sequence
  Synthetic
ugcggggcgggcggcggcgg

SEQ ID NO: 5345 - RNA, 20 nt, Artificial Sequence
  Synthetic
ugcuuaaaaaaaagccauga

SEQ ID NO: 5346 - RNA, 17 nt, Artificial Sequence
  Synthetic
uggccagugcggggagg

SEQ ID NO: 5347 - RNA, 20 nt, Artificial Sequence
  Synthetic
uggccagugcggggaggggg

SEQ ID NO: 5348 - RNA, 17 nt, Artificial Sequence
  Synthetic
uggccauuggcuugucc

SEQ ID NO: 5349 - RNA, 17 nt, Artificial Sequence
  Synthetic
uggccgggagagaagaa

SEQ ID NO: 5350 - RNA, 17 nt, Artificial Sequence
  Synthetic
ugggaggaaaggguggg

SEQ ID NO: 5351 - RNA, 20 nt, Artificial Sequence
  Synthetic
uggggccgcgggcucaccag

SEQ ID NO: 5352 - RNA, 17 nt, Artificial Sequence
  Synthetic
ugguuccagaugggaug

SEQ ID NO: 5353 - RNA, 17 nt, Artificial Sequence
  Synthetic
uuaaaaaaaagccauga

SEQ ID NO: 5354 - RNA, 20 nt, Artificial Sequence
  Synthetic
uuagaguccgcguguguggg

SEQ ID NO: 5355 - RNA, 17 nt, Artificial Sequence
  Synthetic
uuauuauuacuauuauu

SEQ ID NO: 5356 - RNA, 17 nt, Artificial Sequence
  Synthetic
uuauuucuaauuuauuu

SEQ ID NO: 5357 - RNA, 17 nt, Artificial Sequence
  Synthetic
uuauuuuggaugucaaa

SEQ ID NO: 5358 - RNA, 17 nt, Artificial Sequence
  Synthetic
uucacaucgggagagcc

SEQ ID NO: 5359 - RNA, 20 nt, Artificial Sequence
  Synthetic
uucccguuugcuuaagugcu

SEQ ID NO: 5360 - RNA, 20 nt, Artificial Sequence
  Synthetic
uugaacgucaggagucugga

SEQ ID NO: 5361 - RNA, 17 nt, Artificial Sequence
  Synthetic
uugaacuugcagcucag

SEQ ID NO: 5362 - RNA, 20 nt, Artificial Sequence
  Synthetic
uugcuugcggcgagacaugg

SEQ ID NO: 5363 - RNA, 17 nt, Artificial Sequence
  Synthetic
uugugggagagccguca

SEQ ID NO: 5364 - RNA, 20 nt, Artificial Sequence
  Synthetic
uuuuagaguccgcgugugug

SEQ ID NO: 5365-6364 - skipped (1000 entries)

SEQ ID NO: 6365 - RNA, 20 nt, Artificial Sequence
  Synthetic
gacgacggcucgguucacau

SEQ ID NO: 6366 - RNA, 17 nt, Artificial Sequence
  Synthetic
gacggcucgguucacau

SEQ ID NO: 6367 - RNA, 20 nt, Artificial Sequence
  Synthetic
gacggcucgguucacaucgg

SEQ ID NO: 6368 - RNA, 20 nt, Artificial Sequence
  Synthetic
gacgugacgucccugcgaac

SEQ ID NO: 6369 - RNA, 17 nt, Artificial Sequence
  Synthetic
gcggacgugacgucccu

SEQ ID NO: 6370 - RNA, 20 nt, Artificial Sequence
  Synthetic
ggacgacggcucgguucaca

SEQ ID NO: 6371 - RNA, 17 nt, Artificial Sequence
  Synthetic
ggacgucacguccgcac

SEQ ID NO: 6372 - RNA, 17 nt, Artificial Sequence
  Synthetic
ggcucgguucacaucgg

SEQ ID NO: 6373 - RNA, 17 nt, Artificial Sequence
  Synthetic
ggcucucccgaugugaa

SEQ ID NO: 6374 - RNA, 17 nt, Artificial Sequence
  Synthetic
gguucacaucgggagag

SEQ ID NO: 6375 - RNA, 20 nt, Artificial Sequence
  Synthetic
gucccugcgaacuugaacgu

SEQ ID NO: 6376 - RNA, 17 nt, Artificial Sequence
  Synthetic
gugacgucccugcgaac

SEQ ID NO: 6377 - RNA, 20 nt, Artificial Sequence
  Synthetic
acgacggcucgguucacauc

SEQ ID NO: 6378 - RNA, 17 nt, Artificial Sequence
  Synthetic
acgagagcgcgcaggac

SEQ ID NO: 6379 - RNA, 17 nt, Artificial Sequence
  Synthetic
acggcucgguucacauc

SEQ ID NO: 6380 - RNA, 20 nt, Artificial Sequence
  Synthetic
agugcggacgugacgucccu

SEQ ID NO: 6381 - RNA, 20 nt, Artificial Sequence
  Synthetic
aucacgagagcgcgcaggac

SEQ ID NO: 6382 - RNA, 20 nt, Artificial Sequence
  Synthetic
cagggacgucacguccgcac

SEQ ID NO: 6383 - RNA, 17 nt, Artificial Sequence
  Synthetic
caucgggagagccgggu

SEQ ID NO: 6384 - RNA, 20 nt, Artificial Sequence
  Synthetic
cccggcucucccgaugugaa

SEQ ID NO: 6385 - RNA, 17 nt, Artificial Sequence
  Synthetic
ccugcgaacuugaacgu

SEQ ID NO: 6386 - RNA, 17 nt, Artificial Sequence
  Synthetic
cgacggcucgguucaca

SEQ ID NO: 6387 - RNA, 20 nt, Artificial Sequence
  Synthetic
cucgguucacaucgggagag

SEQ ID NO: 6388 - RNA, 17 nt, Artificial Sequence
  Synthetic
cugcgaacuugaacguc

SEQ ID NO: 6389 - RNA, 20 nt, Artificial Sequence
  Synthetic
ucacaucgggagagccgggu

SEQ ID NO: 6390 - RNA, 20 nt, Artificial Sequence
  Synthetic
ucccugcgaacuugaacguc

SEQ ID NO: 6391 - RNA, 20 nt, Artificial Sequence
  Synthetic
gaaaaaacccucaucccauc

SEQ ID NO: 6392 - RNA, 17 nt, Artificial Sequence
  Synthetic
gaaagaaggagacucca

SEQ ID NO: 6393 - RNA, 17 nt, Artificial Sequence
  Synthetic
gaaagggguggcagggg

SEQ ID NO: 6394 - RNA, 20 nt, Artificial Sequence
  Synthetic
gaaagggguggcaggggugg

SEQ ID NO: 6395 - RNA, 20 nt, Artificial Sequence
  Synthetic
gaaauaauacaaagauggcg

SEQ ID NO: 6396 - RNA, 17 nt, Artificial Sequence
  Synthetic
gaacgucaggagucugg

SEQ ID NO: 6397 - RNA, 20 nt, Artificial Sequence
  Synthetic
gaagaaagggguggcagggg

SEQ ID NO: 6398 - RNA, 17 nt, Artificial Sequence
  Synthetic
gaagagagauagaggga

SEQ ID NO: 6399 - RNA, 17 nt, Artificial Sequence
  Synthetic
gaagcaaaagcgagggg

SEQ ID NO: 6400 - RNA, 17 nt, Artificial Sequence
  Synthetic
gaaggggaggagggaag

SEQ ID NO: 6401 - RNA, 20 nt, Artificial Sequence
  Synthetic
gacaagccaauggccagugc

SEQ ID NO: 6402 - RNA, 17 nt, Artificial Sequence
  Synthetic
gacacacaaaacauggg

SEQ ID NO: 6403 - RNA, 17 nt, Artificial Sequence
  Synthetic
gacgccagacgcggccc

SEQ ID NO: 6404 - RNA, 20 nt, Artificial Sequence
  Synthetic
gacgccagacgcggcccccg

SEQ ID NO: 6405 - RNA, 17 nt, Artificial Sequence
  Synthetic
gacgcggcccccggggg

SEQ ID NO: 6406 - RNA, 17 nt, Artificial Sequence
  Synthetic
gacuagaagcaaaagcg

SEQ ID NO: 6407 - RNA, 20 nt, Artificial Sequence
  Synthetic
gacuagaagcaaaagcgagg

SEQ ID NO: 6408 - RNA, 20 nt, Artificial Sequence
  Synthetic
gacucucggagguuuuucuc

SEQ ID NO: 6409 - RNA, 17 nt, Artificial Sequence
  Synthetic
gagaagaaagggguggc

SEQ ID NO: 6410 - RNA, 17 nt, Artificial Sequence
  Synthetic
gagaagagagauagagg

SEQ ID NO: 6411 - RNA, 17 nt, Artificial Sequence
  Synthetic
gagaaggggaggaggga

SEQ ID NO: 6412 - RNA, 20 nt, Artificial Sequence
  Synthetic
gagacauggugggcugcggg

SEQ ID NO: 6413 - RNA, 17 nt, Artificial Sequence
  Synthetic
gagagaagagagauaga

SEQ ID NO: 6414 - RNA, 20 nt, Artificial Sequence
  Synthetic
gagagaaggggaggagggaa

SEQ ID NO: 6415 - RNA, 17 nt, Artificial Sequence
  Synthetic
gagagagaagagagaua

SEQ ID NO: 6416 - RNA, 17 nt, Artificial Sequence
  Synthetic
gagagagagaagagaga

SEQ ID NO: 6417 - RNA, 20 nt, Artificial Sequence
  Synthetic
gagagagagaagagagauag

SEQ ID NO: 6418 - RNA, 17 nt, Artificial Sequence
  Synthetic
gagagagagagagagag

SEQ ID NO: 6419 - RNA, 20 nt, Artificial Sequence
  Synthetic
gagagauagagggagagaga

SEQ ID NO: 6420 - RNA, 20 nt, Artificial Sequence
  Synthetic
gagauagagggagagagaga

SEQ ID NO: 6421 - RNA, 17 nt, Artificial Sequence
  Synthetic
gagcaggagagaagggg

SEQ ID NO: 6422 - RNA, 20 nt, Artificial Sequence
  Synthetic
gagcaggagagaaggggagg

SEQ ID NO: 6423 - RNA, 17 nt, Artificial Sequence
  Synthetic
gagccggguuagaaaga

SEQ ID NO: 6424 - RNA, 17 nt, Artificial Sequence
  Synthetic
gagcugcaaguucaagu

SEQ ID NO: 6425 - RNA, 17 nt, Artificial Sequence
  Synthetic
gagggagagagagagaa

SEQ ID NO: 6426 - RNA, 17 nt, Artificial Sequence
  Synthetic
gaggggcgggccgaggg

SEQ ID NO: 6427 - RNA, 17 nt, Artificial Sequence
  Synthetic
gagggggaggugcgggg

SEQ ID NO: 6428 - RNA, 17 nt, Artificial Sequence
  Synthetic
gagggggcgcuggggcc

SEQ ID NO: 6429 - RNA, 17 nt, Artificial Sequence
  Synthetic
gagguaaaagagauaaa

SEQ ID NO: 6430 - RNA, 17 nt, Artificial Sequence
  Synthetic
gaguccgcguguguggg

SEQ ID NO: 6431 - RNA, 20 nt, Artificial Sequence
  Synthetic
gagucgagguaaaagagaua

SEQ ID NO: 6432 - RNA, 20 nt, Artificial Sequence
  Synthetic
gauagagggagagagagaga

SEQ ID NO: 6433 - RNA, 17 nt, Artificial Sequence
  Synthetic
gaugaagauauuuucuc

SEQ ID NO: 6434 - RNA, 17 nt, Artificial Sequence
  Synthetic
gaugucaaaaggcacug

SEQ ID NO: 6435 - RNA, 17 nt, Artificial Sequence
  Synthetic
gauguguguccauuggu

SEQ ID NO: 6436 - RNA, 20 nt, Artificial Sequence
  Synthetic
gcaaugguuccagaugggau

SEQ ID NO: 6437 - RNA, 20 nt, Artificial Sequence
  Synthetic
gcacuugaacuugcagcuca

SEQ ID NO: 6438 - RNA, 20 nt, Artificial Sequence
  Synthetic
gcaggacuagaagcaaaagc

SEQ ID NO: 6439 - RNA, 17 nt, Artificial Sequence
  Synthetic
gcaggagagaaggggag

SEQ ID NO: 6440 - RNA, 17 nt, Artificial Sequence
  Synthetic
gcagggaagaugaauug

SEQ ID NO: 6441 - RNA, 20 nt, Artificial Sequence
  Synthetic
gcagggaagaugaauugugg

SEQ ID NO: 6442 - RNA, 20 nt, Artificial Sequence
  Synthetic
gcagggcgagcaggagagaa

SEQ ID NO: 6443 - RNA, 20 nt, Artificial Sequence
  Synthetic
gcaggggugggaggaaaggg

SEQ ID NO: 6444 - RNA, 17 nt, Artificial Sequence
  Synthetic
gcauuuuuaaauuuuuc

SEQ ID NO: 6445 - RNA, 20 nt, Artificial Sequence
  Synthetic
gccaauggccagugcgggga

SEQ ID NO: 6446 - RNA, 17 nt, Artificial Sequence
  Synthetic
gccagacgcggcccccg

SEQ ID NO: 6447 - RNA, 20 nt, Artificial Sequence
  Synthetic
gccagacgcggcccccgggg

SEQ ID NO: 6448 - RNA, 20 nt, Artificial Sequence
  Synthetic
gcccccgggggaggggcggg

SEQ ID NO: 6449 - RNA, 17 nt, Artificial Sequence
  Synthetic
gccgaggggagggggcg

SEQ ID NO: 6450 - RNA, 20 nt, Artificial Sequence
  Synthetic
gccgcggcgguggcguggcc

SEQ ID NO: 6451 - RNA, 17 nt, Artificial Sequence
  Synthetic
gccgcgucuggcguccg

SEQ ID NO: 6452 - RNA, 17 nt, Artificial Sequence
  Synthetic
gcgagacauggugggcu

SEQ ID NO: 6453 - RNA, 20 nt, Artificial Sequence
  Synthetic
gcgcaggacuagaagcaaaa

SEQ ID NO: 6454 - RNA, 20 nt, Artificial Sequence
  Synthetic
gcgcagggaagaugaauugu

SEQ ID NO: 6455 - RNA, 20 nt, Artificial Sequence
  Synthetic
gcgccgcggcgguggcgugg

SEQ ID NO: 6456 - RNA, 20 nt, Artificial Sequence
  Synthetic
gcggacgccagacgcggccc

SEQ ID NO: 6457 - RNA, 20 nt, Artificial Sequence
  Synthetic
gcggcgagacauggugggcu

SEQ ID NO: 6458 - RNA, 17 nt, Artificial Sequence
  Synthetic
gcggcgguggcguggcc

SEQ ID NO: 6459 - RNA, 17 nt, Artificial Sequence
  Synthetic
gcggggagggggaggug

SEQ ID NO: 6460 - RNA, 17 nt, Artificial Sequence
  Synthetic
gcggggcggggggcucc

SEQ ID NO: 6461 - RNA, 20 nt, Artificial Sequence
  Synthetic
gcguggccgggagagaagaa

SEQ ID NO: 6462 - RNA, 17 nt, Artificial Sequence
  Synthetic
gcgugugugggggggag

SEQ ID NO: 6463 - RNA, 17 nt, Artificial Sequence
  Synthetic
gcucaccaguggccgca

SEQ ID NO: 6464 - RNA, 17 nt, Artificial Sequence
  Synthetic
gcucgcugcggccacug

SEQ ID NO: 6465 - RNA, 20 nt, Artificial Sequence
  Synthetic
gcuggacaugaaaaagagac

SEQ ID NO: 6466 - RNA, 17 nt, Artificial Sequence
  Synthetic
gcuugcggcgagacaug

SEQ ID NO: 6467 - RNA, 20 nt, Artificial Sequence
  Synthetic
ggaaaaaacccucaucccau

SEQ ID NO: 6468 - RNA, 20 nt, Artificial Sequence
  Synthetic
ggaaggggaagcucacacca

SEQ ID NO: 6469 - RNA, 20 nt, Artificial Sequence
  Synthetic
ggacaagccaauggccagug

SEQ ID NO: 6470 - RNA, 17 nt, Artificial Sequence
  Synthetic
ggacaugaaaaagagac

SEQ ID NO: 6471 - RNA, 20 nt, Artificial Sequence
  Synthetic
ggacgccagacgcggccccc

SEQ ID NO: 6472 - RNA, 17 nt, Artificial Sequence
  Synthetic
ggacuagaagcaaaagc

SEQ ID NO: 6473 - RNA, 20 nt, Artificial Sequence
  Synthetic
ggacuagaagcaaaagcgag

SEQ ID NO: 6474 - RNA, 20 nt, Artificial Sequence
  Synthetic
ggagagaagaaagggguggc

SEQ ID NO: 6475 - RNA, 20 nt, Artificial Sequence
  Synthetic
ggagagaaggggaggaggga

SEQ ID NO: 6476 - RNA, 20 nt, Artificial Sequence
  Synthetic
ggagagagagagaagagaga

SEQ ID NO: 6477 - RNA, 20 nt, Artificial Sequence
  Synthetic
ggagagccggguuagaaaga

SEQ ID NO: 6478 - RNA, 20 nt, Artificial Sequence
  Synthetic
ggaggggcgggccgagggga

SEQ ID NO: 6479 - RNA, 17 nt, Artificial Sequence
  Synthetic
ggagggggaggugcggg

SEQ ID NO: 6480 - RNA, 20 nt, Artificial Sequence
  Synthetic
ggagggggaggugcggggcg

SEQ ID NO: 6481 - RNA, 20 nt, Artificial Sequence
  Synthetic
ggcagggcgagcaggagaga

SEQ ID NO: 6482 - RNA, 20 nt, Artificial Sequence
  Synthetic
ggcaggggugggaggaaagg

SEQ ID NO: 6483 - RNA, 17 nt, Artificial Sequence
  Synthetic
ggccgcgucuggcgucc

SEQ ID NO: 6484 - RNA, 17 nt, Artificial Sequence
  Synthetic
ggcgagcaggagagaag

SEQ ID NO: 6485 - RNA, 20 nt, Artificial Sequence
  Synthetic
ggcgagcaggagagaagggg

SEQ ID NO: 6486 - RNA, 20 nt, Artificial Sequence
  Synthetic
ggcgcagggaagaugaauug

SEQ ID NO: 6487 - RNA, 20 nt, Artificial Sequence
  Synthetic
ggcgcucgcugcggccacug

SEQ ID NO: 6488 - RNA, 17 nt, Artificial Sequence
  Synthetic
ggcggcggcggcggcgg

SEQ ID NO: 6489 - RNA, 20 nt, Artificial Sequence
  Synthetic
ggcggcggcggcggcggcgg

SEQ ID NO: 6490 - RNA, 17 nt, Artificial Sequence
  Synthetic
ggcgguggcguggccgg

SEQ ID NO: 6491 - RNA, 20 nt, Artificial Sequence
  Synthetic
ggcguggccgggagagaaga

SEQ ID NO: 6492 - RNA, 17 nt, Artificial Sequence
  Synthetic
gggaagaugaauugugg

SEQ ID NO: 6493 - RNA, 20 nt, Artificial Sequence
  Synthetic
gggagagaagaaaggggugg

SEQ ID NO: 6494 - RNA, 17 nt, Artificial Sequence
  Synthetic
gggagagccggguuaga

SEQ ID NO: 6495 - RNA, 20 nt, Artificial Sequence
  Synthetic
gggagagccggguuagaaag

SEQ ID NO: 6496 - RNA, 17 nt, Artificial Sequence
  Synthetic
gggaggaaagggugggg

SEQ ID NO: 6497 - RNA, 17 nt, Artificial Sequence
  Synthetic
gggaggggcgggccgag

SEQ ID NO: 6498 - RNA, 20 nt, Artificial Sequence
  Synthetic
gggaggggcgggccgagggg

SEQ ID NO: 6499 - RNA, 20 nt, Artificial Sequence
  Synthetic
gggagggggaggugcggggc

SEQ ID NO: 6500 - RNA, 17 nt, Artificial Sequence
  Synthetic
gggcagggcgagcagga

SEQ ID NO: 6501 - RNA, 20 nt, Artificial Sequence
  Synthetic
gggcagggcgagcaggagag

SEQ ID NO: 6502 - RNA, 20 nt, Artificial Sequence
  Synthetic
gggccgaggggagggggcgc

SEQ ID NO: 6503 - RNA, 17 nt, Artificial Sequence
  Synthetic
gggcgagcaggagagaa

SEQ ID NO: 6504 - RNA, 20 nt, Artificial Sequence
  Synthetic
gggcgagcaggagagaaggg

SEQ ID NO: 6505 - RNA, 17 nt, Artificial Sequence
  Synthetic
ggggaggggcgggccga

SEQ ID NO: 6506 - RNA, 20 nt, Artificial Sequence
  Synthetic
ggggaggggcgggccgaggg

SEQ ID NO: 6507 - RNA, 20 nt, Artificial Sequence
  Synthetic
ggggagggggaggugcgggg

SEQ ID NO: 6508 - RNA, 20 nt, Artificial Sequence
  Synthetic
ggggagggggcgcuggggcc

SEQ ID NO: 6509 - RNA, 20 nt, Artificial Sequence
  Synthetic
ggggccgcgucuggcguccg

SEQ ID NO: 6510 - RNA, 17 nt, Artificial Sequence
  Synthetic
ggggcgggccgagggga

SEQ ID NO: 6511 - RNA, 17 nt, Artificial Sequence
  Synthetic
gggggaggggcgggccg

SEQ ID NO: 6512 - RNA, 17 nt, Artificial Sequence
  Synthetic
gggggaggugcggggcg

SEQ ID NO: 6513 - RNA, 20 nt, Artificial Sequence
  Synthetic
gggggccgcgucuggcgucc

SEQ ID NO: 6514 - RNA, 17 nt, Artificial Sequence
  Synthetic
gggguggcagggguggg

SEQ ID NO: 6515 - RNA, 17 nt, Artificial Sequence
  Synthetic
ggggugggaggaaaggg

SEQ ID NO: 6516 - RNA, 20 nt, Artificial Sequence
  Synthetic
ggggugggaggaaagggugg

SEQ ID NO: 6517 - RNA, 20 nt, Artificial Sequence
  Synthetic
ggguggcaggggugggagga

SEQ ID NO: 6518 - RNA, 17 nt, Artificial Sequence
  Synthetic
gggugggaggaaagggu

SEQ ID NO: 6519 - RNA, 20 nt, Artificial Sequence
  Synthetic
gggugggaggaaaggguggg

SEQ ID NO: 6520 - RNA, 17 nt, Artificial Sequence
  Synthetic
gguaaaagagauaaagg

SEQ ID NO: 6521 - RNA, 20 nt, Artificial Sequence
  Synthetic
ggugcggggcggggggcucc

SEQ ID NO: 6522 - RNA, 17 nt, Artificial Sequence
  Synthetic
ggugggaggaaagggug

SEQ ID NO: 6523 - RNA, 20 nt, Artificial Sequence
  Synthetic
ggugggaggaaagggugggg

SEQ ID NO: 6524 - RNA, 20 nt, Artificial Sequence
  Synthetic
gguuagaaagaaggagacuc

SEQ ID NO: 6525 - RNA, 17 nt, Artificial Sequence
  Synthetic
gguuugccuugcuugcg

SEQ ID NO: 6526 - RNA, 20 nt, Artificial Sequence
  Synthetic
gucgagguaaaagagauaaa

SEQ ID NO: 6527 - RNA, 17 nt, Artificial Sequence
  Synthetic
guggccgggagagaaga

SEQ ID NO: 6528 - RNA, 17 nt, Artificial Sequence
  Synthetic
gugggaggaaagggugg

SEQ ID NO: 6529 - RNA, 17 nt, Artificial Sequence
  Synthetic
aaaaaaaaaaaaaaaaa

SEQ ID NO: 6530 - RNA, 20 nt, Artificial Sequence
  Synthetic
aaaaaaaaaaaaaaaaaaaa

SEQ ID NO: 6531 - RNA, 20 nt, Artificial Sequence
  Synthetic
aaaaaaaaaaaaaaaaaaag

SEQ ID NO: 6532 - RNA, 20 nt, Artificial Sequence
  Synthetic
aaaaaaaaaaaaaaaaaaga

SEQ ID NO: 6533 - RNA, 17 nt, Artificial Sequence
  Synthetic
aaaaaaaaaaaaaaaag

SEQ ID NO: 6534 - RNA, 20 nt, Artificial Sequence
  Synthetic
aaaaaaaaaaaaaaaagagg

SEQ ID NO: 6535 - RNA, 17 nt, Artificial Sequence
  Synthetic
aaaaaaaaaaaaaaaga

SEQ ID NO: 6536 - RNA, 20 nt, Artificial Sequence
  Synthetic
aaaaaaaaaaaaaagaggga

SEQ ID NO: 6537 - RNA, 17 nt, Artificial Sequence
  Synthetic
aaaaaaaaaaaaagagg

SEQ ID NO: 6538 - RNA, 20 nt, Artificial Sequence
  Synthetic
aaaaaaaaaaaagagggaga

SEQ ID NO: 6539 - RNA, 17 nt, Artificial Sequence
  Synthetic
aaaaaaaaaaagaggga

SEQ ID NO: 6540 - RNA, 20 nt, Artificial Sequence
  Synthetic
aaaaaaaaaagagggagaga

SEQ ID NO: 6541 - RNA, 17 nt, Artificial Sequence
  Synthetic
aaaaaaaaagagggaga

SEQ ID NO: 6542 - RNA, 20 nt, Artificial Sequence
  Synthetic
aaaaaaaagagggagagaga

SEQ ID NO: 6543 - RNA, 17 nt, Artificial Sequence
  Synthetic
aaaaaaagagggagaga

SEQ ID NO: 6544 - RNA, 20 nt, Artificial Sequence
  Synthetic
aaaaaauggcaaaagccccc

SEQ ID NO: 6545 - RNA, 17 nt, Artificial Sequence
  Synthetic
aaaaacccucaucccau

SEQ ID NO: 6546 - RNA, 17 nt, Artificial Sequence
  Synthetic
aaaaagagggagagaga

SEQ ID NO: 6547 - RNA, 20 nt, Artificial Sequence
  Synthetic
aaaaagagggagagagagag

SEQ ID NO: 6548 - RNA, 20 nt, Artificial Sequence
  Synthetic
aaaacaugggcagggcgagc

SEQ ID NO: 6549 - RNA, 17 nt, Artificial Sequence
  Synthetic
aaaacccucaucccauc

SEQ ID NO: 6550 - RNA, 17 nt, Artificial Sequence
  Synthetic
aaaagcgagggggagag

SEQ ID NO: 6551 - RNA, 20 nt, Artificial Sequence
  Synthetic
aaaccccagcacuuaagcaa

SEQ ID NO: 6552 - RNA, 20 nt, Artificial Sequence
  Synthetic
aaagagggagagagagagaa

SEQ ID NO: 6553 - RNA, 17 nt, Artificial Sequence
  Synthetic
aaagggguggcaggggu

SEQ ID NO: 6554 - RNA, 20 nt, Artificial Sequence
  Synthetic
aaagggguggcagggguggg

SEQ ID NO: 6555 - RNA, 20 nt, Artificial Sequence
  Synthetic
aaauaauacaaagauggcgc

SEQ ID NO: 6556 - RNA, 17 nt, Artificial Sequence
  Synthetic
aaauggcaaaagccccc

SEQ ID NO: 6557 - RNA, 17 nt, Artificial Sequence
  Synthetic
aacaugggcagggcgag

SEQ ID NO: 6558 - RNA, 20 nt, Artificial Sequence
  Synthetic
aacaugggcagggcgagcag

SEQ ID NO: 6559 - RNA, 20 nt, Artificial Sequence
  Synthetic
aaccccagcacuuaagcaaa

SEQ ID NO: 6560 - RNA, 17 nt, Artificial Sequence
  Synthetic
aacccggcucucccgau

SEQ ID NO: 6561 - RNA, 20 nt, Artificial Sequence
  Synthetic
aagaaagggguggcaggggu

SEQ ID NO: 6562 - RNA, 20 nt, Artificial Sequence
  Synthetic
aagagagauagagggagaga

SEQ ID NO: 6563 - RNA, 17 nt, Artificial Sequence
  Synthetic
aagagggagagagagag

SEQ ID NO: 6564 - RNA, 17 nt, Artificial Sequence
  Synthetic
aagauggcgcagggaag

SEQ ID NO: 6565 - RNA, 20 nt, Artificial Sequence
  Synthetic
aagcaaaagcgagggggaga

SEQ ID NO: 6566 - RNA, 17 nt, Artificial Sequence
  Synthetic
aagccaauggccagugc

SEQ ID NO: 6567 - RNA, 20 nt, Artificial Sequence
  Synthetic
aagccaauggccagugcggg

SEQ ID NO: 6568 - RNA, 20 nt, Artificial Sequence
  Synthetic
aauaauaauuauuaauaauc

SEQ ID NO: 6569 - RNA, 20 nt, Artificial Sequence
  Synthetic
aauaauacaaagauggcgca

SEQ ID NO: 6570 - RNA, 17 nt, Artificial Sequence
  Synthetic
aauaauuauuaauaauc

SEQ ID NO: 6571 - RNA, 20 nt, Artificial Sequence
  Synthetic
aauaauuauuauuacuauua

SEQ ID NO: 6572 - RNA, 17 nt, Artificial Sequence
  Synthetic
aauacaaagauggcgca

SEQ ID NO: 6573 - RNA, 17 nt, Artificial Sequence
  Synthetic
aauggccagugcgggga

SEQ ID NO: 6574 - RNA, 17 nt, Artificial Sequence
  Synthetic
aauuauuauuacuauua

SEQ ID NO: 6575 - RNA, 20 nt, Artificial Sequence
  Synthetic
aauucccguuugcuuaagug

SEQ ID NO: 6576 - RNA, 20 nt, Artificial Sequence
  Synthetic
acaaagauggcgcagggaag

SEQ ID NO: 6577 - RNA, 17 nt, Artificial Sequence
  Synthetic
acaagccaauggccagu

SEQ ID NO: 6578 - RNA, 20 nt, Artificial Sequence
  Synthetic
acaagccaauggccagugcg

SEQ ID NO: 6579 - RNA, 20 nt, Artificial Sequence
  Synthetic
acacacaaaacaugggcagg

SEQ ID NO: 6580 - RNA, 20 nt, Artificial Sequence
  Synthetic
acacacaucaggggcuggac

SEQ ID NO: 6581 - RNA, 17 nt, Artificial Sequence
  Synthetic
acagagacacacaaaac

SEQ ID NO: 6582 - RNA, 17 nt, Artificial Sequence
  Synthetic
acaugggcagggcgagc

SEQ ID NO: 6583 - RNA, 17 nt, Artificial Sequence
  Synthetic
acauggugggcugcggg

SEQ ID NO: 6584 - RNA, 17 nt, Artificial Sequence
  Synthetic
accaauggacacacauc

SEQ ID NO: 6585 - RNA, 20 nt, Artificial Sequence
  Synthetic
accccagcacuuaagcaaac

SEQ ID NO: 6586 - RNA, 20 nt, Artificial Sequence
  Synthetic
accuccgagagucgagguaa

SEQ ID NO: 6587 - RNA, 20 nt, Artificial Sequence
  Synthetic
acgagaaaaaccuccgagag

SEQ ID NO: 6588 - RNA, 17 nt, Artificial Sequence
  Synthetic
acgccagacgcggcccc

SEQ ID NO: 6589 - RNA, 20 nt, Artificial Sequence
  Synthetic
acgccagacgcggcccccgg

SEQ ID NO: 6590 - RNA, 20 nt, Artificial Sequence
  Synthetic
acgcggcccccgggggaggg

SEQ ID NO: 6591 - RNA, 17 nt, Artificial Sequence
  Synthetic
acggcaaugguuccaga

SEQ ID NO: 6592 - RNA, 20 nt, Artificial Sequence
  Synthetic
acgucaggagucuggaugga

SEQ ID NO: 6593 - RNA, 17 nt, Artificial Sequence
  Synthetic
acuagaagcaaaagcga

SEQ ID NO: 6594 - RNA, 20 nt, Artificial Sequence
  Synthetic
acuauuauuggguuacuuac

SEQ ID NO: 6595 - RNA, 20 nt, Artificial Sequence
  Synthetic
acuccugacguucaaguucg

SEQ ID NO: 6596 - RNA, 20 nt, Artificial Sequence
  Synthetic
acugaugaagauauuuucuc

SEQ ID NO: 6597 - RNA, 17 nt, Artificial Sequence
  Synthetic
acuugaacgucaggagu

SEQ ID NO: 6598 - RNA, 17 nt, Artificial Sequence
  Synthetic
acuugaacuugcagcuc

SEQ ID NO: 6599 - RNA, 17 nt, Artificial Sequence
  Synthetic
agaaaaaccuccgagag

SEQ ID NO: 6600 - RNA, 17 nt, Artificial Sequence
  Synthetic
agaaagggguggcaggg

SEQ ID NO: 6601 - RNA, 20 nt, Artificial Sequence
  Synthetic
agaagaaagggguggcaggg

SEQ ID NO: 6602 - RNA, 20 nt, Artificial Sequence
  Synthetic
agaagagagauagagggaga

SEQ ID NO: 6603 - RNA, 20 nt, Artificial Sequence
  Synthetic
agaagcaaaagcgaggggga

SEQ ID NO: 6604 - RNA, 17 nt, Artificial Sequence
  Synthetic
agaaggggaggagggaa

SEQ ID NO: 6605 - RNA, 17 nt, Artificial Sequence
  Synthetic
agacgcggcccccgggg

SEQ ID NO: 6606 - RNA, 17 nt, Artificial Sequence
  Synthetic
agagaagaaaggggugg

SEQ ID NO: 6607 - RNA, 20 nt, Artificial Sequence
  Synthetic
agagaagagagauagaggga

SEQ ID NO: 6608 - RNA, 17 nt, Artificial Sequence
  Synthetic
agagaaggggaggaggg

SEQ ID NO: 6609 - RNA, 20 nt, Artificial Sequence
  Synthetic
agagaaggggaggagggaag

SEQ ID NO: 6610 - RNA, 20 nt, Artificial Sequence
  Synthetic
agagacacacaaaacauggg

SEQ ID NO: 6611 - RNA, 17 nt, Artificial Sequence
  Synthetic
agagagaagagagauag

SEQ ID NO: 6612 - RNA, 20 nt, Artificial Sequence
  Synthetic
agagagaagagagauagagg

SEQ ID NO: 6613 - RNA, 20 nt, Artificial Sequence
  Synthetic
agagagagaagagagauaga

SEQ ID NO: 6614 - RNA, 20 nt, Artificial Sequence
  Synthetic
agagagagagaagagagaua

SEQ ID NO: 6615 - RNA, 17 nt, Artificial Sequence
  Synthetic
agagagauagagggaga

SEQ ID NO: 6616 - RNA, 17 nt, Artificial Sequence
  Synthetic
agagauagagggagaga

SEQ ID NO: 6617 - RNA, 17 nt, Artificial Sequence
  Synthetic
agagccggguuagaaag

SEQ ID NO: 6618 - RNA, 17 nt, Artificial Sequence
  Synthetic
agagggagagagagaga

SEQ ID NO: 6619 - RNA, 17 nt, Artificial Sequence
  Synthetic
agaguccgcgugugugg

SEQ ID NO: 6620 - RNA, 17 nt, Artificial Sequence
  Synthetic
agauagagggagagaga

SEQ ID NO: 6621 - RNA, 17 nt, Artificial Sequence
  Synthetic
agcaaaagcgaggggga

SEQ ID NO: 6622 - RNA, 20 nt, Artificial Sequence
  Synthetic
agcaaaagcgagggggagag

SEQ ID NO: 6623 - RNA, 20 nt, Artificial Sequence
  Synthetic
agcaggagagaaggggagga

SEQ ID NO: 6624 - RNA, 17 nt, Artificial Sequence
  Synthetic
agccaauggccagugcg

SEQ ID NO: 6625 - RNA, 20 nt, Artificial Sequence
  Synthetic
agccaauggccagugcgggg

SEQ ID NO: 6626 - RNA, 20 nt, Artificial Sequence
  Synthetic
aggacaagccaauggccagu

SEQ ID NO: 6627 - RNA, 20 nt, Artificial Sequence
  Synthetic
aggacuagaagcaaaagcga

SEQ ID NO: 6628 - RNA, 17 nt, Artificial Sequence
  Synthetic
aggagagaaggggagga

SEQ ID NO: 6629 - RNA, 20 nt, Artificial Sequence
  Synthetic
aggagagaaggggaggaggg

SEQ ID NO: 6630 - RNA, 20 nt, Artificial Sequence
  Synthetic
agggagagagagagagagag

SEQ ID NO: 6631 - RNA, 17 nt, Artificial Sequence
  Synthetic
agggcgagcaggagaga

SEQ ID NO: 6632 - RNA, 17 nt, Artificial Sequence
  Synthetic
aggggaagcucacacca

SEQ ID NO: 6633 - RNA, 17 nt, Artificial Sequence
  Synthetic
aggggcgggccgagggg

SEQ ID NO: 6634 - RNA, 17 nt, Artificial Sequence
  Synthetic
aggggcuggacaugaaa

SEQ ID NO: 6635 - RNA, 17 nt, Artificial Sequence
  Synthetic
agggggaggugcggggc

SEQ ID NO: 6636 - RNA, 17 nt, Artificial Sequence
  Synthetic
agggguggcaggggugg

SEQ ID NO: 6637 - RNA, 17 nt, Artificial Sequence
  Synthetic
aggggugggaggaaagg

SEQ ID NO: 6638 - RNA, 20 nt, Artificial Sequence
  Synthetic
aggggugggaggaaagggug

SEQ ID NO: 6639 - RNA, 17 nt, Artificial Sequence
  Synthetic
agguaaaagagauaaag

SEQ ID NO: 6640 - RNA, 17 nt, Artificial Sequence
  Synthetic
aguccgcgugugugggg

SEQ ID NO: 6641 - RNA, 20 nt, Artificial Sequence
  Synthetic
agucgagguaaaagagauaa

SEQ ID NO: 6642 - RNA, 20 nt, Artificial Sequence
  Synthetic
agugcggggagggggaggug

SEQ ID NO: 6643 - RNA, 17 nt, Artificial Sequence
  Synthetic
auaauacaaagauggcg

SEQ ID NO: 6644 - RNA, 17 nt, Artificial Sequence
  Synthetic
auaaucacgagagcgcg

SEQ ID NO: 6645 - RNA, 20 nt, Artificial Sequence
  Synthetic
auacacggcaaugguuccag

SEQ ID NO: 6646 - RNA, 17 nt, Artificial Sequence
  Synthetic
auagagggagagagaga

SEQ ID NO: 6647 - RNA, 20 nt, Artificial Sequence
  Synthetic
aucaggggcuggacaugaaa

SEQ ID NO: 6648 - RNA, 20 nt, Artificial Sequence
  Synthetic
aucgggagagccggguuaga

SEQ ID NO: 6649 - RNA, 20 nt, Artificial Sequence
  Synthetic
aucucuuuuaccucgacucu

SEQ ID NO: 6650 - RNA, 17 nt, Artificial Sequence
  Synthetic
auggccagugcggggag

SEQ ID NO: 6651 - RNA, 17 nt, Artificial Sequence
  Synthetic
augggcagggcgagcag

SEQ ID NO: 6652 - RNA, 17 nt, Artificial Sequence
  Synthetic
augguuccagaugggau

SEQ ID NO: 6653 - RNA, 17 nt, Artificial Sequence
  Synthetic
auuauuggguuacuuac

SEQ ID NO: 6654 - RNA, 17 nt, Artificial Sequence
  Synthetic
auuauuucuaauuuauu

SEQ ID NO: 6655 - RNA, 20 nt, Artificial Sequence
  Synthetic
auucccguuugcuuaagugc

SEQ ID NO: 6656 - RNA, 20 nt, Artificial Sequence
  Synthetic
auuuuagaguccgcgugugu

SEQ ID NO: 6657 - RNA, 17 nt, Artificial Sequence
  Synthetic
auuuuuaaauuuuucac

SEQ ID NO: 6658 - RNA, 20 nt, Artificial Sequence
  Synthetic
auuuuucacgagaaaaaccu

SEQ ID NO: 6659 - RNA, 20 nt, Artificial Sequence
  Synthetic
caaaacaugggcagggcgag

SEQ ID NO: 6660 - RNA, 17 nt, Artificial Sequence
  Synthetic
caaaagcgagggggaga

SEQ ID NO: 6661 - RNA, 17 nt, Artificial Sequence
  Synthetic
caagccaauggccagug

SEQ ID NO: 6662 - RNA, 20 nt, Artificial Sequence
  Synthetic
caauggacacacaucagggg

SEQ ID NO: 6663 - RNA, 17 nt, Artificial Sequence
  Synthetic
caauggccagugcgggg

SEQ ID NO: 6664 - RNA, 20 nt, Artificial Sequence
  Synthetic
caauggccagugcggggagg

SEQ ID NO: 6665 - RNA, 17 nt, Artificial Sequence
  Synthetic
caaugguuccagauggg

SEQ ID NO: 6666 - RNA, 17 nt, Artificial Sequence
  Synthetic
cacaaaacaugggcagg

SEQ ID NO: 6667 - RNA, 20 nt, Artificial Sequence
  Synthetic
cacaccaauggacacacauc

SEQ ID NO: 6668 - RNA, 17 nt, Artificial Sequence
  Synthetic
cacacgcggacucuaaa

SEQ ID NO: 6669 - RNA, 17 nt, Artificial Sequence
  Synthetic
cacaucaggggcuggac

SEQ ID NO: 6670 - RNA, 17 nt, Artificial Sequence
  Synthetic
caccaauggacacacau

SEQ ID NO: 6671 - RNA, 17 nt, Artificial Sequence
  Synthetic
cacggcaaugguuccag

SEQ ID NO: 6672 - RNA, 20 nt, Artificial Sequence
  Synthetic
cacugaugaagauauuuucu

SEQ ID NO: 6673 - RNA, 17 nt, Artificial Sequence
  Synthetic
cacuugaacuugcagcu

SEQ ID NO: 6674 - RNA, 20 nt, Artificial Sequence
  Synthetic
cacuugaacuugcagcucag

SEQ ID NO: 6675 - RNA, 17 nt, Artificial Sequence
  Synthetic
caggacuagaagcaaaa

SEQ ID NO: 6676 - RNA, 20 nt, Artificial Sequence
  Synthetic
caggacuagaagcaaaagcg

SEQ ID NO: 6677 - RNA, 17 nt, Artificial Sequence
  Synthetic
caggagagaaggggagg

SEQ ID NO: 6678 - RNA, 17 nt, Artificial Sequence
  Synthetic
cagggaagaugaauugu

SEQ ID NO: 6679 - RNA, 17 nt, Artificial Sequence
  Synthetic
cagggcgagcaggagag

SEQ ID NO: 6680 - RNA, 20 nt, Artificial Sequence
  Synthetic
cagggcgagcaggagagaag

SEQ ID NO: 6681 - RNA, 20 nt, Artificial Sequence
  Synthetic
caggggugggaggaaagggu

SEQ ID NO: 6682 - RNA, 20 nt, Artificial Sequence
  Synthetic
cagugcggggagggggaggu

SEQ ID NO: 6683 - RNA, 20 nt, Artificial Sequence
  Synthetic
caugcauuuuuaaauuuuuc

SEQ ID NO: 6684 - RNA, 20 nt, Artificial Sequence
  Synthetic
caugggcagggcgagcagga

SEQ ID NO: 6685 - RNA, 20 nt, Artificial Sequence
  Synthetic
cauuuuagaguccgcgugug

SEQ ID NO: 6686 - RNA, 17 nt, Artificial Sequence
  Synthetic
ccaauggccagugcggg

SEQ ID NO: 6687 - RNA, 20 nt, Artificial Sequence
  Synthetic
ccaauggccagugcggggag

SEQ ID NO: 6688 - RNA, 20 nt, Artificial Sequence
  Synthetic
ccacacacgcggacucuaaa

SEQ ID NO: 6689 - RNA, 17 nt, Artificial Sequence
  Synthetic
ccagacgcggcccccgg

SEQ ID NO: 6690 - RNA, 20 nt, Artificial Sequence
  Synthetic
ccagacgcggcccccggggg

SEQ ID NO: 6691 - RNA, 17 nt, Artificial Sequence
  Synthetic
ccagcacuuaagcaaac

SEQ ID NO: 6692 - RNA, 20 nt, Artificial Sequence
  Synthetic
ccauugccguguaugcacuu

SEQ ID NO: 6693 - RNA, 17 nt, Artificial Sequence
  Synthetic
cccagcacuuaagcaaa

SEQ ID NO: 6694 - RNA, 17 nt, Artificial Sequence
  Synthetic
ccccagcacuuaagcaa

SEQ ID NO: 6695 - RNA, 20 nt, Artificial Sequence
  Synthetic
ccccgggggaggggcgggcc

SEQ ID NO: 6696 - RNA, 20 nt, Artificial Sequence
  Synthetic
ccccucggcccgccccuccc

SEQ ID NO: 6697 - RNA, 17 nt, Artificial Sequence
  Synthetic
cccgggggaggggcggg

SEQ ID NO: 6698 - RNA, 20 nt, Artificial Sequence
  Synthetic
cccgggggaggggcgggccg

SEQ ID NO: 6699 - RNA, 17 nt, Artificial Sequence
  Synthetic
cccguuugcuuaagugc

SEQ ID NO: 6700 - RNA, 20 nt, Artificial Sequence
  Synthetic
cccucggcccgccccucccc

SEQ ID NO: 6701 - RNA, 20 nt, Artificial Sequence
  Synthetic
cccugcucccccccacacac

SEQ ID NO: 6702 - RNA, 17 nt, Artificial Sequence
  Synthetic
ccgaggggagggggcgc

SEQ ID NO: 6703 - RNA, 20 nt, Artificial Sequence
  Synthetic
ccgcacuugaacuugcagcu

SEQ ID NO: 6704 - RNA, 17 nt, Artificial Sequence
  Synthetic
ccgcggcgguggcgugg

SEQ ID NO: 6705 - RNA, 20 nt, Artificial Sequence
  Synthetic
ccgggggaggggcgggccga

SEQ ID NO: 6706 - RNA, 20 nt, Artificial Sequence
  Synthetic
ccucggcccgccccuccccc

SEQ ID NO: 6707 - RNA, 17 nt, Artificial Sequence
  Synthetic
ccugacguucaaguucg

SEQ ID NO: 6708 - RNA, 20 nt, Artificial Sequence
  Synthetic
ccugagcugcaaguucaagu

SEQ ID NO: 6709 - RNA, 20 nt, Artificial Sequence
  Synthetic
ccugauguguguccauuggu

SEQ ID NO: 6710 - RNA, 20 nt, Artificial Sequence
  Synthetic
cgaacuugaacgucaggagu

SEQ ID NO: 6711 - RNA, 17 nt, Artificial Sequence
  Synthetic
cgagacauggugggcug

SEQ ID NO: 6712 - RNA, 17 nt, Artificial Sequence
  Synthetic
cgagcaggagagaaggg

SEQ ID NO: 6713 - RNA, 20 nt, Artificial Sequence
  Synthetic
cgagcaggagagaaggggag

SEQ ID NO: 6714 - RNA, 17 nt, Artificial Sequence
  Synthetic
cgagguaaaagagauaa

SEQ ID NO: 6715 - RNA, 20 nt, Artificial Sequence
  Synthetic
cgagguaaaagagauaaagg

SEQ ID NO: 6716 - RNA, 20 nt, Artificial Sequence
  Synthetic
cgcacuugaacuugcagcuc

SEQ ID NO: 6717 - RNA, 17 nt, Artificial Sequence
  Synthetic
cgcagggaagaugaauu

SEQ ID NO: 6718 - RNA, 17 nt, Artificial Sequence
  Synthetic
cgccagacgcggccccc

SEQ ID NO: 6719 - RNA, 20 nt, Artificial Sequence
  Synthetic
cgccgcggcgguggcguggc

SEQ ID NO: 6720 - RNA, 17 nt, Artificial Sequence
  Synthetic
cgcggcgguggcguggc

SEQ ID NO: 6721 - RNA, 20 nt, Artificial Sequence
  Synthetic
cgcggcgguggcguggccgg

SEQ ID NO: 6722 - RNA, 20 nt, Artificial Sequence
  Synthetic
cggacgccagacgcggcccc

SEQ ID NO: 6723 - RNA, 20 nt, Artificial Sequence
  Synthetic
cggcaaugguuccagauggg

SEQ ID NO: 6724 - RNA, 17 nt, Artificial Sequence
  Synthetic
cggcccccgggggaggg

SEQ ID NO: 6725 - RNA, 17 nt, Artificial Sequence
  Synthetic
cggcccgccccuccccc

SEQ ID NO: 6726 - RNA, 20 nt, Artificial Sequence
  Synthetic
cggcgagacauggugggcug

SEQ ID NO: 6727 - RNA, 17 nt, Artificial Sequence
  Synthetic
cggcggcggcggcggcg

SEQ ID NO: 6728 - RNA, 20 nt, Artificial Sequence
  Synthetic
cggcggcggcggcggcggcg

SEQ ID NO: 6729 - RNA, 20 nt, Artificial Sequence
  Synthetic
cggcgguggcguggccggga

SEQ ID NO: 6730 - RNA, 20 nt, Artificial Sequence
  Synthetic
cgggccgaggggagggggcg

SEQ ID NO: 6731 - RNA, 20 nt, Artificial Sequence
  Synthetic
cgggcucaccaguggccgca

SEQ ID NO: 6732 - RNA, 20 nt, Artificial Sequence
  Synthetic
cggggagggggaggugcggg

SEQ ID NO: 6733 - RNA, 17 nt, Artificial Sequence
  Synthetic
cgggggaggggcgggcc

SEQ ID NO: 6734 - RNA, 20 nt, Artificial Sequence
  Synthetic
cgggggaggggcgggccgag

SEQ ID NO: 6735 - RNA, 17 nt, Artificial Sequence
  Synthetic
cgguggcguggccggga

SEQ ID NO: 6736 - RNA, 20 nt, Artificial Sequence
  Synthetic
cgguggcguggccgggagag

SEQ ID NO: 6737 - RNA, 17 nt, Artificial Sequence
  Synthetic
cuagaagcaaaagcgag

SEQ ID NO: 6738 - RNA, 20 nt, Artificial Sequence
  Synthetic
cuagaagcaaaagcgagggg

SEQ ID NO: 6739 - RNA, 20 nt, Artificial Sequence
  Synthetic
cuccugacguucaaguucgc

SEQ ID NO: 6740 - RNA, 17 nt, Artificial Sequence
  Synthetic
cucggcccgccccuccc

SEQ ID NO: 6741 - RNA, 17 nt, Artificial Sequence
  Synthetic
cucuuuuaccucgacuc

SEQ ID NO: 6742 - RNA, 17 nt, Artificial Sequence
  Synthetic
cugacguucaaguucgc

SEQ ID NO: 6743 - RNA, 20 nt, Artificial Sequence
  Synthetic
cuugaacgucaggagucugg

SEQ ID NO: 6744 - RNA, 17 nt, Artificial Sequence
  Synthetic
cuugaacuugcagcuca

SEQ ID NO: 6745 - RNA, 20 nt, Artificial Sequence
  Synthetic
cuugcuugcggcgagacaug

SEQ ID NO: 6746 - RNA, 20 nt, Artificial Sequence
  Synthetic
uaauaauuauuaauaaucac

SEQ ID NO: 6747 - RNA, 17 nt, Artificial Sequence
  Synthetic
uaauacaaagauggcgc

SEQ ID NO: 6748 - RNA, 17 nt, Artificial Sequence
  Synthetic
uaauuauuaauaaucac

SEQ ID NO: 6749 - RNA, 20 nt, Artificial Sequence
  Synthetic
uacacggcaaugguuccaga

SEQ ID NO: 6750 - RNA, 17 nt, Artificial Sequence
  Synthetic
uagaaagaaggagacuc

SEQ ID NO: 6751 - RNA, 17 nt, Artificial Sequence
  Synthetic
uagaagcaaaagcgagg

SEQ ID NO: 6752 - RNA, 17 nt, Artificial Sequence
  Synthetic
uagaguccgcgugugug

SEQ ID NO: 6753 - RNA, 20 nt, Artificial Sequence
  Synthetic
uagaguccgcgugugugggg

SEQ ID NO: 6754 - RNA, 20 nt, Artificial Sequence
  Synthetic
uaucucuuuuaccucgacuc

SEQ ID NO: 6755 - RNA, 20 nt, Artificial Sequence
  Synthetic
uauuauuggguuacuuacgc

SEQ ID NO: 6756 - RNA, 17 nt, Artificial Sequence
  Synthetic
uauuggguuacuuacgc

SEQ ID NO: 6757 - RNA, 20 nt, Artificial Sequence
  Synthetic
ucacaccaauggacacacau

SEQ ID NO: 6758 - RNA, 17 nt, Artificial Sequence
  Synthetic
ucacgagaaaaaccucc

SEQ ID NO: 6759 - RNA, 17 nt, Artificial Sequence
  Synthetic
ucaggagucuggaugga

SEQ ID NO: 6760 - RNA, 20 nt, Artificial Sequence
  Synthetic
ucauuuuagaguccgcgugu

SEQ ID NO: 6761 - RNA, 17 nt, Artificial Sequence
  Synthetic
ucccguuugcuuaagug

SEQ ID NO: 6762 - RNA, 17 nt, Artificial Sequence
  Synthetic
uccgagagucgagguaa

SEQ ID NO: 6763 - RNA, 20 nt, Artificial Sequence
  Synthetic
uccgcgugugugggggggag

SEQ ID NO: 6764 - RNA, 17 nt, Artificial Sequence
  Synthetic
ucgagguaaaagagaua

SEQ ID NO: 6765 - RNA, 20 nt, Artificial Sequence
  Synthetic
ucgagguaaaagagauaaag

SEQ ID NO: 6766 - RNA, 17 nt, Artificial Sequence
  Synthetic
ucggcccgccccucccc

SEQ ID NO: 6767 - RNA, 20 nt, Artificial Sequence
  Synthetic
ucuaacccggcucucccgau

SEQ ID NO: 6768 - RNA, 17 nt, Artificial Sequence
  Synthetic
ucucggagguuuuucuc

SEQ ID NO: 6769 - RNA, 17 nt, Artificial Sequence
  Synthetic
ucuuuuaccucgacucu

SEQ ID NO: 6770 - RNA, 17 nt, Artificial Sequence
  Synthetic
ugacauccaaaauaaau

SEQ ID NO: 6771 - RNA, 17 nt, Artificial Sequence
  Synthetic
ugaugaagauauuuucu

SEQ ID NO: 6772 - RNA, 20 nt, Artificial Sequence
  Synthetic
ugcauuuuuaaauuuuucac

SEQ ID NO: 6773 - RNA, 17 nt, Artificial Sequence
  Synthetic
ugcggggagggggaggu

SEQ ID NO: 6774 - RNA, 17 nt, Artificial Sequence
  Synthetic
ugcucccccccacacac

SEQ ID NO: 6775 - RNA, 17 nt, Artificial Sequence
  Synthetic
uggacacacaucagggg

SEQ ID NO: 6776 - RNA, 20 nt, Artificial Sequence
  Synthetic
uggacagagacacacaaaac

SEQ ID NO: 6777 - RNA, 17 nt, Artificial Sequence
  Synthetic
uggcaggggugggagga

SEQ ID NO: 6778 - RNA, 17 nt, Artificial Sequence
  Synthetic
uggccagugcggggagg

SEQ ID NO: 6779 - RNA, 17 nt, Artificial Sequence
  Synthetic
uggccgggagagaagaa

SEQ ID NO: 6780 - RNA, 20 nt, Artificial Sequence
  Synthetic
uggcgcagggaagaugaauu

SEQ ID NO: 6781 - RNA, 17 nt, Artificial Sequence
  Synthetic
uggcguggccgggagag

SEQ ID NO: 6782 - RNA, 17 nt, Artificial Sequence
  Synthetic
ugggaggaaaggguggg

SEQ ID NO: 6783 - RNA, 20 nt, Artificial Sequence
  Synthetic
ugggguuugccuugcuugcg

SEQ ID NO: 6784 - RNA, 20 nt, Artificial Sequence
  Synthetic
uguauuauuucuaauuuauu

SEQ ID NO: 6785 - RNA, 20 nt, Artificial Sequence
  Synthetic
uuaauaaucacgagagcgcg

SEQ ID NO: 6786 - RNA, 20 nt, Artificial Sequence
  Synthetic
uuagaaagaaggagacucca

SEQ ID NO: 6787 - RNA, 17 nt, Artificial Sequence
  Synthetic
uuagaguccgcgugugu

SEQ ID NO: 6788 - RNA, 20 nt, Artificial Sequence
  Synthetic
uuagaguccgcguguguggg

SEQ ID NO: 6789 - RNA, 17 nt, Artificial Sequence
  Synthetic
uugaacuugcagcucag

SEQ ID NO: 6790 - RNA, 17 nt, Artificial Sequence
  Synthetic
uugccguguaugcacuu

SEQ ID NO: 6791 - RNA, 20 nt, Artificial Sequence
  Synthetic
uuggaugucaaaaggcacug

SEQ ID NO: 6792 - RNA, 17 nt, Artificial Sequence
  Synthetic
uuuagaguccgcgugug

SEQ ID NO: 6793 - RNA, 20 nt, Artificial Sequence
  Synthetic
uuuagaguccgcgugugugg

SEQ ID NO: 6794 - RNA, 17 nt, Artificial Sequence
  Synthetic
uuucacgagaaaaaccu

SEQ ID NO: 6795 - RNA, 17 nt, Artificial Sequence
  Synthetic
uuuuagaguccgcgugu

SEQ ID NO: 6796 - RNA, 20 nt, Artificial Sequence
  Synthetic
uuuuagaguccgcgugugug

SEQ ID NO: 6797 - RNA, 20 nt, Artificial Sequence
  Synthetic
uuuucacgagaaaaaccucc

SEQ ID NO: 6798 - RNA, 20 nt, Artificial Sequence
  Synthetic
uuuugacauccaaaauaaau

SEQ ID NO: 6799 - RNA, 20 nt, Artificial Sequence
  Synthetic
gcuucuaguccugcgcgcuc

SEQ ID NO: 6800 - RNA, 20 nt, Artificial Sequence
  Synthetic
acacacgcggacucuaaaau

SEQ ID NO: 6801 - RNA, 17 nt, Artificial Sequence
  Synthetic
ucuaguccugcgcgcuc

SEQ ID NO: 6802 - RNA, 17 nt, Artificial Sequence
  Synthetic
cacgcggacucuaaaau

SEQ ID NO: 6803 - RNA, 17 nt, Artificial Sequence
  Synthetic
ggugcaccugacuccug

SEQ ID NO: 6804 - RNA, 20 nt, Artificial Sequence
  Synthetic
guaacggcagacuucuccac

SEQ ID NO: 6805 - RNA, 17 nt, Artificial Sequence
  Synthetic
acggcagacuucuccac

SEQ ID NO: 6806 - RNA, 17 nt, Artificial Sequence
  Synthetic
acuucuccacaggaguc

SEQ ID NO: 6807 - RNA, 17 nt, Artificial Sequence
  Synthetic
aggagucaggugcacca

SEQ ID NO: 6808 - RNA, 20 nt, Artificial Sequence
  Synthetic
cauggugcaccugacuccug

SEQ ID NO: 6809 - RNA, 20 nt, Artificial Sequence
  Synthetic
cacaggagucaggugcacca

SEQ ID NO: 6810 - RNA, 20 nt, Artificial Sequence
  Synthetic
cagacuucuccacaggaguc

SEQ ID NO: 6811 - RNA, 20 nt, Artificial Sequence
  Synthetic
gaaguugguggugaggcccu

SEQ ID NO: 6812 - RNA, 20 nt, Artificial Sequence
  Synthetic
gcaaccucaaacagacacca

SEQ ID NO: 6813 - RNA, 17 nt, Artificial Sequence
  Synthetic
gccccacagggcaguaa

SEQ ID NO: 6814 - RNA, 17 nt, Artificial Sequence
  Synthetic
gccguuacugcccugug

SEQ ID NO: 6815 - RNA, 17 nt, Artificial Sequence
  Synthetic
ggaugaaguugguggug

SEQ ID NO: 6816 - RNA, 20 nt, Artificial Sequence
  Synthetic
gucugccguuacugcccugu

SEQ ID NO: 6817 - RNA, 17 nt, Artificial Sequence
  Synthetic
gugaacguggaugaagu

SEQ ID NO: 6818 - RNA, 20 nt, Artificial Sequence
  Synthetic
gugaacguggaugaaguugg

SEQ ID NO: 6819 - RNA, 17 nt, Artificial Sequence
  Synthetic
guggggcaaggugaacg

SEQ ID NO: 6820 - RNA, 17 nt, Artificial Sequence
  Synthetic
guggugaggcccugggc

SEQ ID NO: 6821 - RNA, 17 nt, Artificial Sequence
  Synthetic
guucaccuugccccaca

SEQ ID NO: 6822 - RNA, 17 nt, Artificial Sequence
  Synthetic
guugguggugaggcccu

SEQ ID NO: 6823 - RNA, 17 nt, Artificial Sequence
  Synthetic
aacguggaugaaguugg

SEQ ID NO: 6824 - RNA, 20 nt, Artificial Sequence
  Synthetic
aagcaaauguaagcaauaga

SEQ ID NO: 6825 - RNA, 20 nt, Artificial Sequence
  Synthetic
aaggugaacguggaugaagu

SEQ ID NO: 6826 - RNA, 17 nt, Artificial Sequence
  Synthetic
accauggugucuguuug

SEQ ID NO: 6827 - RNA, 17 nt, Artificial Sequence
  Synthetic
accucaaacagacacca

SEQ ID NO: 6828 - RNA, 20 nt, Artificial Sequence
  Synthetic
accuugauaccaaccugccc

SEQ ID NO: 6829 - RNA, 20 nt, Artificial Sequence
  Synthetic
agucugccguuacugcccug

SEQ ID NO: 6830 - RNA, 17 nt, Artificial Sequence
  Synthetic
aguugguggugaggccc

SEQ ID NO: 6831 - RNA, 17 nt, Artificial Sequence
  Synthetic
caaauguaagcaauaga

SEQ ID NO: 6832 - RNA, 20 nt, Artificial Sequence
  Synthetic
cacguucaccuugccccaca

SEQ ID NO: 6833 - RNA, 20 nt, Artificial Sequence
  Synthetic
ccacguucaccuugccccac

SEQ ID NO: 6834 - RNA, 20 nt, Artificial Sequence
  Synthetic
cccugggcagguugguauca

SEQ ID NO: 6835 - RNA, 20 nt, Artificial Sequence
  Synthetic
ccuguggggcaaggugaacg

SEQ ID NO: 6836 - RNA, 20 nt, Artificial Sequence
  Synthetic
ccuugauaccaaccugccca

SEQ ID NO: 6837 - RNA, 20 nt, Artificial Sequence
  Synthetic
cguggaugaaguugguggug

SEQ ID NO: 6838 - RNA, 20 nt, Artificial Sequence
  Synthetic
cguuacugcccuguggggca

SEQ ID NO: 6839 - RNA, 17 nt, Artificial Sequence
  Synthetic
cguucaccuugccccac

SEQ ID NO: 6840 - RNA, 17 nt, Artificial Sequence
  Synthetic
cugccguuacugcccug

SEQ ID NO: 6841 - RNA, 20 nt, Artificial Sequence
  Synthetic
cuugccccacagggcaguaa

SEQ ID NO: 6842 - RNA, 17 nt, Artificial Sequence
  Synthetic
uacugcccuguggggca

SEQ ID NO: 6843 - RNA, 17 nt, Artificial Sequence
  Synthetic
uaucaagguuacaagac

SEQ ID NO: 6844 - RNA, 20 nt, Artificial Sequence
  Synthetic
ucugccguuacugcccugug

SEQ ID NO: 6845 - RNA, 20 nt, Artificial Sequence
  Synthetic
ugaaguugguggugaggccc

SEQ ID NO: 6846 - RNA, 17 nt, Artificial Sequence
  Synthetic
ugaggcccugggcaggu

SEQ ID NO: 6847 - RNA, 17 nt, Artificial Sequence
  Synthetic
ugauaccaaccugccca

SEQ ID NO: 6848 - RNA, 20 nt, Artificial Sequence
  Synthetic
ugcaccauggugucuguuug

SEQ ID NO: 6849 - RNA, 17 nt, Artificial Sequence
  Synthetic
ugccguuacugcccugu

SEQ ID NO: 6850 - RNA, 17 nt, Artificial Sequence
  Synthetic
ugggcagguugguauca

SEQ ID NO: 6851 - RNA, 20 nt, Artificial Sequence
  Synthetic
ugguaucaagguuacaagac

SEQ ID NO: 6852 - RNA, 20 nt, Artificial Sequence
  Synthetic
uggugaggcccugggcaggu

SEQ ID NO: 6853 - RNA, 17 nt, Artificial Sequence
  Synthetic
uugauaccaaccugccc

SEQ ID NO: 6854 - RNA, 20 nt, Artificial Sequence
  Synthetic
uugguggugaggcccugggc

SEQ ID NO: 6855 - RNA, 20 nt, Artificial Sequence
  Synthetic
guaacggcagacuucuccac

SEQ ID NO: 6856 - RNA, 20 nt, Artificial Sequence
  Synthetic
cccuguggggcaagguggac

SEQ ID NO: 6857 - RNA, 20 nt, Artificial Sequence
  Synthetic
agucugccguuacugcccug

SEQ ID NO: 6858 - RNA, 20 nt, Artificial Sequence
  Synthetic
aagucugccguuacugcccu

SEQ ID NO: 6859 - RNA, 20 nt, Artificial Sequence
  Synthetic
aaccuugauaccaaccugcc

SEQ ID NO: 6860 - RNA, 20 nt, Artificial Sequence
  Synthetic
uccacguucaccuugcccca

SEQ ID NO: 6861 - RNA, 20 nt, Artificial Sequence
  Synthetic
gcuagugaacacaguugugu

SEQ ID NO: 6862 - RNA, 20 nt, Artificial Sequence
  Synthetic
ccauggugcaccugacuccu

SEQ ID NO: 6863 - RNA, 20 nt, Artificial Sequence
  Synthetic
cauggugcaccugacuccug

SEQ ID NO: 6864 - RNA, 20 nt, Artificial Sequence
  Synthetic
aggugcaccauggugucugu

SEQ ID NO: 6865 - RNA, 20 nt, Artificial Sequence
  Synthetic
uggugcaccugacuccugug

SEQ ID NO: 6866 - RNA, 20 nt, Artificial Sequence
  Synthetic
gaacguggaugaaguuggug

SEQ ID NO: 6867 - RNA, 20 nt, Artificial Sequence
  Synthetic
uuacugcccuguggggcaag

SEQ ID NO: 6868 - RNA, 20 nt, Artificial Sequence
  Synthetic
gugucuguuugagguugcua

SEQ ID NO: 6869 - RNA, 20 nt, Artificial Sequence
  Synthetic
guggggcaaggugaacgugg

SEQ ID NO: 6870 - RNA, 20 nt, Artificial Sequence
  Synthetic
augaaguugguggugaggcc

SEQ ID NO: 6871 - RNA, 20 nt, Artificial Sequence
  Synthetic
aguaacggcagacuucucca

SEQ ID NO: 6872 - RNA, 17 nt, Artificial Sequence
  Synthetic
ucaucucgauuggugaa

SEQ ID NO: 6873 - RNA, 17 nt, Artificial Sequence
  Synthetic
uugcuugcggcgagaca

SEQ ID NO: 6874 - RNA, 17 nt, Artificial Sequence
  Synthetic
augucucgccgcaagca

SEQ ID NO: 6875 - RNA, 17 nt, Artificial Sequence
  Synthetic
gcagaauaugccccgca

SEQ ID NO: 6876 - RNA, 17 nt, Artificial Sequence
  Synthetic
ccguugggagcuccaga

SEQ ID NO: 6877 - RNA, 17 nt, Artificial Sequence
  Synthetic
cuccaugugcagaacga

SEQ ID NO: 6878 - RNA, 17 nt, Artificial Sequence
  Synthetic
ucgauuggugaagggga

SEQ ID NO: 6879 - RNA, 17 nt, Artificial Sequence
  Synthetic
cauccucuggcgugacc

SEQ ID NO: 6880 - RNA, 17 nt, Artificial Sequence
  Synthetic
gcucuaauccccacgcc

SEQ ID NO: 6881 - RNA, 17 nt, Artificial Sequence
  Synthetic
cccguuugcuuaagugc

SEQ ID NO: 6882 - RNA, 17 nt, Artificial Sequence
  Synthetic
aaacaaucgucauccuc

SEQ ID NO: 6883 - RNA, 17 nt, Artificial Sequence
  Synthetic
cccaacgggccgugguc

SEQ ID NO: 6884 - RNA, 17 nt, Artificial Sequence
  Synthetic
caucucgauuggugaag

SEQ ID NO: 6885 - RNA, 17 nt, Artificial Sequence
  Synthetic
cauccaggucacgccag

SEQ ID NO: 6886 - RNA, 17 nt, Artificial Sequence
  Synthetic
uuaucaacgucaucuag

SEQ ID NO: 6887 - RNA, 17 nt, Artificial Sequence
  Synthetic
gagcucccaacgggccg

SEQ ID NO: 6888 - RNA, 17 nt, Artificial Sequence
  Synthetic
ugcacucaucccaggcg

SEQ ID NO: 6889 - RNA, 17 nt, Artificial Sequence
  Synthetic
agacauggugggcugcg

SEQ ID NO: 6890 - RNA, 17 nt, Artificial Sequence
  Synthetic
cguuugcuuaagugcug

SEQ ID NO: 6891 - RNA, 17 nt, Artificial Sequence
  Synthetic
gcuuuuuucaucucgau

SEQ ID NO: 6892 - RNA, 17 nt, Artificial Sequence
  Synthetic
ccguuugcuuaagugcu

SEQ ID NO: 6893 - RNA, 17 nt, Artificial Sequence
  Synthetic
uccaaucccguggaggu

SEQ ID NO: 6894 - RNA, 17 nt, Artificial Sequence
  Synthetic
uugcggcgagacauggu

SEQ ID NO: 6895 - RNA, 17 nt, Artificial Sequence
  Synthetic
augaccuccucaccugu

SEQ ID NO: 6896 - RNA, 20 nt, Artificial Sequence
  Synthetic
uuauuuuuaucgagcacaaa

SEQ ID NO: 6897 - RNA, 20 nt, Artificial Sequence
  Synthetic
uccccuucuggagcucccaa

SEQ ID NO: 6898 - RNA, 20 nt, Artificial Sequence
  Synthetic
uuuucaucucgauuggugaa

SEQ ID NO: 6899 - RNA, 20 nt, Artificial Sequence
  Synthetic
gccuugcuugcggcgagaca

SEQ ID NO: 6900 - RNA, 20 nt, Artificial Sequence
  Synthetic
accaugucucgccgcaagca

SEQ ID NO: 6901 - RNA, 20 nt, Artificial Sequence
  Synthetic
gagcuccaugugcagaacga

SEQ ID NO: 6902 - RNA, 20 nt, Artificial Sequence
  Synthetic
ucacagauaaacuucugcac

SEQ ID NO: 6903 - RNA, 20 nt, Artificial Sequence
  Synthetic
cgucauccucuggcgugacc

SEQ ID NO: 6904 - RNA, 20 nt, Artificial Sequence
  Synthetic
ggagcucuaauccccacgcc

SEQ ID NO: 6905 - RNA, 20 nt, Artificial Sequence
  Synthetic
ucccguggagguuggcaucc

SEQ ID NO: 6906 - RNA, 20 nt, Artificial Sequence
  Synthetic
auucccguuugcuuaagugc

SEQ ID NO: 6907 - RNA, 20 nt, Artificial Sequence
  Synthetic
cccccaaugggaaguucauc

SEQ ID NO: 6908 - RNA, 20 nt, Artificial Sequence
  Synthetic
gcucccaacgggccgugguc

SEQ ID NO: 6909 - RNA, 20 nt, Artificial Sequence
  Synthetic
uuucaucucgauuggugaag

SEQ ID NO: 6910 - RNA, 20 nt, Artificial Sequence
  Synthetic
uguuuaucaacgucaucuag

SEQ ID NO: 6911 - RNA, 20 nt, Artificial Sequence
  Synthetic
agagcuccaugugcagaacg

SEQ ID NO: 6912 - RNA, 20 nt, Artificial Sequence
  Synthetic
gaaaaaagcauccaaucccg

SEQ ID NO: 6913 - RNA, 20 nt, Artificial Sequence
  Synthetic
gcgagacauggugggcugcg

SEQ ID NO: 6914 - RNA, 20 nt, Artificial Sequence
  Synthetic
cagauaaacuucugcacugg

SEQ ID NO: 6915 - RNA, 20 nt, Artificial Sequence
  Synthetic
cggcgagacauggugggcug

SEQ ID NO: 6916 - RNA, 20 nt, Artificial Sequence
  Synthetic
cugcacucaucccaggcgug

SEQ ID NO: 6917 - RNA, 20 nt, Artificial Sequence
  Synthetic
ugaaccagaccacggcccgu

SEQ ID NO: 6918 - RNA, 20 nt, Artificial Sequence
  Synthetic
gcauccaaucccguggaggu

SEQ ID NO: 6919 - RNA, 20 nt, Artificial Sequence
  Synthetic
ugcuugcggcgagacauggu

SEQ ID NO: 6920 - RNA, 20 nt, Artificial Sequence
  Synthetic
ucaagaggcucggcuguggu

SEQ ID NO: 6921 - RNA, 20 nt, Artificial Sequence
  Synthetic
aucaugaccuccucaccugu

SEQ ID NO: 6922 - RNA, 17 nt, Artificial Sequence
  Synthetic
uuuuuaucgagcacaaa

SEQ ID NO: 6923 - RNA, 17 nt, Artificial Sequence
  Synthetic
cccagcacuuaagcaaa

SEQ ID NO: 6924 - RNA, 17 nt, Artificial Sequence
  Synthetic
auaagaaugucccccaa

SEQ ID NO: 6925 - RNA, 17 nt, Artificial Sequence
  Synthetic
ccuucuggagcucccaa

SEQ ID NO: 6926 - RNA, 17 nt, Artificial Sequence
  Synthetic
aaacggaaacaaugcaa

SEQ ID NO: 6927 - RNA, 17 nt, Artificial Sequence
  Synthetic
uucaucaucuguaagaa

SEQ ID NO: 6928 - RNA, 17 nt, Artificial Sequence
  Synthetic
cguugggagcuccagaa

SEQ ID NO: 6929 - RNA, 17 nt, Artificial Sequence
  Synthetic
uccccucguucugcaca

SEQ ID NO: 6930 - RNA, 17 nt, Artificial Sequence
  Synthetic
gaugaugaaccagacca

SEQ ID NO: 6931 - RNA, 17 nt, Artificial Sequence
  Synthetic
cuggaugccaaccucca

SEQ ID NO: 6932 - RNA, 17 nt, Artificial Sequence
  Synthetic
cagguaaaugagaagca

SEQ ID NO: 6933 - RNA, 17 nt, Artificial Sequence
  Synthetic
uaaacuucugcacugga

SEQ ID NO: 6934 - RNA, 17 nt, Artificial Sequence
  Synthetic
uucaucucgauugguga

SEQ ID NO: 6935 - RNA, 17 nt, Artificial Sequence
  Synthetic
cauuuguagaagaaaua

SEQ ID NO: 6936 - RNA, 17 nt, Artificial Sequence
  Synthetic
aggaauuugccccaaac

SEQ ID NO: 6937 - RNA, 17 nt, Artificial Sequence
  Synthetic
ccagcacuuaagcaaac

SEQ ID NO: 6938 - RNA, 17 nt, Artificial Sequence
  Synthetic
cuucuggagcucccaac

SEQ ID NO: 6939 - RNA, 17 nt, Artificial Sequence
  Synthetic
caucuggcacugcccac

SEQ ID NO: 6940 - RNA, 17 nt, Artificial Sequence
  Synthetic
uggaugccaaccuccac

SEQ ID NO: 6941 - RNA, 17 nt, Artificial Sequence
  Synthetic
cagauaaacuucugcac

SEQ ID NO: 6942 - RNA, 17 nt, Artificial Sequence
  Synthetic
uauucugcacucauccc

SEQ ID NO: 6943 - RNA, 17 nt, Artificial Sequence
  Synthetic
cguggagguuggcaucc

SEQ ID NO: 6944 - RNA, 17 nt, Artificial Sequence
  Synthetic
aaacaggaacacauagc

SEQ ID NO: 6945 - RNA, 17 nt, Artificial Sequence
  Synthetic
ugcagaauaugccccgc

SEQ ID NO: 6946 - RNA, 17 nt, Artificial Sequence
  Synthetic
auggugggcugcggggc

SEQ ID NO: 6947 - RNA, 17 nt, Artificial Sequence
  Synthetic
acuuacaaauacccugc

SEQ ID NO: 6948 - RNA, 17 nt, Artificial Sequence
  Synthetic
uguacauguguagcugc

SEQ ID NO: 6949 - RNA, 17 nt, Artificial Sequence
  Synthetic
gagacauggugggcugc

SEQ ID NO: 6950 - RNA, 17 nt, Artificial Sequence
  Synthetic
guguuguauuauuuugc

SEQ ID NO: 6951 - RNA, 17 nt, Artificial Sequence
  Synthetic
ccaaugggaaguucauc

SEQ ID NO: 6952 - RNA, 17 nt, Artificial Sequence
  Synthetic
aggucaugauccccuuc

SEQ ID NO: 6953 - RNA, 17 nt, Artificial Sequence
  Synthetic
guaagaauggcuucaag

SEQ ID NO: 6954 - RNA, 17 nt, Artificial Sequence
  Synthetic
guugggagcuccagaag

SEQ ID NO: 6955 - RNA, 17 nt, Artificial Sequence
  Synthetic
cagcuuuuucuaagcag

SEQ ID NO: 6956 - RNA, 17 nt, Artificial Sequence
  Synthetic
uccaugugcagaacgag

SEQ ID NO: 6957 - RNA, 17 nt, Artificial Sequence
  Synthetic
cagaacgaggggaggag

SEQ ID NO: 6958 - RNA, 17 nt, Artificial Sequence
  Synthetic
aaacuucugcacuggag

SEQ ID NO: 6959 - RNA, 17 nt, Artificial Sequence
  Synthetic
gcuccaugugcagaacg

SEQ ID NO: 6960 - RNA, 17 nt, Artificial Sequence
  Synthetic
aaaagcauccaaucccg

SEQ ID NO: 6961 - RNA, 17 nt, Artificial Sequence
  Synthetic
cuuacaaauacccugcg

SEQ ID NO: 6962 - RNA, 17 nt, Artificial Sequence
  Synthetic
auuggugaaggggaagg

SEQ ID NO: 6963 - RNA, 17 nt, Artificial Sequence
  Synthetic
acugcccacaggugagg

SEQ ID NO: 6964 - RNA, 17 nt, Artificial Sequence
  Synthetic
ggggcgggcggcggcgg

SEQ ID NO: 6965 - RNA, 17 nt, Artificial Sequence
  Synthetic
ugcggggcgggcggcgg

SEQ ID NO: 6966 - RNA, 17 nt, Artificial Sequence
  Synthetic
ggcugcggggcgggcgg

SEQ ID NO: 6967 - RNA, 17 nt, Artificial Sequence
  Synthetic
gugggcugcggggcggg

SEQ ID NO: 6968 - RNA, 17 nt, Artificial Sequence
  Synthetic
augugcagaacgagggg

SEQ ID NO: 6969 - RNA, 17 nt, Artificial Sequence
  Synthetic
cauggugggcugcgggg

SEQ ID NO: 6970 - RNA, 17 nt, Artificial Sequence
  Synthetic
cuugcggcgagacaugg

SEQ ID NO: 6971 - RNA, 17 nt, Artificial Sequence
  Synthetic
auaaacuucugcacugg

SEQ ID NO: 6972 - RNA, 17 nt, Artificial Sequence
  Synthetic
agcauccaaucccgugg

SEQ ID NO: 6973 - RNA, 17 nt, Artificial Sequence
  Synthetic
gaugaacuucccauugg

SEQ ID NO: 6974 - RNA, 17 nt, Artificial Sequence
  Synthetic
caugaccuccucaccug

SEQ ID NO: 6975 - RNA, 17 nt, Artificial Sequence
  Synthetic
aacuuacaaauacccug

SEQ ID NO: 6976 - RNA, 17 nt, Artificial Sequence
  Synthetic
cugcuuagaaaaagcug

SEQ ID NO: 6977 - RNA, 17 nt, Artificial Sequence
  Synthetic
uucaagaggcucggcug

SEQ ID NO: 6978 - RNA, 17 nt, Artificial Sequence
  Synthetic
cgagacauggugggcug

SEQ ID NO: 6979 - RNA, 17 nt, Artificial Sequence
  Synthetic
cacucaucccaggcgug

SEQ ID NO: 6980 - RNA, 17 nt, Artificial Sequence
  Synthetic
ggcacugcccacaggug

SEQ ID NO: 6981 - RNA, 17 nt, Artificial Sequence
  Synthetic
agaugaacuucccauug

SEQ ID NO: 6982 - RNA, 17 nt, Artificial Sequence
  Synthetic
gggguuugccuugcuug

SEQ ID NO: 6983 - RNA, 17 nt, Artificial Sequence
  Synthetic
cuauguguuccuguuug

SEQ ID NO: 6984 - RNA, 17 nt, Artificial Sequence
  Synthetic
uaagaaugucccccaau

SEQ ID NO: 6985 - RNA, 17 nt, Artificial Sequence
  Synthetic
ccagaugaacuucccau

SEQ ID NO: 6986 - RNA, 17 nt, Artificial Sequence
  Synthetic
gccaaccuccacgggau

SEQ ID NO: 6987 - RNA, 17 nt, Artificial Sequence
  Synthetic
auuauuauuacuauuau

SEQ ID NO: 6988 - RNA, 17 nt, Artificial Sequence
  Synthetic
cucuaauccccacgccu

SEQ ID NO: 6989 - RNA, 17 nt, Artificial Sequence
  Synthetic
aauggcuucaagaggcu

SEQ ID NO: 6990 - RNA, 17 nt, Artificial Sequence
  Synthetic
guacauguguagcugcu

SEQ ID NO: 6991 - RNA, 17 nt, Artificial Sequence
  Synthetic
accagaccacggcccgu

SEQ ID NO: 6992 - RNA, 17 nt, Artificial Sequence
  Synthetic
gcacucaucccaggcgu

SEQ ID NO: 6993 - RNA, 17 nt, Artificial Sequence
  Synthetic
agaggcucggcuguggu

SEQ ID NO: 6994 - RNA, 17 nt, Artificial Sequence
  Synthetic
cagaugaacuucccauu

SEQ ID NO: 6995 - RNA, 17 nt, Artificial Sequence
  Synthetic
uuauuauuacuauuauu

SEQ ID NO: 6996 - RNA, 17 nt, Artificial Sequence
  Synthetic
ccagaccacggcccguu

SEQ ID NO: 6997 - RNA, 17 nt, Artificial Sequence
  Synthetic
ugcuauguguuccuguu

SEQ ID NO: 6998 - RNA, 17 nt, Artificial Sequence
  Synthetic
gcuauguguuccuguuu

SEQ ID NO: 6999 - RNA, 20 nt, Artificial Sequence
  Synthetic
aaccccagcacuuaagcaaa

SEQ ID NO: 7000 - RNA, 20 nt, Artificial Sequence
  Synthetic
aaaauaagaaugucccccaa

SEQ ID NO: 7001 - RNA, 20 nt, Artificial Sequence
  Synthetic
cacaaacggaaacaaugcaa

SEQ ID NO: 7002 - RNA, 20 nt, Artificial Sequence
  Synthetic
ugguucaucaucuguaagaa

SEQ ID NO: 7003 - RNA, 20 nt, Artificial Sequence
  Synthetic
gcccguugggagcuccagaa

SEQ ID NO: 7004 - RNA, 20 nt, Artificial Sequence
  Synthetic
uccuccccucguucugcaca

SEQ ID NO: 7005 - RNA, 20 nt, Artificial Sequence
  Synthetic
acagaugaugaaccagacca

SEQ ID NO: 7006 - RNA, 20 nt, Artificial Sequence
  Synthetic
gaccuggaugccaaccucca

SEQ ID NO: 7007 - RNA, 20 nt, Artificial Sequence
  Synthetic
uagcagguaaaugagaagca

SEQ ID NO: 7008 - RNA, 20 nt, Artificial Sequence
  Synthetic
agugcagaauaugccccgca

SEQ ID NO: 7009 - RNA, 20 nt, Artificial Sequence
  Synthetic
ggcccguugggagcuccaga

SEQ ID NO: 7010 - RNA, 20 nt, Artificial Sequence
  Synthetic
aucucgauuggugaagggga

SEQ ID NO: 7011 - RNA, 20 nt, Artificial Sequence
  Synthetic
agauaaacuucugcacugga

SEQ ID NO: 7012 - RNA, 20 nt, Artificial Sequence
  Synthetic
uuuuucaucucgauugguga

SEQ ID NO: 7013 - RNA, 20 nt, Artificial Sequence
  Synthetic
uagaggaauuugccccaaac

SEQ ID NO: 7014 - RNA, 20 nt, Artificial Sequence
  Synthetic
accccagcacuuaagcaaac

SEQ ID NO: 7015 - RNA, 20 nt, Artificial Sequence
  Synthetic
ccccuucuggagcucccaac

SEQ ID NO: 7016 - RNA, 20 nt, Artificial Sequence
  Synthetic
guucaucuggcacugcccac

SEQ ID NO: 7017 - RNA, 20 nt, Artificial Sequence
  Synthetic
accuggaugccaaccuccac

SEQ ID NO: 7018 - RNA, 20 nt, Artificial Sequence
  Synthetic
gcauauucugcacucauccc

SEQ ID NO: 7019 - RNA, 20 nt, Artificial Sequence
  Synthetic
cccaaacaggaacacauagc

SEQ ID NO: 7020 - RNA, 20 nt, Artificial Sequence
  Synthetic
gagugcagaauaugccccgc

SEQ ID NO: 7021 - RNA, 20 nt, Artificial Sequence
  Synthetic
gacauggugggcugcggggc

SEQ ID NO: 7022 - RNA, 20 nt, Artificial Sequence
  Synthetic
ucaacuuacaaauacccugc

SEQ ID NO: 7023 - RNA, 20 nt, Artificial Sequence
  Synthetic
aguuguacauguguagcugc

SEQ ID NO: 7024 - RNA, 20 nt, Artificial Sequence
  Synthetic
ggcgagacauggugggcugc

SEQ ID NO: 7025 - RNA, 20 nt, Artificial Sequence
  Synthetic
uugguguuguauuauuuugc

SEQ ID NO: 7026 - RNA, 20 nt, Artificial Sequence
  Synthetic
gauaaacaaucgucauccuc

SEQ ID NO: 7027 - RNA, 20 nt, Artificial Sequence
  Synthetic
aggaggucaugauccccuuc

SEQ ID NO: 7028 - RNA, 20 nt, Artificial Sequence
  Synthetic
ucuguaagaauggcuucaag

SEQ ID NO: 7029 - RNA, 20 nt, Artificial Sequence
  Synthetic
cccguugggagcuccagaag

SEQ ID NO: 7030 - RNA, 20 nt, Artificial Sequence
  Synthetic
uggcauccaggucacgccag

SEQ ID NO: 7031 - RNA, 20 nt, Artificial Sequence
  Synthetic
ccacagcuuuuucuaagcag

SEQ ID NO: 7032 - RNA, 20 nt, Artificial Sequence
  Synthetic
agcuccaugugcagaacgag

SEQ ID NO: 7033 - RNA, 20 nt, Artificial Sequence
  Synthetic
gugcagaacgaggggaggag

SEQ ID NO: 7034 - RNA, 20 nt, Artificial Sequence
  Synthetic
gauaaacuucugcacuggag

SEQ ID NO: 7035 - RNA, 20 nt, Artificial Sequence
  Synthetic
cuggagcucccaacgggccg

SEQ ID NO: 7036 - RNA, 20 nt, Artificial Sequence
  Synthetic
uucugcacucaucccaggcg

SEQ ID NO: 7037 - RNA, 20 nt, Artificial Sequence
  Synthetic
caacuuacaaauacccugcg

SEQ ID NO: 7038 - RNA, 20 nt, Artificial Sequence
  Synthetic
ucgauuggugaaggggaagg

SEQ ID NO: 7039 - RNA, 20 nt, Artificial Sequence
  Synthetic
ggcacugcccacaggugagg

SEQ ID NO: 7040 - RNA, 20 nt, Artificial Sequence
  Synthetic
ugcggggcgggcggcggcgg

SEQ ID NO: 7041 - RNA, 20 nt, Artificial Sequence
  Synthetic
ggcugcggggcgggcggcgg

SEQ ID NO: 7042 - RNA, 20 nt, Artificial Sequence
  Synthetic
gugggcugcggggcgggcgg

SEQ ID NO: 7043 - RNA, 20 nt, Artificial Sequence
  Synthetic
auggugggcugcggggcggg

SEQ ID NO: 7044 - RNA, 20 nt, Artificial Sequence
  Synthetic
uccaugugcagaacgagggg

SEQ ID NO: 7045 - RNA, 20 nt, Artificial Sequence
  Synthetic
agacauggugggcugcgggg

SEQ ID NO: 7046 - RNA, 20 nt, Artificial Sequence
  Synthetic
uugcuugcggcgagacaugg

SEQ ID NO: 7047 - RNA, 20 nt, Artificial Sequence
  Synthetic
aaaagcauccaaucccgugg

SEQ ID NO: 7048 - RNA, 20 nt, Artificial Sequence
  Synthetic
ccagaugaacuucccauugg

SEQ ID NO: 7049 - RNA, 20 nt, Artificial Sequence
  Synthetic
gaucaugaccuccucaccug

SEQ ID NO: 7050 - RNA, 20 nt, Artificial Sequence
  Synthetic
cucaacuuacaaauacccug

SEQ ID NO: 7051 - RNA, 20 nt, Artificial Sequence
  Synthetic
ccucugcuuagaaaaagcug

SEQ ID NO: 7052 - RNA, 20 nt, Artificial Sequence
  Synthetic
ggcuucaagaggcucggcug

SEQ ID NO: 7053 - RNA, 20 nt, Artificial Sequence
  Synthetic
ucccguuugcuuaagugcug

SEQ ID NO: 7054 - RNA, 20 nt, Artificial Sequence
  Synthetic
ucuggcacugcccacaggug

SEQ ID NO: 7055 - RNA, 20 nt, Artificial Sequence
  Synthetic
gccagaugaacuucccauug

SEQ ID NO: 7056 - RNA, 20 nt, Artificial Sequence
  Synthetic
gcugggguuugccuugcuug

SEQ ID NO: 7057 - RNA, 20 nt, Artificial Sequence
  Synthetic
cugcuauguguuccuguuug

SEQ ID NO: 7058 - RNA, 20 nt, Artificial Sequence
  Synthetic
aaauaagaaugucccccaau

SEQ ID NO: 7059 - RNA, 20 nt, Artificial Sequence
  Synthetic
gugccagaugaacuucccau

SEQ ID NO: 7060 - RNA, 20 nt, Artificial Sequence
  Synthetic
gaugcuuuuuucaucucgau

SEQ ID NO: 7061 - RNA, 20 nt, Artificial Sequence
  Synthetic
gaugccaaccuccacgggau

SEQ ID NO: 7062 - RNA, 20 nt, Artificial Sequence
  Synthetic
gagcucuaauccccacgccu

SEQ ID NO: 7063 - RNA, 20 nt, Artificial Sequence
  Synthetic
aagaauggcuucaagaggcu

SEQ ID NO: 7064 - RNA, 20 nt, Artificial Sequence
  Synthetic
guuguacauguguagcugcu

SEQ ID NO: 7065 - RNA, 20 nt, Artificial Sequence
  Synthetic
uucccguuugcuuaagugcu

SEQ ID NO: 7066 - RNA, 20 nt, Artificial Sequence
  Synthetic
ucugcacucaucccaggcgu

SEQ ID NO: 7067 - RNA, 20 nt, Artificial Sequence
  Synthetic
ugccagaugaacuucccauu

SEQ ID NO: 7068 - RNA, 20 nt, Artificial Sequence
  Synthetic
gaaccagaccacggcccguu

SEQ ID NO: 7069 - RNA, 20 nt, Artificial Sequence
  Synthetic
accugcuauguguuccuguu

SEQ ID NO: 7070 - RNA, 20 nt, Artificial Sequence
  Synthetic
ccugcuauguguuccuguuu

SEQ ID NO: 7071 - RNA, 17 nt, Artificial Sequence
  Synthetic
uccgacgaggaggcaaa

SEQ ID NO: 7072 - RNA, 17 nt, Artificial Sequence
  Synthetic
auucuuagcagguuaaa

SEQ ID NO: 7073 - RNA, 17 nt, Artificial Sequence
  Synthetic
gcugcgguugaauccaa

SEQ ID NO: 7074 - RNA, 17 nt, Artificial Sequence
  Synthetic
ggcccagcccuaugcaa

SEQ ID NO: 7075 - RNA, 17 nt, Artificial Sequence
  Synthetic
ccgcagcacccugucaa

SEQ ID NO: 7076 - RNA, 17 nt, Artificial Sequence
  Synthetic
cuuccggccuggcagaa

SEQ ID NO: 7077 - RNA, 17 nt, Artificial Sequence
  Synthetic
uugaugcgcuuagagaa

SEQ ID NO: 7078 - RNA, 17 nt, Artificial Sequence
  Synthetic
aaccugaucccggagaa

SEQ ID NO: 7079 - RNA, 17 nt, Artificial Sequence
  Synthetic
gagcacuccucggagaa

SEQ ID NO: 7080 - RNA, 17 nt, Artificial Sequence
  Synthetic
cuggguacuacgccgaa

SEQ ID NO: 7081 - RNA, 17 nt, Artificial Sequence
  Synthetic
ucuccgaagcuaaggaa

SEQ ID NO: 7082 - RNA, 17 nt, Artificial Sequence
  Synthetic
gggggcgucgccaggaa

SEQ ID NO: 7083 - RNA, 17 nt, Artificial Sequence
  Synthetic
uugcuaccuggcuggaa

SEQ ID NO: 7084 - RNA, 17 nt, Artificial Sequence
  Synthetic
cugcaccuaguccugaa

SEQ ID NO: 7085 - RNA, 17 nt, Artificial Sequence
  Synthetic
aaccaugcacuggugaa

SEQ ID NO: 7086 - RNA, 17 nt, Artificial Sequence
  Synthetic
auuuucucagaacuuaa

SEQ ID NO: 7087 - RNA, 17 nt, Artificial Sequence
  Synthetic
uauucuuagcagguuaa

SEQ ID NO: 7088 - RNA, 17 nt, Artificial Sequence
  Synthetic
gacgauggcacuguuaa

SEQ ID NO: 7089 - RNA, 17 nt, Artificial Sequence
  Synthetic
cggugguggacuaaaca

SEQ ID NO: 7090 - RNA, 17 nt, Artificial Sequence
  Synthetic
ggccgcgaugcccaaca

SEQ ID NO: 7091 - RNA, 17 nt, Artificial Sequence
  Synthetic
uacuuagaaagcgaaca

SEQ ID NO: 7092 - RNA, 17 nt, Artificial Sequence
  Synthetic
gcaccggcgcagccaca

SEQ ID NO: 7093 - RNA, 17 nt, Artificial Sequence
  Synthetic
cgaggccgagggccaca

SEQ ID NO: 7094 - RNA, 17 nt, Artificial Sequence
  Synthetic
cccgagugccuuugaca

SEQ ID NO: 7095 - RNA, 17 nt, Artificial Sequence
  Synthetic
cuugaacuuggccacca

SEQ ID NO: 7096 - RNA, 17 nt, Artificial Sequence
  Synthetic
aaaauuugaagccccca

SEQ ID NO: 7097 - RNA, 17 nt, Artificial Sequence
  Synthetic
cugcaauaugaauccca

SEQ ID NO: 7098 - RNA, 17 nt, Artificial Sequence
  Synthetic
uauggagccucccgcca

SEQ ID NO: 7099 - RNA, 17 nt, Artificial Sequence
  Synthetic
cgggugauggguggcca

SEQ ID NO: 7100 - RNA, 17 nt, Artificial Sequence
  Synthetic
ucuccuagagaaaucca

SEQ ID NO: 7101 - RNA, 17 nt, Artificial Sequence
  Synthetic
ucccagccaccucucca

SEQ ID NO: 7102 - RNA, 17 nt, Artificial Sequence
  Synthetic
cucggggcgcagcggca

SEQ ID NO: 7103 - RNA, 17 nt, Artificial Sequence
  Synthetic
cgacgucaugcagggca

SEQ ID NO: 7104 - RNA, 17 nt, Artificial Sequence
  Synthetic
cugcaugacgucgggca

SEQ ID NO: 7105 - RNA, 17 nt, Artificial Sequence
  Synthetic
gacuuagagagcuggca

SEQ ID NO: 7106 - RNA, 17 nt, Artificial Sequence
  Synthetic
cugcccgacgucaugca

SEQ ID NO: 7107 - RNA, 17 nt, Artificial Sequence
  Synthetic
cucgcugaagugcugca

SEQ ID NO: 7108 - RNA, 17 nt, Artificial Sequence
  Synthetic
agccauucaccagugca

SEQ ID NO: 7109 - RNA, 17 nt, Artificial Sequence
  Synthetic
cacgcacagaacacuca

SEQ ID NO: 7110 - RNA, 17 nt, Artificial Sequence
  Synthetic
gucggacuugaccguca

SEQ ID NO: 7111 - RNA, 17 nt, Artificial Sequence
  Synthetic
accaacccgcgggguca

SEQ ID NO: 7112 - RNA, 17 nt, Artificial Sequence
  Synthetic
aggcccagcucaaaaga

SEQ ID NO: 7113 - RNA, 17 nt, Artificial Sequence
  Synthetic
gcuuccggccuggcaga

SEQ ID NO: 7114 - RNA, 17 nt, Artificial Sequence
  Synthetic
ccugggggcggaagaga

SEQ ID NO: 7115 - RNA, 17 nt, Artificial Sequence
  Synthetic
cuugaugcgcuuagaga

SEQ ID NO: 7116 - RNA, 17 nt, Artificial Sequence
  Synthetic
gcugacggagagcgaga

SEQ ID NO: 7117 - RNA, 17 nt, Artificial Sequence
  Synthetic
gcgcaucaagcucgaga

SEQ ID NO: 7118 - RNA, 17 nt, Artificial Sequence
  Synthetic
ucggaccgcauagacga

SEQ ID NO: 7119 - RNA, 17 nt, Artificial Sequence
  Synthetic
acggucaaguccgacga

SEQ ID NO: 7120 - RNA, 17 nt, Artificial Sequence
  Synthetic
caccuggccgaggccga

SEQ ID NO: 7121 - RNA, 17 nt, Artificial Sequence
  Synthetic
gucuccgaagcuaagga

SEQ ID NO: 7122 - RNA, 17 nt, Artificial Sequence
  Synthetic
ggggggcgucgccagga

SEQ ID NO: 7123 - RNA, 17 nt, Artificial Sequence
  Synthetic
agguuggagacagagga

SEQ ID NO: 7124 - RNA, 17 nt, Artificial Sequence
  Synthetic
gggcggauugcagagga

SEQ ID NO: 7125 - RNA, 17 nt, Artificial Sequence
  Synthetic
ggggcugggagggagga

SEQ ID NO: 7126 - RNA, 17 nt, Artificial Sequence
  Synthetic
ccggggagcuggacgga

SEQ ID NO: 7127 - RNA, 17 nt, Artificial Sequence
  Synthetic
guguggcaguuuucgga

SEQ ID NO: 7128 - RNA, 17 nt, Artificial Sequence
  Synthetic
ggauugcagaggaggga

SEQ ID NO: 7129 - RNA, 17 nt, Artificial Sequence
  Synthetic
uugaccgggggcuggga

SEQ ID NO: 7130 - RNA, 17 nt, Artificial Sequence
  Synthetic
uggagagguggcuggga

SEQ ID NO: 7131 - RNA, 17 nt, Artificial Sequence
  Synthetic
ccgcccggggagcugga

SEQ ID NO: 7132 - RNA, 17 nt, Artificial Sequence
  Synthetic
gcggcacgggaagugga

SEQ ID NO: 7133 - RNA, 17 nt, Artificial Sequence
  Synthetic
gcccaggaccuggugga

SEQ ID NO: 7134 - RNA, 17 nt, Artificial Sequence
  Synthetic
caaaucgucccccauga

SEQ ID NO: 7135 - RNA, 17 nt, Artificial Sequence
  Synthetic
ucugcaccuaguccuga

SEQ ID NO: 7136 - RNA, 17 nt, Artificial Sequence
  Synthetic
ggaggaggaggagcuga

SEQ ID NO: 7137 - RNA, 17 nt, Artificial Sequence
  Synthetic
caaaggcacucggguga

SEQ ID NO: 7138 - RNA, 17 nt, Artificial Sequence
  Synthetic
ggcccggaccacuaaua

SEQ ID NO: 7139 - RNA, 17 nt, Artificial Sequence
  Synthetic
gcaguaaccuuugcaua

SEQ ID NO: 7140 - RNA, 17 nt, Artificial Sequence
  Synthetic
agcgagaggguggacua

SEQ ID NO: 7141 - RNA, 17 nt, Artificial Sequence
  Synthetic
uggagucuccgaagcua

SEQ ID NO: 7142 - RNA, 17 nt, Artificial Sequence
  Synthetic
guugaauccaauggcua

SEQ ID NO: 7143 - RNA, 17 nt, Artificial Sequence
  Synthetic
cacagguugcacuugua

SEQ ID NO: 7144 - RNA, 17 nt, Artificial Sequence
  Synthetic
aauuuucucagaacuua

SEQ ID NO: 7145 - RNA, 17 nt, Artificial Sequence
  Synthetic
ucggugguggacuaaac

SEQ ID NO: 7146 - RNA, 17 nt, Artificial Sequence
  Synthetic
accugaucccggagaac

SEQ ID NO: 7147 - RNA, 17 nt, Artificial Sequence
  Synthetic
agcacuccucggagaac

SEQ ID NO: 7148 - RNA, 17 nt, Artificial Sequence
  Synthetic
caccggcgcagccacac

SEQ ID NO: 7149 - RNA, 17 nt, Artificial Sequence
  Synthetic
ccgaggccgagggccac

SEQ ID NO: 7150 - RNA, 17 nt, Artificial Sequence
  Synthetic
ugcacgcguggucgcac

SEQ ID NO: 7151 - RNA, 17 nt, Artificial Sequence
  Synthetic
ucggggcgcagcggcac

SEQ ID NO: 7152 - RNA, 17 nt, Artificial Sequence
  Synthetic
caagagaaaccaugcac

SEQ ID NO: 7153 - RNA, 17 nt, Artificial Sequence
  Synthetic
gcaaccugguggugcac

SEQ ID NO: 7154 - RNA, 17 nt, Artificial Sequence
  Synthetic
gcagcagcuuuuuggac

SEQ ID NO: 7155 - RNA, 17 nt, Artificial Sequence
  Synthetic
caugacuuggacuugac

SEQ ID NO: 7156 - RNA, 17 nt, Artificial Sequence
  Synthetic
acccgagugccuuugac

SEQ ID NO: 7157 - RNA, 17 nt, Artificial Sequence
  Synthetic
caaauuucagagcaacc

SEQ ID NO: 7158 - RNA, 17 nt, Artificial Sequence
  Synthetic
gccagcuccccggaacc

SEQ ID NO: 7159 - RNA, 17 nt, Artificial Sequence
  Synthetic
ugcgccggugcaccacc

SEQ ID NO: 7160 - RNA, 17 nt, Artificial Sequence
  Synthetic
gcauaagcgcggccacc

SEQ ID NO: 7161 - RNA, 17 nt, Artificial Sequence
  Synthetic
cagcgaggccuuccacc

SEQ ID NO: 7162 - RNA, 17 nt, Artificial Sequence
  Synthetic
gcuucucgcccaggacc

SEQ ID NO: 7163 - RNA, 17 nt, Artificial Sequence
  Synthetic
augacuuggacuugacc

SEQ ID NO: 7164 - RNA, 17 nt, Artificial Sequence
  Synthetic
aaccugcuaagaauacc

SEQ ID NO: 7165 - RNA, 17 nt, Artificial Sequence
  Synthetic
aagggcggcuugcuacc

SEQ ID NO: 7166 - RNA, 17 nt, Artificial Sequence
  Synthetic
cgaccacgcgugcaccc

SEQ ID NO: 7167 - RNA, 17 nt, Artificial Sequence
  Synthetic
gaaaauuugaagccccc

SEQ ID NO: 7168 - RNA, 17 nt, Artificial Sequence
  Synthetic
ccaucucuuccgccccc

SEQ ID NO: 7169 - RNA, 17 nt, Artificial Sequence
  Synthetic
uccucccucccagcccc

SEQ ID NO: 7170 - RNA, 17 nt, Artificial Sequence
  Synthetic
ggaguucgaccugcccc

SEQ ID NO: 7171 - RNA, 17 nt, Artificial Sequence
  Synthetic
ccuccguccagcucccc

SEQ ID NO: 7172 - RNA, 17 nt, Artificial Sequence
  Synthetic
ggccgcggcugcucccc

SEQ ID NO: 7173 - RNA, 17 nt, Artificial Sequence
  Synthetic
agcccaccgcugucccc

SEQ ID NO: 7174 - RNA, 17 nt, Artificial Sequence
  Synthetic
gcuucuccacaccgccc

SEQ ID NO: 7175 - RNA, 17 nt, Artificial Sequence
  Synthetic
ccgaggccgacucgccc

SEQ ID NO: 7176 - RNA, 17 nt, Artificial Sequence
  Synthetic
gcuuaugcuucucgccc

SEQ ID NO: 7177 - RNA, 17 nt, Artificial Sequence
  Synthetic
auuagugguccgggccc

SEQ ID NO: 7178 - RNA, 17 nt, Artificial Sequence
  Synthetic
ggcggaagagauggccc

SEQ ID NO: 7179 - RNA, 17 nt, Artificial Sequence
  Synthetic
uugagcugggccugccc

SEQ ID NO: 7180 - RNA, 17 nt, Artificial Sequence
  Synthetic
cuccaccgccagcuccc

SEQ ID NO: 7181 - RNA, 17 nt, Artificial Sequence
  Synthetic
cccuccguccagcuccc

SEQ ID NO: 7182 - RNA, 17 nt, Artificial Sequence
  Synthetic
uggccgcggcugcuccc

SEQ ID NO: 7183 - RNA, 17 nt, Artificial Sequence
  Synthetic
cugcaaccauuccagcc

SEQ ID NO: 7184 - RNA, 17 nt, Artificial Sequence
  Synthetic
cggcuucgggcugagcc

SEQ ID NO: 7185 - RNA, 17 nt, Artificial Sequence
  Synthetic
cgcuucuccacaccgcc

SEQ ID NO: 7186 - RNA, 17 nt, Artificial Sequence
  Synthetic
ccaccgcauagagcgcc

SEQ ID NO: 7187 - RNA, 17 nt, Artificial Sequence
  Synthetic
cccgaggccgacucgcc

SEQ ID NO: 7188 - RNA, 17 nt, Artificial Sequence
  Synthetic
ggagggggggcgucgcc

SEQ ID NO: 7189 - RNA, 17 nt, Artificial Sequence
  Synthetic
auagggcugggccggcc

SEQ ID NO: 7190 - RNA, 17 nt, Artificial Sequence
  Synthetic
gagagaggcuuccggcc

SEQ ID NO: 7191 - RNA, 17 nt, Artificial Sequence
  Synthetic
uguugggcaucgcggcc

SEQ ID NO: 7192 - RNA, 17 nt, Artificial Sequence
  Synthetic
ggcccucggccucggcc

SEQ ID NO: 7193 - RNA, 17 nt, Artificial Sequence
  Synthetic
cugggccugcccgggcc

SEQ ID NO: 7194 - RNA, 17 nt, Artificial Sequence
  Synthetic
uauuagugguccgggcc

SEQ ID NO: 7195 - RNA, 17 nt, Artificial Sequence
  Synthetic
gcuucagcuugcuggcc

SEQ ID NO: 7196 - RNA, 17 nt, Artificial Sequence
  Synthetic
ucgggugauggguggcc

SEQ ID NO: 7197 - RNA, 17 nt, Artificial Sequence
  Synthetic
uuugagcugggccugcc

SEQ ID NO: 7198 - RNA, 17 nt, Artificial Sequence
  Synthetic
gggaucuuugagcugcc

SEQ ID NO: 7199 - RNA, 17 nt, Artificial Sequence
  Synthetic
gaaagcgcccuucugcc

SEQ ID NO: 7200 - RNA, 17 nt, Artificial Sequence
  Synthetic
accaagucgcuggugcc

SEQ ID NO: 7201 - RNA, 17 nt, Artificial Sequence
  Synthetic
ucucucgauacugaucc

SEQ ID NO: 7202 - RNA, 17 nt, Artificial Sequence
  Synthetic
cgaccccaaccugaucc

SEQ ID NO: 7203 - RNA, 17 nt, Artificial Sequence
  Synthetic
gguggcgcgccgccucc

SEQ ID NO: 7204 - RNA, 17 nt, Artificial Sequence
  Synthetic
ccggcuacgcggccucc

SEQ ID NO: 7205 - RNA, 17 nt, Artificial Sequence
  Synthetic
ccucguccccguucucc

SEQ ID NO: 7206 - RNA, 17 nt, Artificial Sequence
  Synthetic
ggccuuccaccaggucc

SEQ ID NO: 7207 - RNA, 17 nt, Artificial Sequence
  Synthetic
ccccauauuaguggucc

SEQ ID NO: 7208 - RNA, 17 nt, Artificial Sequence
  Synthetic
uagcaagccgcccuucc

SEQ ID NO: 7209 - RNA, 17 nt, Artificial Sequence
  Synthetic
cgcuggugccggguucc

SEQ ID NO: 7210 - RNA, 17 nt, Artificial Sequence
  Synthetic
uaggagacuuagagagc

SEQ ID NO: 7211 - RNA, 17 nt, Artificial Sequence
  Synthetic
gaaggggcucagcgagc

SEQ ID NO: 7212 - RNA, 17 nt, Artificial Sequence
  Synthetic
cacaccgcccggggagc

SEQ ID NO: 7213 - RNA, 17 nt, Artificial Sequence
  Synthetic
gccggguuccggggagc

SEQ ID NO: 7214 - RNA, 17 nt, Artificial Sequence
  Synthetic
ucugcccucuuuugagc

SEQ ID NO: 7215 - RNA, 17 nt, Artificial Sequence
  Synthetic
ccuggaggccgcguagc

SEQ ID NO: 7216 - RNA, 17 nt, Artificial Sequence
  Synthetic
auccugguauucuuagc

SEQ ID NO: 7217 - RNA, 17 nt, Artificial Sequence
  Synthetic
aagggauaccaacccgc

SEQ ID NO: 7218 - RNA, 17 nt, Artificial Sequence
  Synthetic
aaguccccugaccccgc

SEQ ID NO: 7219 - RNA, 17 nt, Artificial Sequence
  Synthetic
cgcccguguggcugcgc

SEQ ID NO: 7220 - RNA, 17 nt, Artificial Sequence
  Synthetic
uaugcgguccgacucgc

SEQ ID NO: 7221 - RNA, 17 nt, Artificial Sequence
  Synthetic
ccacgagaacagcucgc

SEQ ID NO: 7222 - RNA, 17 nt, Artificial Sequence
  Synthetic
uacucgcaguggcucgc

SEQ ID NO: 7223 - RNA, 17 nt, Artificial Sequence
  Synthetic
gcugcccaccaagucgc

SEQ ID NO: 7224 - RNA, 17 nt, Artificial Sequence
  Synthetic
caccgcuguccccaggc

SEQ ID NO: 7225 - RNA, 17 nt, Artificial Sequence
  Synthetic
gcgcccuucugccaggc

SEQ ID NO: 7226 - RNA, 17 nt, Artificial Sequence
  Synthetic
guguugggcaucgcggc

SEQ ID NO: 7227 - RNA, 17 nt, Artificial Sequence
  Synthetic
uaaccuuugcauagggc

SEQ ID NO: 7228 - RNA, 17 nt, Artificial Sequence
  Synthetic
gugguccgggcccgggc

SEQ ID NO: 7229 - RNA, 17 nt, Artificial Sequence
  Synthetic
ccugcaugacgucgggc

SEQ ID NO: 7230 - RNA, 17 nt, Artificial Sequence
  Synthetic
uggacuugaccgggggc

SEQ ID NO: 7231 - RNA, 17 nt, Artificial Sequence
  Synthetic
gcaucgcggccgggggc

SEQ ID NO: 7232 - RNA, 17 nt, Artificial Sequence
  Synthetic
uuugcauagggcugggc

SEQ ID NO: 7233 - RNA, 17 nt, Artificial Sequence
  Synthetic
cuagagaaauccauggc

SEQ ID NO: 7234 - RNA, 17 nt, Artificial Sequence
  Synthetic
gcggcuugcuaccuggc

SEQ ID NO: 7235 - RNA, 17 nt, Artificial Sequence
  Synthetic
agacuuagagagcuggc

SEQ ID NO: 7236 - RNA, 17 nt, Artificial Sequence
  Synthetic
ucccauggagagguggc

SEQ ID NO: 7237 - RNA, 17 nt, Artificial Sequence
  Synthetic
gacgaagacucgguggc

SEQ ID NO: 7238 - RNA, 17 nt, Artificial Sequence
  Synthetic
ccugcccgacgucaugc

SEQ ID NO: 7239 - RNA, 17 nt, Artificial Sequence
  Synthetic
uguacauguguagcugc

SEQ ID NO: 7240 - RNA, 17 nt, Artificial Sequence
  Synthetic
ggacuugagcgcgcugc

SEQ ID NO: 7241 - RNA, 17 nt, Artificial Sequence
  Synthetic
guccaaaaagcugcugc

SEQ ID NO: 7242 - RNA, 17 nt, Artificial Sequence
  Synthetic
caccaagucgcuggugc

SEQ ID NO: 7243 - RNA, 17 nt, Artificial Sequence
  Synthetic
guggcgcuucagcuugc

SEQ ID NO: 7244 - RNA, 17 nt, Artificial Sequence
  Synthetic
ccccguucuccgggauc

SEQ ID NO: 7245 - RNA, 17 nt, Artificial Sequence
  Synthetic
cccugucaaaggcacuc

SEQ ID NO: 7246 - RNA, 17 nt, Artificial Sequence
  Synthetic
ccgggcgagucggccuc

SEQ ID NO: 7247 - RNA, 17 nt, Artificial Sequence
  Synthetic
cuggacggagggaucuc

SEQ ID NO: 7248 - RNA, 17 nt, Artificial Sequence
  Synthetic
acacaucuugagcucuc

SEQ ID NO: 7249 - RNA, 17 nt, Artificial Sequence
  Synthetic
uccucguccccguucuc

SEQ ID NO: 7250 - RNA, 17 nt, Artificial Sequence
  Synthetic
augcccugcaugacguc

SEQ ID NO: 7251 - RNA, 17 nt, Artificial Sequence
  Synthetic
uaccaacccgcgggguc

SEQ ID NO: 7252 - RNA, 17 nt, Artificial Sequence
  Synthetic
gccccauauuagugguc

SEQ ID NO: 7253 - RNA, 17 nt, Artificial Sequence
  Synthetic
ggcaaaaggcgauuguc

SEQ ID NO: 7254 - RNA, 17 nt, Artificial Sequence
  Synthetic
cggguugguaucccuuc

SEQ ID NO: 7255 - RNA, 17 nt, Artificial Sequence
  Synthetic
guaucgagagaggcuuc

SEQ ID NO: 7256 - RNA, 17 nt, Artificial Sequence
  Synthetic
ggguggacuacggcuuc

SEQ ID NO: 7257 - RNA, 17 nt, Artificial Sequence
  Synthetic
ucgcuggugccggguuc

SEQ ID NO: 7258 - RNA, 17 nt, Artificial Sequence
  Synthetic
caggcccagcucaaaag

SEQ ID NO: 7259 - RNA, 17 nt, Artificial Sequence
  Synthetic
gugaagaaccuagaaag

SEQ ID NO: 7260 - RNA, 17 nt, Artificial Sequence
  Synthetic
uucuuagcagguuaaag

SEQ ID NO: 7261 - RNA, 17 nt, Artificial Sequence
  Synthetic
cgaggaagaggaagaag

SEQ ID NO: 7262 - RNA, 17 nt, Artificial Sequence
  Synthetic
ugaugcgcuuagagaag

SEQ ID NO: 7263 - RNA, 17 nt, Artificial Sequence
  Synthetic
ggaggacgacgaggaag

SEQ ID NO: 7264 - RNA, 17 nt, Artificial Sequence
  Synthetic
ggaagaagaggaggaag

SEQ ID NO: 7265 - RNA, 17 nt, Artificial Sequence
  Synthetic
cggggacgaggaggaag

SEQ ID NO: 7266 - RNA, 17 nt, Artificial Sequence
  Synthetic
cgcagcggcacgggaag

SEQ ID NO: 7267 - RNA, 17 nt, Artificial Sequence
  Synthetic
ggugguggacuaaacag

SEQ ID NO: 7268 - RNA, 17 nt, Artificial Sequence
  Synthetic
aaagagguuggagacag

SEQ ID NO: 7269 - RNA, 17 nt, Artificial Sequence
  Synthetic
ggccggccuggggacag

SEQ ID NO: 7270 - RNA, 17 nt, Artificial Sequence
  Synthetic
aaauuugaagcccccag

SEQ ID NO: 7271 - RNA, 17 nt, Artificial Sequence
  Synthetic
gggaucucggggcgcag

SEQ ID NO: 7272 - RNA, 17 nt, Artificial Sequence
  Synthetic
agaacguguacucgcag

SEQ ID NO: 7273 - RNA, 17 nt, Artificial Sequence
  Synthetic
ggaggggcggauugcag

SEQ ID NO: 7274 - RNA, 17 nt, Artificial Sequence
  Synthetic
ccaacccgcggggucag

SEQ ID NO: 7275 - RNA, 17 nt, Artificial Sequence
  Synthetic
aggaucaguaucgagag

SEQ ID NO: 7276 - RNA, 17 nt, Artificial Sequence
  Synthetic
agcugacggagagcgag

SEQ ID NO: 7277 - RNA, 17 nt, Artificial Sequence
  Synthetic
gguuggagacagaggag

SEQ ID NO: 7278 - RNA, 17 nt, Artificial Sequence
  Synthetic
gggcugggagggaggag

SEQ ID NO: 7279 - RNA, 17 nt, Artificial Sequence
  Synthetic
gauugcagaggagggag

SEQ ID NO: 7280 - RNA, 17 nt, Artificial Sequence
  Synthetic
acuaaacagggggggag

SEQ ID NO: 7281 - RNA, 17 nt, Artificial Sequence
  Synthetic
auaugaaucccauggag

SEQ ID NO: 7282 - RNA, 17 nt, Artificial Sequence
  Synthetic
agcacgccccauauuag

SEQ ID NO: 7283 - RNA, 17 nt, Artificial Sequence
  Synthetic
ccugaucccggagaacg

SEQ ID NO: 7284 - RNA, 17 nt, Artificial Sequence
  Synthetic
ggaagaggaggacgacg

SEQ ID NO: 7285 - RNA, 17 nt, Artificial Sequence
  Synthetic
cgaggagugcuccgacg

SEQ ID NO: 7286 - RNA, 17 nt, Artificial Sequence
  Synthetic
cccggagaacggggacg

SEQ ID NO: 7287 - RNA, 17 nt, Artificial Sequence
  Synthetic
guggcucgccggcuacg

SEQ ID NO: 7288 - RNA, 17 nt, Artificial Sequence
  Synthetic
ugacuuggacuugaccg

SEQ ID NO: 7289 - RNA, 17 nt, Artificial Sequence
  Synthetic
gaagggauaccaacccg

SEQ ID NO: 7290 - RNA, 17 nt, Artificial Sequence
  Synthetic
gaaguccccugaccccg

SEQ ID NO: 7291 - RNA, 17 nt, Artificial Sequence
  Synthetic
uuuggacaggccccccg

SEQ ID NO: 7292 - RNA, 17 nt, Artificial Sequence
  Synthetic
cuucuccacaccgcccg

SEQ ID NO: 7293 - RNA, 17 nt, Artificial Sequence
  Synthetic
cgaggccgacucgcccg

SEQ ID NO: 7294 - RNA, 17 nt, Artificial Sequence
  Synthetic
cgcccggggagcagccg

SEQ ID NO: 7295 - RNA, 17 nt, Artificial Sequence
  Synthetic
ccaccuggccgaggccg

SEQ ID NO: 7296 - RNA, 17 nt, Artificial Sequence
  Synthetic
guugggcaucgcggccg

SEQ ID NO: 7297 - RNA, 17 nt, Artificial Sequence
  Synthetic
ggcacuguuaauggccg

SEQ ID NO: 7298 - RNA, 17 nt, Artificial Sequence
  Synthetic
gcgcggccaccuggccg

SEQ ID NO: 7299 - RNA, 17 nt, Artificial Sequence
  Synthetic
caaacucccguucuccg

SEQ ID NO: 7300 - RNA, 17 nt, Artificial Sequence
  Synthetic
cagcgcgcucaaguccg

SEQ ID NO: 7301 - RNA, 17 nt, Artificial Sequence
  Synthetic
gcuggugccggguuccg

SEQ ID NO: 7302 - RNA, 17 nt, Artificial Sequence
  Synthetic
ggcgagaagcauaagcg

SEQ ID NO: 7303 - RNA, 17 nt, Artificial Sequence
  Synthetic
caugcagcacuucagcg

SEQ ID NO: 7304 - RNA, 17 nt, Artificial Sequence
  Synthetic
uggccugggugcacgcg

SEQ ID NO: 7305 - RNA, 17 nt, Artificial Sequence
  Synthetic
agggauaccaacccgcg

SEQ ID NO: 7306 - RNA, 17 nt, Artificial Sequence
  Synthetic
cacgagaacagcucgcg

SEQ ID NO: 7307 - RNA, 17 nt, Artificial Sequence
  Synthetic
ugacgucgggcagggcg

SEQ ID NO: 7308 - RNA, 17 nt, Artificial Sequence
  Synthetic
gaacagcucgcggggcg

SEQ ID NO: 7309 - RNA, 17 nt, Artificial Sequence
  Synthetic
gggcgcggucgugggcg

SEQ ID NO: 7310 - RNA, 17 nt, Artificial Sequence
  Synthetic
cuccguguugggcaucg

SEQ ID NO: 7311 - RNA, 17 nt, Artificial Sequence
  Synthetic
cgggcgagucggccucg

SEQ ID NO: 7312 - RNA, 17 nt, Artificial Sequence
  Synthetic
accacgagaacagcucg

SEQ ID NO: 7313 - RNA, 17 nt, Artificial Sequence
  Synthetic
uggacggagggaucucg

SEQ ID NO: 7314 - RNA, 17 nt, Artificial Sequence
  Synthetic
cccgcgagcuguucucg

SEQ ID NO: 7315 - RNA, 17 nt, Artificial Sequence
  Synthetic
cucgcggggcgcggucg

SEQ ID NO: 7316 - RNA, 17 nt, Artificial Sequence
  Synthetic
gugguggacuaaacagg

SEQ ID NO: 7317 - RNA, 17 nt, Artificial Sequence
  Synthetic
ccucggccucggccagg

SEQ ID NO: 7318 - RNA, 17 nt, Artificial Sequence
  Synthetic
ggaagaggaagaagagg

SEQ ID NO: 7319 - RNA, 17 nt, Artificial Sequence
  Synthetic
agaagaggaggaagagg

SEQ ID NO: 7320 - RNA, 17 nt, Artificial Sequence
  Synthetic
ggacgaggaggaagagg

SEQ ID NO: 7321 - RNA, 17 nt, Artificial Sequence
  Synthetic
gagguuggagacagagg

SEQ ID NO: 7322 - RNA, 17 nt, Artificial Sequence
  Synthetic
ggggcggauugcagagg

SEQ ID NO: 7323 - RNA, 17 nt, Artificial Sequence
  Synthetic
ugaaucccauggagagg

SEQ ID NO: 7324 - RNA, 17 nt, Artificial Sequence
  Synthetic
ggagugcuccgacgagg

SEQ ID NO: 7325 - RNA, 17 nt, Artificial Sequence
  Synthetic
ggagaacggggacgagg

SEQ ID NO: 7326 - RNA, 17 nt, Artificial Sequence
  Synthetic
agaggaggaagaggagg

SEQ ID NO: 7327 - RNA, 17 nt, Artificial Sequence
  Synthetic
guuggagacagaggagg

SEQ ID NO: 7328 - RNA, 17 nt, Artificial Sequence
  Synthetic
ggaggaagaggaggagg

SEQ ID NO: 7329 - RNA, 17 nt, Artificial Sequence
  Synthetic
auugcagaggagggagg

SEQ ID NO: 7330 - RNA, 17 nt, Artificial Sequence
  Synthetic
gggggcugggagggagg

SEQ ID NO: 7331 - RNA, 17 nt, Artificial Sequence
  Synthetic
cgggcugagccuggagg

SEQ ID NO: 7332 - RNA, 17 nt, Artificial Sequence
  Synthetic
cccggggagcuggacgg

SEQ ID NO: 7333 - RNA, 17 nt, Artificial Sequence
  Synthetic
gacuuggacuugaccgg

SEQ ID NO: 7334 - RNA, 17 nt, Artificial Sequence
  Synthetic
uugggcaucgcggccgg

SEQ ID NO: 7335 - RNA, 17 nt, Artificial Sequence
  Synthetic
cggccuggggacagcgg

SEQ ID NO: 7336 - RNA, 17 nt, Artificial Sequence
  Synthetic
uuccggggagcuggcgg

SEQ ID NO: 7337 - RNA, 17 nt, Artificial Sequence
  Synthetic
ccaggcgcucuaugcgg

SEQ ID NO: 7338 - RNA, 17 nt, Artificial Sequence
  Synthetic
uugcgacgaagacucgg

SEQ ID NO: 7339 - RNA, 17 nt, Artificial Sequence
  Synthetic
gggcgagucggccucgg

SEQ ID NO: 7340 - RNA, 17 nt, Artificial Sequence
  Synthetic
uccaagugaugucucgg

SEQ ID NO: 7341 - RNA, 17 nt, Artificial Sequence
  Synthetic
ggcgucgccaggaaggg

SEQ ID NO: 7342 - RNA, 17 nt, Artificial Sequence
  Synthetic
ugguggacuaaacaggg

SEQ ID NO: 7343 - RNA, 17 nt, Artificial Sequence
  Synthetic
gacggagagcgagaggg

SEQ ID NO: 7344 - RNA, 17 nt, Artificial Sequence
  Synthetic
cggauugcagaggaggg

SEQ ID NO: 7345 - RNA, 17 nt, Artificial Sequence
  Synthetic
uugcagaggagggaggg

SEQ ID NO: 7346 - RNA, 17 nt, Artificial Sequence
  Synthetic
accgggggcugggaggg

SEQ ID NO: 7347 - RNA, 17 nt, Artificial Sequence
  Synthetic
ccguccagcuccccggg

SEQ ID NO: 7348 - RNA, 17 nt, Artificial Sequence
  Synthetic
gagaaauccauggcggg

SEQ ID NO: 7349 - RNA, 17 nt, Artificial Sequence
  Synthetic
ggcgagucggccucggg

SEQ ID NO: 7350 - RNA, 17 nt, Artificial Sequence
  Synthetic
gguggacuaaacagggg

SEQ ID NO: 7351 - RNA, 17 nt, Artificial Sequence
  Synthetic
uuugaagcccccagggg

SEQ ID NO: 7352 - RNA, 17 nt, Artificial Sequence
  Synthetic
cugggagggaggagggg

SEQ ID NO: 7353 - RNA, 17 nt, Artificial Sequence
  Synthetic
ugcagaggagggagggg

SEQ ID NO: 7354 - RNA, 17 nt, Artificial Sequence
  Synthetic
cauagagcgccuggggg

SEQ ID NO: 7355 - RNA, 17 nt, Artificial Sequence
  Synthetic
agcccccaggggugggg

SEQ ID NO: 7356 - RNA, 17 nt, Artificial Sequence
  Synthetic
ggcacucgggugauggg

SEQ ID NO: 7357 - RNA, 17 nt, Artificial Sequence
  Synthetic
cuugaccgggggcuggg

SEQ ID NO: 7358 - RNA, 17 nt, Artificial Sequence
  Synthetic
aacagggggggaguggg

SEQ ID NO: 7359 - RNA, 17 nt, Artificial Sequence
  Synthetic
gguacuacgccgaaugg

SEQ ID NO: 7360 - RNA, 17 nt, Artificial Sequence
  Synthetic
ccuagagaaauccaugg

SEQ ID NO: 7361 - RNA, 17 nt, Artificial Sequence
  Synthetic
ggacuugaccgucaugg

SEQ ID NO: 7362 - RNA, 17 nt, Artificial Sequence
  Synthetic
auuucagagcaaccugg

SEQ ID NO: 7363 - RNA, 17 nt, Artificial Sequence
  Synthetic
ucucgcccaggaccugg

SEQ ID NO: 7364 - RNA, 17 nt, Artificial Sequence
  Synthetic
cuucgggcugagccugg

SEQ ID NO: 7365 - RNA, 17 nt, Artificial Sequence
  Synthetic
ccgcauagagcgccugg

SEQ ID NO: 7366 - RNA, 17 nt, Artificial Sequence
  Synthetic
aucuuugagcugccugg

SEQ ID NO: 7367 - RNA, 17 nt, Artificial Sequence
  Synthetic
ggguuccggggagcugg

SEQ ID NO: 7368 - RNA, 17 nt, Artificial Sequence
  Synthetic
agcggcacgggaagugg

SEQ ID NO: 7369 - RNA, 17 nt, Artificial Sequence
  Synthetic
cgcgcucaaguccgugg

SEQ ID NO: 7370 - RNA, 17 nt, Artificial Sequence
  Synthetic
gcgagcuguucucgugg

SEQ ID NO: 7371 - RNA, 17 nt, Artificial Sequence
  Synthetic
ggcgcucuaugcggugg

SEQ ID NO: 7372 - RNA, 17 nt, Artificial Sequence
  Synthetic
aagugaugucucggugg

SEQ ID NO: 7373 - RNA, 17 nt, Artificial Sequence
  Synthetic
cggcaccagcgacuugg

SEQ ID NO: 7374 - RNA, 17 nt, Artificial Sequence
  Synthetic
ggguacuacgccgaaug

SEQ ID NO: 7375 - RNA, 17 nt, Artificial Sequence
  Synthetic
cggacuugaccgucaug

SEQ ID NO: 7376 - RNA, 17 nt, Artificial Sequence
  Synthetic
gcaugugcgucuucaug

SEQ ID NO: 7377 - RNA, 17 nt, Artificial Sequence
  Synthetic
cccggaccacuaauaug

SEQ ID NO: 7378 - RNA, 17 nt, Artificial Sequence
  Synthetic
cccccaggcgcucuaug

SEQ ID NO: 7379 - RNA, 17 nt, Artificial Sequence
  Synthetic
cagugccaucgucuaug

SEQ ID NO: 7380 - RNA, 17 nt, Artificial Sequence
  Synthetic
gacacuugugaguacug

SEQ ID NO: 7381 - RNA, 17 nt, Artificial Sequence
  Synthetic
cgucgcaagugucccug

SEQ ID NO: 7382 - RNA, 17 nt, Artificial Sequence
  Synthetic
accgcauagagcgccug

SEQ ID NO: 7383 - RNA, 17 nt, Artificial Sequence
  Synthetic
agggcugggccggccug

SEQ ID NO: 7384 - RNA, 17 nt, Artificial Sequence
  Synthetic
aggggcucagcgagcug

SEQ ID NO: 7385 - RNA, 17 nt, Artificial Sequence
  Synthetic
ccuuugacagggugcug

SEQ ID NO: 7386 - RNA, 17 nt, Artificial Sequence
  Synthetic
aagucaugcgaguucug

SEQ ID NO: 7387 - RNA, 17 nt, Artificial Sequence
  Synthetic
agggcuucucgcccgug

SEQ ID NO: 7388 - RNA, 17 nt, Artificial Sequence
  Synthetic
cagcuccccgggcggug

SEQ ID NO: 7389 - RNA, 17 nt, Artificial Sequence
  Synthetic
aggcgcucuaugcggug

SEQ ID NO: 7390 - RNA, 17 nt, Artificial Sequence
  Synthetic
ugaagcccccaggggug

SEQ ID NO: 7391 - RNA, 17 nt, Artificial Sequence
  Synthetic
agagagcucaagaugug

SEQ ID NO: 7392 - RNA, 17 nt, Artificial Sequence
  Synthetic
ucuccgggaucagguug

SEQ ID NO: 7393 - RNA, 17 nt, Artificial Sequence
  Synthetic
uggguacuacgccgaau

SEQ ID NO: 7394 - RNA, 17 nt, Artificial Sequence
  Synthetic
ggaggcuccauagccau

SEQ ID NO: 7395 - RNA, 17 nt, Artificial Sequence
  Synthetic
cccagccaccucuccau

SEQ ID NO: 7396 - RNA, 17 nt, Artificial Sequence
  Synthetic
ugcaguaaccuuugcau

SEQ ID NO: 7397 - RNA, 17 nt, Artificial Sequence
  Synthetic
ucggacuugaccgucau

SEQ ID NO: 7398 - RNA, 17 nt, Artificial Sequence
  Synthetic
aaaggcacucgggugau

SEQ ID NO: 7399 - RNA, 17 nt, Artificial Sequence
  Synthetic
gcccggaccacuaauau

SEQ ID NO: 7400 - RNA, 17 nt, Artificial Sequence
  Synthetic
guucucgcucuugaacu

SEQ ID NO: 7401 - RNA, 17 nt, Artificial Sequence
  Synthetic
acccugucaaaggcacu

SEQ ID NO: 7402 - RNA, 17 nt, Artificial Sequence
  Synthetic
accaccgagacaucacu

SEQ ID NO: 7403 - RNA, 17 nt, Artificial Sequence
  Synthetic
cacuugcgacgaagacu

SEQ ID NO: 7404 - RNA, 17 nt, Artificial Sequence
  Synthetic
acccggcaccagcgacu

SEQ ID NO: 7405 - RNA, 17 nt, Artificial Sequence
  Synthetic
gguaucccuucaggacu

SEQ ID NO: 7406 - RNA, 17 nt, Artificial Sequence
  Synthetic
gcagaacucgcaugacu

SEQ ID NO: 7407 - RNA, 17 nt, Artificial Sequence
  Synthetic
agugucccuguggcccu

SEQ ID NO: 7408 - RNA, 17 nt, Artificial Sequence
  Synthetic
caccgcauagagcgccu

SEQ ID NO: 7409 - RNA, 17 nt, Artificial Sequence
  Synthetic
uagggcugggccggccu

SEQ ID NO: 7410 - RNA, 17 nt, Artificial Sequence
  Synthetic
ccuguggcccucggccu

SEQ ID NO: 7411 - RNA, 17 nt, Artificial Sequence
  Synthetic
cccgggcgagucggccu

SEQ ID NO: 7412 - RNA, 17 nt, Artificial Sequence
  Synthetic
cuucagcuugcuggccu

SEQ ID NO: 7413 - RNA, 17 nt, Artificial Sequence
  Synthetic
cucgucggagcacuccu

SEQ ID NO: 7414 - RNA, 17 nt, Artificial Sequence
  Synthetic
gccuuccaccagguccu

SEQ ID NO: 7415 - RNA, 17 nt, Artificial Sequence
  Synthetic
aaggggcucagcgagcu

SEQ ID NO: 7416 - RNA, 17 nt, Artificial Sequence
  Synthetic
cugcccucuuuugagcu

SEQ ID NO: 7417 - RNA, 17 nt, Artificial Sequence
  Synthetic
aaccuuugcauagggcu

SEQ ID NO: 7418 - RNA, 17 nt, Artificial Sequence
  Synthetic
ggacuugaccgggggcu

SEQ ID NO: 7419 - RNA, 17 nt, Artificial Sequence
  Synthetic
cccauggagagguggcu

SEQ ID NO: 7420 - RNA, 17 nt, Artificial Sequence
  Synthetic
guacauguguagcugcu

SEQ ID NO: 7421 - RNA, 17 nt, Artificial Sequence
  Synthetic
uccaaaaagcugcugcu

SEQ ID NO: 7422 - RNA, 17 nt, Artificial Sequence
  Synthetic
gcuggacggagggaucu

SEQ ID NO: 7423 - RNA, 17 nt, Artificial Sequence
  Synthetic
cacaucuugagcucucu

SEQ ID NO: 7424 - RNA, 17 nt, Artificial Sequence
  Synthetic
ccgccauggauuucucu

SEQ ID NO: 7425 - RNA, 17 nt, Artificial Sequence
  Synthetic
ggguccaagugaugucu

SEQ ID NO: 7426 - RNA, 17 nt, Artificial Sequence
  Synthetic
gucuccaaccucuuucu

SEQ ID NO: 7427 - RNA, 17 nt, Artificial Sequence
  Synthetic
cucgguggccggcgagu

SEQ ID NO: 7428 - RNA, 17 nt, Artificial Sequence
  Synthetic
cugcuccccgggcgagu

SEQ ID NO: 7429 - RNA, 17 nt, Artificial Sequence
  Synthetic
cuaaacagggggggagu

SEQ ID NO: 7430 - RNA, 17 nt, Artificial Sequence
  Synthetic
caugcccugcaugacgu

SEQ ID NO: 7431 - RNA, 17 nt, Artificial Sequence
  Synthetic
ggcgcggucgugggcgu

SEQ ID NO: 7432 - RNA, 17 nt, Artificial Sequence
  Synthetic
gccuuuugccuccucgu

SEQ ID NO: 7433 - RNA, 17 nt, Artificial Sequence
  Synthetic
gguggagagaccgucgu

SEQ ID NO: 7434 - RNA, 17 nt, Artificial Sequence
  Synthetic
ucgcggggcgcggucgu

SEQ ID NO: 7435 - RNA, 17 nt, Artificial Sequence
  Synthetic
guucuccgggaucaggu

SEQ ID NO: 7436 - RNA, 17 nt, Artificial Sequence
  Synthetic
agaaccuagaaagaggu

SEQ ID NO: 7437 - RNA, 17 nt, Artificial Sequence
  Synthetic
ggccuggggacagcggu

SEQ ID NO: 7438 - RNA, 17 nt, Artificial Sequence
  Synthetic
caggcgcucuaugcggu

SEQ ID NO: 7439 - RNA, 17 nt, Artificial Sequence
  Synthetic
ccccugaccccgcgggu

SEQ ID NO: 7440 - RNA, 17 nt, Artificial Sequence
  Synthetic
uugaagcccccaggggu

SEQ ID NO: 7441 - RNA, 17 nt, Artificial Sequence
  Synthetic
ggcaccagcgacuuggu

SEQ ID NO: 7442 - RNA, 17 nt, Artificial Sequence
  Synthetic
acacuugugaguacugu

SEQ ID NO: 7443 - RNA, 17 nt, Artificial Sequence
  Synthetic
guacacguucuccgugu

SEQ ID NO: 7444 - RNA, 17 nt, Artificial Sequence
  Synthetic
gcacagguugcacuugu

SEQ ID NO: 7445 - RNA, 17 nt, Artificial Sequence
  Synthetic
cuucacacacccccauu

SEQ ID NO: 7446 - RNA, 17 nt, Artificial Sequence
  Synthetic
gaucccuuccuuagcuu

SEQ ID NO: 7447 - RNA, 17 nt, Artificial Sequence
  Synthetic
aggguggacuacggcuu

SEQ ID NO: 7448 - RNA, 17 nt, Artificial Sequence
  Synthetic
uucuccgggaucagguu

SEQ ID NO: 7449 - RNA, 17 nt, Artificial Sequence
  Synthetic
uacacguucuccguguu

SEQ ID NO: 7450 - RNA, 17 nt, Artificial Sequence
  Synthetic
gcccagcagcagcuuuu

SEQ ID NO: 7451 - RNA, 17 nt, Artificial Sequence
  Synthetic
agauguguggcaguuuu

SEQ ID NO: 7452 - RNA, 20 nt, Artificial Sequence
  Synthetic
ugcuccgacgaggaggcaaa

SEQ ID NO: 7453 - RNA, 20 nt, Artificial Sequence
  Synthetic
gguauucuuagcagguuaaa

SEQ ID NO: 7454 - RNA, 20 nt, Artificial Sequence
  Synthetic
ggugcugcgguugaauccaa

SEQ ID NO: 7455 - RNA, 20 nt, Artificial Sequence
  Synthetic
gccggcccagcccuaugcaa

SEQ ID NO: 7456 - RNA, 20 nt, Artificial Sequence
  Synthetic
caaccgcagcacccugucaa

SEQ ID NO: 7457 - RNA, 20 nt, Artificial Sequence
  Synthetic
aggcuuccggccuggcagaa

SEQ ID NO: 7458 - RNA, 20 nt, Artificial Sequence
  Synthetic
agcuugaugcgcuuagagaa

SEQ ID NO: 7459 - RNA, 20 nt, Artificial Sequence
  Synthetic
cccaaccugaucccggagaa

SEQ ID NO: 7460 - RNA, 20 nt, Artificial Sequence
  Synthetic
ucggagcacuccucggagaa

SEQ ID NO: 7461 - RNA, 20 nt, Artificial Sequence
  Synthetic
ucucuggguacuacgccgaa

SEQ ID NO: 7462 - RNA, 20 nt, Artificial Sequence
  Synthetic
gagucuccgaagcuaaggaa

SEQ ID NO: 7463 - RNA, 20 nt, Artificial Sequence
  Synthetic
agggggggcgucgccaggaa

SEQ ID NO: 7464 - RNA, 20 nt, Artificial Sequence
  Synthetic
ggcuugcuaccuggcuggaa

SEQ ID NO: 7465 - RNA, 20 nt, Artificial Sequence
  Synthetic
auucugcaccuaguccugaa

SEQ ID NO: 7466 - RNA, 20 nt, Artificial Sequence
  Synthetic
agaaaccaugcacuggugaa

SEQ ID NO: 7467 - RNA, 20 nt, Artificial Sequence
  Synthetic
caaauuuucucagaacuuaa

SEQ ID NO: 7468 - RNA, 20 nt, Artificial Sequence
  Synthetic
ugguauucuuagcagguuaa

SEQ ID NO: 7469 - RNA, 20 nt, Artificial Sequence
  Synthetic
auagacgauggcacuguuaa

SEQ ID NO: 7470 - RNA, 20 nt, Artificial Sequence
  Synthetic
ucucggugguggacuaaaca

SEQ ID NO: 7471 - RNA, 20 nt, Artificial Sequence
  Synthetic
cccggccgcgaugcccaaca

SEQ ID NO: 7472 - RNA, 20 nt, Artificial Sequence
  Synthetic
aucuacuuagaaagcgaaca

SEQ ID NO: 7473 - RNA, 20 nt, Artificial Sequence
  Synthetic
ggugcaccggcgcagccaca

SEQ ID NO: 7474 - RNA, 20 nt, Artificial Sequence
  Synthetic
ggccgaggccgagggccaca

SEQ ID NO: 7475 - RNA, 20 nt, Artificial Sequence
  Synthetic
ucacccgagugccuuugaca

SEQ ID NO: 7476 - RNA, 20 nt, Artificial Sequence
  Synthetic
gcucuugaacuuggccacca

SEQ ID NO: 7477 - RNA, 20 nt, Artificial Sequence
  Synthetic
gagaaaauuugaagccccca

SEQ ID NO: 7478 - RNA, 20 nt, Artificial Sequence
  Synthetic
ugucugcaauaugaauccca

SEQ ID NO: 7479 - RNA, 20 nt, Artificial Sequence
  Synthetic
ggcuauggagccucccgcca

SEQ ID NO: 7480 - RNA, 20 nt, Artificial Sequence
  Synthetic
acucgggugauggguggcca

SEQ ID NO: 7481 - RNA, 20 nt, Artificial Sequence
  Synthetic
aagucuccuagagaaaucca

SEQ ID NO: 7482 - RNA, 20 nt, Artificial Sequence
  Synthetic
ccuucccagccaccucucca

SEQ ID NO: 7483 - RNA, 20 nt, Artificial Sequence
  Synthetic
gaucucggggcgcagcggca

SEQ ID NO: 7484 - RNA, 20 nt, Artificial Sequence
  Synthetic
gcccgacgucaugcagggca

SEQ ID NO: 7485 - RNA, 20 nt, Artificial Sequence
  Synthetic
gcccugcaugacgucgggca

SEQ ID NO: 7486 - RNA, 20 nt, Artificial Sequence
  Synthetic
ggagacuuagagagcuggca

SEQ ID NO: 7487 - RNA, 20 nt, Artificial Sequence
  Synthetic
gcccugcccgacgucaugca

SEQ ID NO: 7488 - RNA, 20 nt, Artificial Sequence
  Synthetic
ggccucgcugaagugcugca

SEQ ID NO: 7489 - RNA, 20 nt, Artificial Sequence
  Synthetic
aacagccauucaccagugca

SEQ ID NO: 7490 - RNA, 20 nt, Artificial Sequence
  Synthetic
caacacgcacagaacacuca

SEQ ID NO: 7491 - RNA, 20 nt, Artificial Sequence
  Synthetic
gucgucggacuugaccguca

SEQ ID NO: 7492 - RNA, 20 nt, Artificial Sequence
  Synthetic
gauaccaacccgcgggguca

SEQ ID NO: 7493 - RNA, 20 nt, Artificial Sequence
  Synthetic
ggcaggcccagcucaaaaga

SEQ ID NO: 7494 - RNA, 20 nt, Artificial Sequence
  Synthetic
gaggcuuccggccuggcaga

SEQ ID NO: 7495 - RNA, 20 nt, Artificial Sequence
  Synthetic
gcgccugggggcggaagaga

SEQ ID NO: 7496 - RNA, 20 nt, Artificial Sequence
  Synthetic
gagcuugaugcgcuuagaga

SEQ ID NO: 7497 - RNA, 20 nt, Artificial Sequence
  Synthetic
ggagcugacggagagcgaga

SEQ ID NO: 7498 - RNA, 20 nt, Artificial Sequence
  Synthetic
uaagcgcaucaagcucgaga

SEQ ID NO: 7499 - RNA, 20 nt, Artificial Sequence
  Synthetic
gagucggaccgcauagacga

SEQ ID NO: 7500 - RNA, 20 nt, Artificial Sequence
  Synthetic
augacggucaaguccgacga

SEQ ID NO: 7501 - RNA, 20 nt, Artificial Sequence
  Synthetic
ggccaccuggccgaggccga

SEQ ID NO: 7502 - RNA, 20 nt, Artificial Sequence
  Synthetic
ggagucuccgaagcuaagga

SEQ ID NO: 7503 - RNA, 20 nt, Artificial Sequence
  Synthetic
gagggggggcgucgccagga

SEQ ID NO: 7504 - RNA, 20 nt, Artificial Sequence
  Synthetic
aagagguuggagacagagga

SEQ ID NO: 7505 - RNA, 20 nt, Artificial Sequence
  Synthetic
gaggggcggauugcagagga

SEQ ID NO: 7506 - RNA, 20 nt, Artificial Sequence
  Synthetic
ccgggggcugggagggagga

SEQ ID NO: 7507 - RNA, 20 nt, Artificial Sequence
  Synthetic
cgcccggggagcuggacgga

SEQ ID NO: 7508 - RNA, 20 nt, Artificial Sequence
  Synthetic
gauguguggcaguuuucgga

SEQ ID NO: 7509 - RNA, 20 nt, Artificial Sequence
  Synthetic
ggcggauugcagaggaggga

SEQ ID NO: 7510 - RNA, 20 nt, Artificial Sequence
  Synthetic
gacuugaccgggggcuggga

SEQ ID NO: 7511 - RNA, 20 nt, Artificial Sequence
  Synthetic
ccauggagagguggcuggga

SEQ ID NO: 7512 - RNA, 20 nt, Artificial Sequence
  Synthetic
acaccgcccggggagcugga

SEQ ID NO: 7513 - RNA, 20 nt, Artificial Sequence
  Synthetic
gcagcggcacgggaagugga

SEQ ID NO: 7514 - RNA, 20 nt, Artificial Sequence
  Synthetic
cucgcccaggaccuggugga

SEQ ID NO: 7515 - RNA, 20 nt, Artificial Sequence
  Synthetic
gcacaaaucgucccccauga

SEQ ID NO: 7516 - RNA, 20 nt, Artificial Sequence
  Synthetic
cauucugcaccuaguccuga

SEQ ID NO: 7517 - RNA, 20 nt, Artificial Sequence
  Synthetic
agaggaggaggaggagcuga

SEQ ID NO: 7518 - RNA, 20 nt, Artificial Sequence
  Synthetic
ugucaaaggcacucggguga

SEQ ID NO: 7519 - RNA, 20 nt, Artificial Sequence
  Synthetic
ccgggcccggaccacuaaua

SEQ ID NO: 7520 - RNA, 20 nt, Artificial Sequence
  Synthetic
guugcaguaaccuuugcaua

SEQ ID NO: 7521 - RNA, 20 nt, Artificial Sequence
  Synthetic
gagagcgagaggguggacua

SEQ ID NO: 7522 - RNA, 20 nt, Artificial Sequence
  Synthetic
gucuggagucuccgaagcua

SEQ ID NO: 7523 - RNA, 20 nt, Artificial Sequence
  Synthetic
gcgguugaauccaauggcua

SEQ ID NO: 7524 - RNA, 20 nt, Artificial Sequence
  Synthetic
ucgcacagguugcacuugua

SEQ ID NO: 7525 - RNA, 20 nt, Artificial Sequence
  Synthetic
ucaaauuuucucagaacuua

SEQ ID NO: 7526 - RNA, 20 nt, Artificial Sequence
  Synthetic
gucucggugguggacuaaac

SEQ ID NO: 7527 - RNA, 20 nt, Artificial Sequence
  Synthetic
ccaaccugaucccggagaac

SEQ ID NO: 7528 - RNA, 20 nt, Artificial Sequence
  Synthetic
cggagcacuccucggagaac

SEQ ID NO: 7529 - RNA, 20 nt, Artificial Sequence
  Synthetic
gugcaccggcgcagccacac

SEQ ID NO: 7530 - RNA, 20 nt, Artificial Sequence
  Synthetic
uggccgaggccgagggccac

SEQ ID NO: 7531 - RNA, 20 nt, Artificial Sequence
  Synthetic
gggugcacgcguggucgcac

SEQ ID NO: 7532 - RNA, 20 nt, Artificial Sequence
  Synthetic
aucucggggcgcagcggcac

SEQ ID NO: 7533 - RNA, 20 nt, Artificial Sequence
  Synthetic
uugcaagagaaaccaugcac

SEQ ID NO: 7534 - RNA, 20 nt, Artificial Sequence
  Synthetic
agagcaaccugguggugcac

SEQ ID NO: 7535 - RNA, 20 nt, Artificial Sequence
  Synthetic
ccagcagcagcuuuuuggac

SEQ ID NO: 7536 - RNA, 20 nt, Artificial Sequence
  Synthetic
ucgcaugacuuggacuugac

SEQ ID NO: 7537 - RNA, 20 nt, Artificial Sequence
  Synthetic
aucacccgagugccuuugac

SEQ ID NO: 7538 - RNA, 20 nt, Artificial Sequence
  Synthetic
guucaaauuucagagcaacc

SEQ ID NO: 7539 - RNA, 20 nt, Artificial Sequence
  Synthetic
accgccagcuccccggaacc

SEQ ID NO: 7540 - RNA, 20 nt, Artificial Sequence
  Synthetic
ggcugcgccggugcaccacc

SEQ ID NO: 7541 - RNA, 20 nt, Artificial Sequence
  Synthetic
gaagcauaagcgcggccacc

SEQ ID NO: 7542 - RNA, 20 nt, Artificial Sequence
  Synthetic
cuucagcgaggccuuccacc

SEQ ID NO: 7543 - RNA, 20 nt, Artificial Sequence
  Synthetic
uaugcuucucgcccaggacc

SEQ ID NO: 7544 - RNA, 20 nt, Artificial Sequence
  Synthetic
cgcaugacuuggacuugacc

SEQ ID NO: 7545 - RNA, 20 nt, Artificial Sequence
  Synthetic
uuuaaccugcuaagaauacc

SEQ ID NO: 7546 - RNA, 20 nt, Artificial Sequence
  Synthetic
aggaagggcggcuugcuacc

SEQ ID NO: 7547 - RNA, 20 nt, Artificial Sequence
  Synthetic
gugcgaccacgcgugcaccc

SEQ ID NO: 7548 - RNA, 20 nt, Artificial Sequence
  Synthetic
ugagaaaauuugaagccccc

SEQ ID NO: 7549 - RNA, 20 nt, Artificial Sequence
  Synthetic
gggccaucucuuccgccccc

SEQ ID NO: 7550 - RNA, 20 nt, Artificial Sequence
  Synthetic
cccuccucccucccagcccc

SEQ ID NO: 7551 - RNA, 20 nt, Artificial Sequence
  Synthetic
gaaggaguucgaccugcccc

SEQ ID NO: 7552 - RNA, 20 nt, Artificial Sequence
  Synthetic
aucccuccguccagcucccc

SEQ ID NO: 7553 - RNA, 20 nt, Artificial Sequence
  Synthetic
aauggccgcggcugcucccc

SEQ ID NO: 7554 - RNA, 20 nt, Artificial Sequence
  Synthetic
ucuagcccaccgcugucccc

SEQ ID NO: 7555 - RNA, 20 nt, Artificial Sequence
  Synthetic
ugcgcuucuccacaccgccc

SEQ ID NO: 7556 - RNA, 20 nt, Artificial Sequence
  Synthetic
cccccgaggccgacucgccc

SEQ ID NO: 7557 - RNA, 20 nt, Artificial Sequence
  Synthetic
cgcgcuuaugcuucucgccc

SEQ ID NO: 7558 - RNA, 20 nt, Artificial Sequence
  Synthetic
cauauuagugguccgggccc

SEQ ID NO: 7559 - RNA, 20 nt, Artificial Sequence
  Synthetic
gggggcggaagagauggccc

SEQ ID NO: 7560 - RNA, 20 nt, Artificial Sequence
  Synthetic
cuuuugagcugggccugccc

SEQ ID NO: 7561 - RNA, 20 nt, Artificial Sequence
  Synthetic
ucucuccaccgccagcuccc

SEQ ID NO: 7562 - RNA, 20 nt, Artificial Sequence
  Synthetic
gaucccuccguccagcuccc

SEQ ID NO: 7563 - RNA, 20 nt, Artificial Sequence
  Synthetic
uaauggccgcggcugcuccc

SEQ ID NO: 7564 - RNA, 20 nt, Artificial Sequence
  Synthetic
uuacugcaaccauuccagcc

SEQ ID NO: 7565 - RNA, 20 nt, Artificial Sequence
  Synthetic
cuacggcuucgggcugagcc

SEQ ID NO: 7566 - RNA, 20 nt, Artificial Sequence
  Synthetic
uugcgcuucuccacaccgcc

SEQ ID NO: 7567 - RNA, 20 nt, Artificial Sequence
  Synthetic
cccccaccgcauagagcgcc

SEQ ID NO: 7568 - RNA, 20 nt, Artificial Sequence
  Synthetic
ccccccgaggccgacucgcc

SEQ ID NO: 7569 - RNA, 20 nt, Artificial Sequence
  Synthetic
gagggagggggggcgucgcc

SEQ ID NO: 7570 - RNA, 20 nt, Artificial Sequence
  Synthetic
ugcauagggcugggccggcc

SEQ ID NO: 7571 - RNA, 20 nt, Artificial Sequence
  Synthetic
aucgagagaggcuuccggcc

SEQ ID NO: 7572 - RNA, 20 nt, Artificial Sequence
  Synthetic
ccguguugggcaucgcggcc

SEQ ID NO: 7573 - RNA, 20 nt, Artificial Sequence
  Synthetic
uguggcccucggccucggcc

SEQ ID NO: 7574 - RNA, 20 nt, Artificial Sequence
  Synthetic
gagcugggccugcccgggcc

SEQ ID NO: 7575 - RNA, 20 nt, Artificial Sequence
  Synthetic
ccauauuagugguccgggcc

SEQ ID NO: 7576 - RNA, 20 nt, Artificial Sequence
  Synthetic
ggcgcuucagcuugcuggcc

SEQ ID NO: 7577 - RNA, 20 nt, Artificial Sequence
  Synthetic
cacucgggugauggguggcc

SEQ ID NO: 7578 - RNA, 20 nt, Artificial Sequence
  Synthetic
ucuuuugagcugggccugcc

SEQ ID NO: 7579 - RNA, 20 nt, Artificial Sequence
  Synthetic
gaagggaucuuugagcugcc

SEQ ID NO: 7580 - RNA, 20 nt, Artificial Sequence
  Synthetic
guggaaagcgcccuucugcc

SEQ ID NO: 7581 - RNA, 20 nt, Artificial Sequence
  Synthetic
cccaccaagucgcuggugcc

SEQ ID NO: 7582 - RNA, 20 nt, Artificial Sequence
  Synthetic
gccucucucgauacugaucc

SEQ ID NO: 7583 - RNA, 20 nt, Artificial Sequence
  Synthetic
gaacgaccccaaccugaucc

SEQ ID NO: 7584 - RNA, 20 nt, Artificial Sequence
  Synthetic
cgugguggcgcgccgccucc

SEQ ID NO: 7585 - RNA, 20 nt, Artificial Sequence
  Synthetic
ucgccggcuacgcggccucc

SEQ ID NO: 7586 - RNA, 20 nt, Artificial Sequence
  Synthetic
ccuccucguccccguucucc

SEQ ID NO: 7587 - RNA, 20 nt, Artificial Sequence
  Synthetic
cgaggccuuccaccaggucc

SEQ ID NO: 7588 - RNA, 20 nt, Artificial Sequence
  Synthetic
acgccccauauuaguggucc

SEQ ID NO: 7589 - RNA, 20 nt, Artificial Sequence
  Synthetic
agguagcaagccgcccuucc

SEQ ID NO: 7590 - RNA, 20 nt, Artificial Sequence
  Synthetic
agucgcuggugccggguucc

SEQ ID NO: 7591 - RNA, 20 nt, Artificial Sequence
  Synthetic
cucuaggagacuuagagagc

SEQ ID NO: 7592 - RNA, 20 nt, Artificial Sequence
  Synthetic
agagaaggggcucagcgagc

SEQ ID NO: 7593 - RNA, 20 nt, Artificial Sequence
  Synthetic
cuccacaccgcccggggagc

SEQ ID NO: 7594 - RNA, 20 nt, Artificial Sequence
  Synthetic
ggugccggguuccggggagc

SEQ ID NO: 7595 - RNA, 20 nt, Artificial Sequence
  Synthetic
gcgucugcccucuuuugagc

SEQ ID NO: 7596 - RNA, 20 nt, Artificial Sequence
  Synthetic
cugccuggaggccgcguagc

SEQ ID NO: 7597 - RNA, 20 nt, Artificial Sequence
  Synthetic
cugauccugguauucuuagc

SEQ ID NO: 7598 - RNA, 20 nt, Artificial Sequence
  Synthetic
cugaagggauaccaacccgc

SEQ ID NO: 7599 - RNA, 20 nt, Artificial Sequence
  Synthetic
cggaaguccccugaccccgc

SEQ ID NO: 7600 - RNA, 20 nt, Artificial Sequence
  Synthetic
ucucgcccguguggcugcgc

SEQ ID NO: 7601 - RNA, 20 nt, Artificial Sequence
  Synthetic
gucuaugcgguccgacucgc

SEQ ID NO: 7602 - RNA, 20 nt, Artificial Sequence
  Synthetic
ccaccacgagaacagcucgc

SEQ ID NO: 7603 - RNA, 20 nt, Artificial Sequence
  Synthetic
guguacucgcaguggcucgc

SEQ ID NO: 7604 - RNA, 20 nt, Artificial Sequence
  Synthetic
ggcgcugcccaccaagucgc

SEQ ID NO: 7605 - RNA, 20 nt, Artificial Sequence
  Synthetic
gcccaccgcuguccccaggc

SEQ ID NO: 7606 - RNA, 20 nt, Artificial Sequence
  Synthetic
aaagcgcccuucugccaggc

SEQ ID NO: 7607 - RNA, 20 nt, Artificial Sequence
  Synthetic
uccguguugggcaucgcggc

SEQ ID NO: 7608 - RNA, 20 nt, Artificial Sequence
  Synthetic
caguaaccuuugcauagggc

SEQ ID NO: 7609 - RNA, 20 nt, Artificial Sequence
  Synthetic
uuagugguccgggcccgggc

SEQ ID NO: 7610 - RNA, 20 nt, Artificial Sequence
  Synthetic
ugcccugcaugacgucgggc

SEQ ID NO: 7611 - RNA, 20 nt, Artificial Sequence
  Synthetic
acuuggacuugaccgggggc

SEQ ID NO: 7612 - RNA, 20 nt, Artificial Sequence
  Synthetic
ugggcaucgcggccgggggc

SEQ ID NO: 7613 - RNA, 20 nt, Artificial Sequence
  Synthetic
accuuugcauagggcugggc

SEQ ID NO: 7614 - RNA, 20 nt, Artificial Sequence
  Synthetic
cuccuagagaaauccauggc

SEQ ID NO: 7615 - RNA, 20 nt, Artificial Sequence
  Synthetic
agggcggcuugcuaccuggc

SEQ ID NO: 7616 - RNA, 20 nt, Artificial Sequence
  Synthetic
aggagacuuagagagcuggc

SEQ ID NO: 7617 - RNA, 20 nt, Artificial Sequence
  Synthetic
gaaucccauggagagguggc

SEQ ID NO: 7618 - RNA, 20 nt, Artificial Sequence
  Synthetic
ugcgacgaagacucgguggc

SEQ ID NO: 7619 - RNA, 20 nt, Artificial Sequence
  Synthetic
cgcccugcccgacgucaugc

SEQ ID NO: 7620 - RNA, 20 nt, Artificial Sequence
  Synthetic
aguuguacauguguagcugc

SEQ ID NO: 7621 - RNA, 20 nt, Artificial Sequence
  Synthetic
cacggacuugagcgcgcugc

SEQ ID NO: 7622 - RNA, 20 nt, Artificial Sequence
  Synthetic
ccuguccaaaaagcugcugc

SEQ ID NO: 7623 - RNA, 20 nt, Artificial Sequence
  Synthetic
gcccaccaagucgcuggugc

SEQ ID NO: 7624 - RNA, 20 nt, Artificial Sequence
  Synthetic
cauguggcgcuucagcuugc

SEQ ID NO: 7625 - RNA, 20 nt, Artificial Sequence
  Synthetic
cguccccguucuccgggauc

SEQ ID NO: 7626 - RNA, 20 nt, Artificial Sequence
  Synthetic
gcacccugucaaaggcacuc

SEQ ID NO: 7627 - RNA, 20 nt, Artificial Sequence
  Synthetic
uccccgggcgagucggccuc

SEQ ID NO: 7628 - RNA, 20 nt, Artificial Sequence
  Synthetic
gagcuggacggagggaucuc

SEQ ID NO: 7629 - RNA, 20 nt, Artificial Sequence
  Synthetic
gccacacaucuugagcucuc

SEQ ID NO: 7630 - RNA, 20 nt, Artificial Sequence
  Synthetic
uccuccucguccccguucuc

SEQ ID NO: 7631 - RNA, 20 nt, Artificial Sequence
  Synthetic
accaugcccugcaugacguc

SEQ ID NO: 7632 - RNA, 20 nt, Artificial Sequence
  Synthetic
ggauaccaacccgcgggguc

SEQ ID NO: 7633 - RNA, 20 nt, Artificial Sequence
  Synthetic
cacgccccauauuagugguc

SEQ ID NO: 7634 - RNA, 20 nt, Artificial Sequence
  Synthetic
ggaggcaaaaggcgauuguc

SEQ ID NO: 7635 - RNA, 20 nt, Artificial Sequence
  Synthetic
ccgcggguugguaucccuuc

SEQ ID NO: 7636 - RNA, 20 nt, Artificial Sequence
  Synthetic
ucaguaucgagagaggcuuc

SEQ ID NO: 7637 - RNA, 20 nt, Artificial Sequence
  Synthetic
agaggguggacuacggcuuc

SEQ ID NO: 7638 - RNA, 20 nt, Artificial Sequence
  Synthetic
aagucgcuggugccggguuc

SEQ ID NO: 7639 - RNA, 20 nt, Artificial Sequence
  Synthetic
gggcaggcccagcucaaaag

SEQ ID NO: 7640 - RNA, 20 nt, Artificial Sequence
  Synthetic
ugugugaagaaccuagaaag

SEQ ID NO: 7641 - RNA, 20 nt, Artificial Sequence
  Synthetic
guauucuuagcagguuaaag

SEQ ID NO: 7642 - RNA, 20 nt, Artificial Sequence
  Synthetic
cgacgaggaagaggaagaag

SEQ ID NO: 7643 - RNA, 20 nt, Artificial Sequence
  Synthetic
gcuugaugcgcuuagagaag

SEQ ID NO: 7644 - RNA, 20 nt, Artificial Sequence
  Synthetic
agaggaggacgacgaggaag

SEQ ID NO: 7645 - RNA, 20 nt, Artificial Sequence
  Synthetic
agaggaagaagaggaggaag

SEQ ID NO: 7646 - RNA, 20 nt, Artificial Sequence
  Synthetic
gaacggggacgaggaggaag

SEQ ID NO: 7647 - RNA, 20 nt, Artificial Sequence
  Synthetic
gggcgcagcggcacgggaag

SEQ ID NO: 7648 - RNA, 20 nt, Artificial Sequence
  Synthetic
cucggugguggacuaaacag

SEQ ID NO: 7649 - RNA, 20 nt, Artificial Sequence
  Synthetic
uagaaagagguuggagacag

SEQ ID NO: 7650 - RNA, 20 nt, Artificial Sequence
  Synthetic
cugggccggccuggggacag

SEQ ID NO: 7651 - RNA, 20 nt, Artificial Sequence
  Synthetic
agaaaauuugaagcccccag

SEQ ID NO: 7652 - RNA, 20 nt, Artificial Sequence
  Synthetic
ggagggaucucggggcgcag

SEQ ID NO: 7653 - RNA, 20 nt, Artificial Sequence
  Synthetic
cggagaacguguacucgcag

SEQ ID NO: 7654 - RNA, 20 nt, Artificial Sequence
  Synthetic
ggaggaggggcggauugcag

SEQ ID NO: 7655 - RNA, 20 nt, Artificial Sequence
  Synthetic
auaccaacccgcggggucag

SEQ ID NO: 7656 - RNA, 20 nt, Artificial Sequence
  Synthetic
accaggaucaguaucgagag

SEQ ID NO: 7657 - RNA, 20 nt, Artificial Sequence
  Synthetic
aggagcugacggagagcgag

SEQ ID NO: 7658 - RNA, 20 nt, Artificial Sequence
  Synthetic
agagguuggagacagaggag

SEQ ID NO: 7659 - RNA, 20 nt, Artificial Sequence
  Synthetic
cgggggcugggagggaggag

SEQ ID NO: 7660 - RNA, 20 nt, Artificial Sequence
  Synthetic
gcggauugcagaggagggag

SEQ ID NO: 7661 - RNA, 20 nt, Artificial Sequence
  Synthetic
uggacuaaacagggggggag

SEQ ID NO: 7662 - RNA, 20 nt, Artificial Sequence
  Synthetic
gcaauaugaaucccauggag

SEQ ID NO: 7663 - RNA, 20 nt, Artificial Sequence
  Synthetic
gggagcacgccccauauuag

SEQ ID NO: 7664 - RNA, 20 nt, Artificial Sequence
  Synthetic
caaccugaucccggagaacg

SEQ ID NO: 7665 - RNA, 20 nt, Artificial Sequence
  Synthetic
ggaggaagaggaggacgacg

SEQ ID NO: 7666 - RNA, 20 nt, Artificial Sequence
  Synthetic
cuccgaggagugcuccgacg

SEQ ID NO: 7667 - RNA, 20 nt, Artificial Sequence
  Synthetic
gaucccggagaacggggacg

SEQ ID NO: 7668 - RNA, 20 nt, Artificial Sequence
  Synthetic
gcaguggcucgccggcuacg

SEQ ID NO: 7669 - RNA, 20 nt, Artificial Sequence
  Synthetic
gcaugacuuggacuugaccg

SEQ ID NO: 7670 - RNA, 20 nt, Artificial Sequence
  Synthetic
ccugaagggauaccaacccg

SEQ ID NO: 7671 - RNA, 20 nt, Artificial Sequence
  Synthetic
acggaaguccccugaccccg

SEQ ID NO: 7672 - RNA, 20 nt, Artificial Sequence
  Synthetic
cuuuuuggacaggccccccg

SEQ ID NO: 7673 - RNA, 20 nt, Artificial Sequence
  Synthetic
gcgcuucuccacaccgcccg

SEQ ID NO: 7674 - RNA, 20 nt, Artificial Sequence
  Synthetic
ccccgaggccgacucgcccg

SEQ ID NO: 7675 - RNA, 20 nt, Artificial Sequence
  Synthetic
acucgcccggggagcagccg

SEQ ID NO: 7676 - RNA, 20 nt, Artificial Sequence
  Synthetic
cggccaccuggccgaggccg

SEQ ID NO: 7677 - RNA, 20 nt, Artificial Sequence
  Synthetic
cguguugggcaucgcggccg

SEQ ID NO: 7678 - RNA, 20 nt, Artificial Sequence
  Synthetic
gauggcacuguuaauggccg

SEQ ID NO: 7679 - RNA, 20 nt, Artificial Sequence
  Synthetic
uaagcgcggccaccuggccg

SEQ ID NO: 7680 - RNA, 20 nt, Artificial Sequence
  Synthetic
gcgcaaacucccguucuccg

SEQ ID NO: 7681 - RNA, 20 nt, Artificial Sequence
  Synthetic
cagcagcgcgcucaaguccg

SEQ ID NO: 7682 - RNA, 20 nt, Artificial Sequence
  Synthetic
gucgcuggugccggguuccg

SEQ ID NO: 7683 - RNA, 20 nt, Artificial Sequence
  Synthetic
cugggcgagaagcauaagcg

SEQ ID NO: 7684 - RNA, 20 nt, Artificial Sequence
  Synthetic
cuccaugcagcacuucagcg

SEQ ID NO: 7685 - RNA, 20 nt, Artificial Sequence
  Synthetic
ugcuggccugggugcacgcg

SEQ ID NO: 7686 - RNA, 20 nt, Artificial Sequence
  Synthetic
ugaagggauaccaacccgcg

SEQ ID NO: 7687 - RNA, 20 nt, Artificial Sequence
  Synthetic
caccacgagaacagcucgcg

SEQ ID NO: 7688 - RNA, 20 nt, Artificial Sequence
  Synthetic
gcaugacgucgggcagggcg

SEQ ID NO: 7689 - RNA, 20 nt, Artificial Sequence
  Synthetic
cgagaacagcucgcggggcg

SEQ ID NO: 7690 - RNA, 20 nt, Artificial Sequence
  Synthetic
gcggggcgcggucgugggcg

SEQ ID NO: 7691 - RNA, 20 nt, Artificial Sequence
  Synthetic
guucuccguguugggcaucg

SEQ ID NO: 7692 - RNA, 20 nt, Artificial Sequence
  Synthetic
ccccgggcgagucggccucg

SEQ ID NO: 7693 - RNA, 20 nt, Artificial Sequence
  Synthetic
gccaccacgagaacagcucg

SEQ ID NO: 7694 - RNA, 20 nt, Artificial Sequence
  Synthetic
agcuggacggagggaucucg

SEQ ID NO: 7695 - RNA, 20 nt, Artificial Sequence
  Synthetic
cgccccgcgagcuguucucg

SEQ ID NO: 7696 - RNA, 20 nt, Artificial Sequence
  Synthetic
cagcucgcggggcgcggucg

SEQ ID NO: 7697 - RNA, 20 nt, Artificial Sequence
  Synthetic
ucggugguggacuaaacagg

SEQ ID NO: 7698 - RNA, 20 nt, Artificial Sequence
  Synthetic
ggcccucggccucggccagg

SEQ ID NO: 7699 - RNA, 20 nt, Artificial Sequence
  Synthetic
cgaggaagaggaagaagagg

SEQ ID NO: 7700 - RNA, 20 nt, Artificial Sequence
  Synthetic
ggaagaagaggaggaagagg

SEQ ID NO: 7701 - RNA, 20 nt, Artificial Sequence
  Synthetic
cggggacgaggaggaagagg

SEQ ID NO: 7702 - RNA, 20 nt, Artificial Sequence
  Synthetic
aaagagguuggagacagagg

SEQ ID NO: 7703 - RNA, 20 nt, Artificial Sequence
  Synthetic
ggaggggcggauugcagagg

SEQ ID NO: 7704 - RNA, 20 nt, Artificial Sequence
  Synthetic
auaugaaucccauggagagg

SEQ ID NO: 7705 - RNA, 20 nt, Artificial Sequence
  Synthetic
cgaggagugcuccgacgagg

SEQ ID NO: 7706 - RNA, 20 nt, Artificial Sequence
  Synthetic
cccggagaacggggacgagg

SEQ ID NO: 7707 - RNA, 20 nt, Artificial Sequence
  Synthetic
agaagaggaggaagaggagg

SEQ ID NO: 7708 - RNA, 20 nt, Artificial Sequence
  Synthetic
gagguuggagacagaggagg

SEQ ID NO: 7709 - RNA, 20 nt, Artificial Sequence
  Synthetic
agaggaggaagaggaggagg

SEQ ID NO: 7710 - RNA, 20 nt, Artificial Sequence
  Synthetic
cggauugcagaggagggagg

SEQ ID NO: 7711 - RNA, 20 nt, Artificial Sequence
  Synthetic
accgggggcugggagggagg

SEQ ID NO: 7712 - RNA, 20 nt, Artificial Sequence
  Synthetic
cuucgggcugagccuggagg

SEQ ID NO: 7713 - RNA, 20 nt, Artificial Sequence
  Synthetic
ccgcccggggagcuggacgg

SEQ ID NO: 7714 - RNA, 20 nt, Artificial Sequence
  Synthetic
caugacuuggacuugaccgg

SEQ ID NO: 7715 - RNA, 20 nt, Artificial Sequence
  Synthetic
guguugggcaucgcggccgg

SEQ ID NO: 7716 - RNA, 20 nt, Artificial Sequence
  Synthetic
ggccggccuggggacagcgg

SEQ ID NO: 7717 - RNA, 20 nt, Artificial Sequence
  Synthetic
ggguuccggggagcuggcgg

SEQ ID NO: 7718 - RNA, 20 nt, Artificial Sequence
  Synthetic
cccccaggcgcucuaugcgg

SEQ ID NO: 7719 - RNA, 20 nt, Artificial Sequence
  Synthetic
cacuugcgacgaagacucgg

SEQ ID NO: 7720 - RNA, 20 nt, Artificial Sequence
  Synthetic
cccgggcgagucggccucgg

SEQ ID NO: 7721 - RNA, 20 nt, Artificial Sequence
  Synthetic
ggguccaagugaugucucgg

SEQ ID NO: 7722 - RNA, 20 nt, Artificial Sequence
  Synthetic
gggggcgucgccaggaaggg

SEQ ID NO: 7723 - RNA, 20 nt, Artificial Sequence
  Synthetic
cggugguggacuaaacaggg

SEQ ID NO: 7724 - RNA, 20 nt, Artificial Sequence
  Synthetic
gcugacggagagcgagaggg

SEQ ID NO: 7725 - RNA, 20 nt, Artificial Sequence
  Synthetic
gggcggauugcagaggaggg

SEQ ID NO: 7726 - RNA, 20 nt, Artificial Sequence
  Synthetic
ggauugcagaggagggaggg

SEQ ID NO: 7727 - RNA, 20 nt, Artificial Sequence
  Synthetic
uugaccgggggcugggaggg

SEQ ID NO: 7728 - RNA, 20 nt, Artificial Sequence
  Synthetic
ccuccguccagcuccccggg

SEQ ID NO: 7729 - RNA, 20 nt, Artificial Sequence
  Synthetic
cuagagaaauccauggcggg

SEQ ID NO: 7730 - RNA, 20 nt, Artificial Sequence
  Synthetic
ccgggcgagucggccucggg

SEQ ID NO: 7731 - RNA, 20 nt, Artificial Sequence
  Synthetic
ggugguggacuaaacagggg

SEQ ID NO: 7732 - RNA, 20 nt, Artificial Sequence
  Synthetic
aaauuugaagcccccagggg

SEQ ID NO: 7733 - RNA, 20 nt, Artificial Sequence
  Synthetic
gggcugggagggaggagggg

SEQ ID NO: 7734 - RNA, 20 nt, Artificial Sequence
  Synthetic
gauugcagaggagggagggg

SEQ ID NO: 7735 - RNA, 20 nt, Artificial Sequence
  Synthetic
ccgcauagagcgccuggggg

SEQ ID NO: 7736 - RNA, 20 nt, Artificial Sequence
  Synthetic
ugaagcccccaggggugggg

SEQ ID NO: 7737 - RNA, 20 nt, Artificial Sequence
  Synthetic
aaaggcacucgggugauggg

SEQ ID NO: 7738 - RNA, 20 nt, Artificial Sequence
  Synthetic
ggacuugaccgggggcuggg

SEQ ID NO: 7739 - RNA, 20 nt, Artificial Sequence
  Synthetic
cuaaacagggggggaguggg

SEQ ID NO: 7740 - RNA, 20 nt, Artificial Sequence
  Synthetic
cuggguacuacgccgaaugg

SEQ ID NO: 7741 - RNA, 20 nt, Artificial Sequence
  Synthetic
ucuccuagagaaauccaugg

SEQ ID NO: 7742 - RNA, 20 nt, Artificial Sequence
  Synthetic
gucggacuugaccgucaugg

SEQ ID NO: 7743 - RNA, 20 nt, Artificial Sequence
  Synthetic
caaauuucagagcaaccugg

SEQ ID NO: 7744 - RNA, 20 nt, Artificial Sequence
  Synthetic
gcuucucgcccaggaccugg

SEQ ID NO: 7745 - RNA, 20 nt, Artificial Sequence
  Synthetic
cggcuucgggcugagccugg

SEQ ID NO: 7746 - RNA, 20 nt, Artificial Sequence
  Synthetic
ccaccgcauagagcgccugg

SEQ ID NO: 7747 - RNA, 20 nt, Artificial Sequence
  Synthetic
gggaucuuugagcugccugg

SEQ ID NO: 7748 - RNA, 20 nt, Artificial Sequence
  Synthetic
gccggguuccggggagcugg

SEQ ID NO: 7749 - RNA, 20 nt, Artificial Sequence
  Synthetic
cgcagcggcacgggaagugg

SEQ ID NO: 7750 - RNA, 20 nt, Artificial Sequence
  Synthetic
cagcgcgcucaaguccgugg

SEQ ID NO: 7751 - RNA, 20 nt, Artificial Sequence
  Synthetic
cccgcgagcuguucucgugg

SEQ ID NO: 7752 - RNA, 20 nt, Artificial Sequence
  Synthetic
ccaggcgcucuaugcggugg

SEQ ID NO: 7753 - RNA, 20 nt, Artificial Sequence
  Synthetic
uccaagugaugucucggugg

SEQ ID NO: 7754 - RNA, 20 nt, Artificial Sequence
  Synthetic
acccggcaccagcgacuugg

SEQ ID NO: 7755 - RNA, 20 nt, Artificial Sequence
  Synthetic
ucuggguacuacgccgaaug

SEQ ID NO: 7756 - RNA, 20 nt, Artificial Sequence
  Synthetic
cgucggacuugaccgucaug

SEQ ID NO: 7757 - RNA, 20 nt, Artificial Sequence
  Synthetic
ugugcaugugcgucuucaug

SEQ ID NO: 7758 - RNA, 20 nt, Artificial Sequence
  Synthetic
gggcccggaccacuaauaug

SEQ ID NO: 7759 - RNA, 20 nt, Artificial Sequence
  Synthetic
ccgcccccaggcgcucuaug

SEQ ID NO: 7760 - RNA, 20 nt, Artificial Sequence
  Synthetic
uaacagugccaucgucuaug

SEQ ID NO: 7761 - RNA, 20 nt, Artificial Sequence
  Synthetic
agcgacacuugugaguacug

SEQ ID NO: 7762 - RNA, 20 nt, Artificial Sequence
  Synthetic
cuucgucgcaagugucccug

SEQ ID NO: 7763 - RNA, 20 nt, Artificial Sequence
  Synthetic
cccaccgcauagagcgccug

SEQ ID NO: 7764 - RNA, 20 nt, Artificial Sequence
  Synthetic
cauagggcugggccggccug

SEQ ID NO: 7765 - RNA, 20 nt, Artificial Sequence
  Synthetic
agaaggggcucagcgagcug

SEQ ID NO: 7766 - RNA, 20 nt, Artificial Sequence
  Synthetic
gugccuuugacagggugcug

SEQ ID NO: 7767 - RNA, 20 nt, Artificial Sequence
  Synthetic
uccaagucaugcgaguucug

SEQ ID NO: 7768 - RNA, 20 nt, Artificial Sequence
  Synthetic
uguagggcuucucgcccgug

SEQ ID NO: 7769 - RNA, 20 nt, Artificial Sequence
  Synthetic
guccagcuccccgggcggug

SEQ ID NO: 7770 - RNA, 20 nt, Artificial Sequence
  Synthetic
cccaggcgcucuaugcggug

SEQ ID NO: 7771 - RNA, 20 nt, Artificial Sequence
  Synthetic
auuugaagcccccaggggug

SEQ ID NO: 7772 - RNA, 20 nt, Artificial Sequence
  Synthetic
cccagagagcucaagaugug

SEQ ID NO: 7773 - RNA, 20 nt, Artificial Sequence
  Synthetic
cguucuccgggaucagguug

SEQ ID NO: 7774 - RNA, 20 nt, Artificial Sequence
  Synthetic
cucuggguacuacgccgaau

SEQ ID NO: 7775 - RNA, 20 nt, Artificial Sequence
  Synthetic
gcgggaggcuccauagccau

SEQ ID NO: 7776 - RNA, 20 nt, Artificial Sequence
  Synthetic
cuucccagccaccucuccau

SEQ ID NO: 7777 - RNA, 20 nt, Artificial Sequence
  Synthetic
gguugcaguaaccuuugcau

SEQ ID NO: 7778 - RNA, 20 nt, Artificial Sequence
  Synthetic
ucgucggacuugaccgucau

SEQ ID NO: 7779 - RNA, 20 nt, Artificial Sequence
  Synthetic
gucaaaggcacucgggugau

SEQ ID NO: 7780 - RNA, 20 nt, Artificial Sequence
  Synthetic
cgggcccggaccacuaauau

SEQ ID NO: 7781 - RNA, 20 nt, Artificial Sequence
  Synthetic
gucguucucgcucuugaacu

SEQ ID NO: 7782 - RNA, 20 nt, Artificial Sequence
  Synthetic
agcacccugucaaaggcacu

SEQ ID NO: 7783 - RNA, 20 nt, Artificial Sequence
  Synthetic
uccaccaccgagacaucacu

SEQ ID NO: 7784 - RNA, 20 nt, Artificial Sequence
  Synthetic
ggacacuugcgacgaagacu

SEQ ID NO: 7785 - RNA, 20 nt, Artificial Sequence
  Synthetic
ggaacccggcaccagcgacu

SEQ ID NO: 7786 - RNA, 20 nt, Artificial Sequence
  Synthetic
guugguaucccuucaggacu

SEQ ID NO: 7787 - RNA, 20 nt, Artificial Sequence
  Synthetic
gccgcagaacucgcaugacu

SEQ ID NO: 7788 - RNA, 20 nt, Artificial Sequence
  Synthetic
gcaagugucccuguggcccu

SEQ ID NO: 7789 - RNA, 20 nt, Artificial Sequence
  Synthetic
ccccaccgcauagagcgccu

SEQ ID NO: 7790 - RNA, 20 nt, Artificial Sequence
  Synthetic
gcauagggcugggccggccu

SEQ ID NO: 7791 - RNA, 20 nt, Artificial Sequence
  Synthetic
gucccuguggcccucggccu

SEQ ID NO: 7792 - RNA, 20 nt, Artificial Sequence
  Synthetic
cuccccgggcgagucggccu

SEQ ID NO: 7793 - RNA, 20 nt, Artificial Sequence
  Synthetic
gcgcuucagcuugcuggccu

SEQ ID NO: 7794 - RNA, 20 nt, Artificial Sequence
  Synthetic
cuccucgucggagcacuccu

SEQ ID NO: 7795 - RNA, 20 nt, Artificial Sequence
  Synthetic
gaggccuuccaccagguccu

SEQ ID NO: 7796 - RNA, 20 nt, Artificial Sequence
  Synthetic
gagaaggggcucagcgagcu

SEQ ID NO: 7797 - RNA, 20 nt, Artificial Sequence
  Synthetic
cgucugcccucuuuugagcu

SEQ ID NO: 7798 - RNA, 20 nt, Artificial Sequence
  Synthetic
aguaaccuuugcauagggcu

SEQ ID NO: 7799 - RNA, 20 nt, Artificial Sequence
  Synthetic
cuuggacuugaccgggggcu

SEQ ID NO: 7800 - RNA, 20 nt, Artificial Sequence
  Synthetic
aaucccauggagagguggcu

SEQ ID NO: 7801 - RNA, 20 nt, Artificial Sequence
  Synthetic
guuguacauguguagcugcu

SEQ ID NO: 7802 - RNA, 20 nt, Artificial Sequence
  Synthetic
cuguccaaaaagcugcugcu

SEQ ID NO: 7803 - RNA, 20 nt, Artificial Sequence
  Synthetic
ggagcuggacggagggaucu

SEQ ID NO: 7804 - RNA, 20 nt, Artificial Sequence
  Synthetic
ccacacaucuugagcucucu

SEQ ID NO: 7805 - RNA, 20 nt, Artificial Sequence
  Synthetic
cucccgccauggauuucucu

SEQ ID NO: 7806 - RNA, 20 nt, Artificial Sequence
  Synthetic
uggggguccaagugaugucu

SEQ ID NO: 7807 - RNA, 20 nt, Artificial Sequence
  Synthetic
ucugucuccaaccucuuucu

SEQ ID NO: 7808 - RNA, 20 nt, Artificial Sequence
  Synthetic
agacucgguggccggcgagu

SEQ ID NO: 7809 - RNA, 20 nt, Artificial Sequence
  Synthetic
cggcugcuccccgggcgagu

SEQ ID NO: 7810 - RNA, 20 nt, Artificial Sequence
  Synthetic
ggacuaaacagggggggagu

SEQ ID NO: 7811 - RNA, 20 nt, Artificial Sequence
  Synthetic
caccaugcccugcaugacgu

SEQ ID NO: 7812 - RNA, 20 nt, Artificial Sequence
  Synthetic
cggggcgcggucgugggcgu

SEQ ID NO: 7813 - RNA, 20 nt, Artificial Sequence
  Synthetic
aucgccuuuugccuccucgu

SEQ ID NO: 7814 - RNA, 20 nt, Artificial Sequence
  Synthetic
ggcgguggagagaccgucgu

SEQ ID NO: 7815 - RNA, 20 nt, Artificial Sequence
  Synthetic
agcucgcggggcgcggucgu

SEQ ID NO: 7816 - RNA, 20 nt, Artificial Sequence
  Synthetic
cccguucuccgggaucaggu

SEQ ID NO: 7817 - RNA, 20 nt, Artificial Sequence
  Synthetic
ugaagaaccuagaaagaggu

SEQ ID NO: 7818 - RNA, 20 nt, Artificial Sequence
  Synthetic
gccggccuggggacagcggu

SEQ ID NO: 7819 - RNA, 20 nt, Artificial Sequence
  Synthetic
ccccaggcgcucuaugcggu

SEQ ID NO: 7820 - RNA, 20 nt, Artificial Sequence
  Synthetic
aguccccugaccccgcgggu

SEQ ID NO: 7821 - RNA, 20 nt, Artificial Sequence
  Synthetic
aauuugaagcccccaggggu

SEQ ID NO: 7822 - RNA, 20 nt, Artificial Sequence
  Synthetic
cccggcaccagcgacuuggu

SEQ ID NO: 7823 - RNA, 20 nt, Artificial Sequence
  Synthetic
gcgacacuugugaguacugu

SEQ ID NO: 7824 - RNA, 20 nt, Artificial Sequence
  Synthetic
cgaguacacguucuccgugu

SEQ ID NO: 7825 - RNA, 20 nt, Artificial Sequence
  Synthetic
gucgcacagguugcacuugu

SEQ ID NO: 7826 - RNA, 20 nt, Artificial Sequence
  Synthetic
guucuucacacacccccauu

SEQ ID NO: 7827 - RNA, 20 nt, Artificial Sequence
  Synthetic
aaagaucccuuccuuagcuu

SEQ ID NO: 7828 - RNA, 20 nt, Artificial Sequence
  Synthetic
gagaggguggacuacggcuu

SEQ ID NO: 7829 - RNA, 20 nt, Artificial Sequence
  Synthetic
ccguucuccgggaucagguu

SEQ ID NO: 7830 - RNA, 20 nt, Artificial Sequence
  Synthetic
gaguacacguucuccguguu

SEQ ID NO: 7831 - RNA, 20 nt, Artificial Sequence
  Synthetic
gcugcccagcagcagcuuuu

SEQ ID NO: 7832 - RNA, 20 nt, Artificial Sequence
  Synthetic
ucaagauguguggcaguuuu

SEQ ID NO: 7833 - RNA, 21 nt, Artificial Sequence
  Synthetic
ugaccuggaugccaaccucca

SEQ ID NO: 7834 - RNA, 22 nt, Artificial Sequence
  Synthetic
gugaccuggaugccaaccucca

SEQ ID NO: 7835 - RNA, 23 nt, Artificial Sequence
  Synthetic
cgugaccuggaugccaaccucca

SEQ ID NO: 7836 - RNA, 24 nt, Artificial Sequence
  Synthetic
gcgugaccuggaugccaaccucca

SEQ ID NO: 7837 - RNA, 18 nt, Artificial Sequence
  Synthetic
augccaaccuccacggga

SEQ ID NO: 7838 - RNA, 19 nt, Artificial Sequence
  Synthetic
gaugccaaccuccacggga

SEQ ID NO: 7839 - RNA, 20 nt, Artificial Sequence
  Synthetic
ggaugccaaccuccacggga

SEQ ID NO: 7840 - RNA, 21 nt, Artificial Sequence
  Synthetic
uggaugccaaccuccacggga

SEQ ID NO: 7841 - RNA, 22 nt, Artificial Sequence
  Synthetic
cuggaugccaaccuccacggga

SEQ ID NO: 7842 - RNA, 23 nt, Artificial Sequence
  Synthetic
ccuggaugccaaccuccacggga

SEQ ID NO: 7843 - RNA, 24 nt, Artificial Sequence
  Synthetic
accuggaugccaaccuccacggga

SEQ ID NO: 7844 - RNA, 18 nt, Artificial Sequence
  Synthetic
gucauccucuggcgugac

SEQ ID NO: 7845 - RNA, 19 nt, Artificial Sequence
  Synthetic
cgucauccucuggcgugac

SEQ ID NO: 7846 - RNA, 20 nt, Artificial Sequence
  Synthetic
ucgucauccucuggcgugac

SEQ ID NO: 7847 - RNA, 21 nt, Artificial Sequence
  Synthetic
aucgucauccucuggcgugac

SEQ ID NO: 7848 - RNA, 22 nt, Artificial Sequence
  Synthetic
aaucgucauccucuggcgugac

SEQ ID NO: 7849 - RNA, 23 nt, Artificial Sequence
  Synthetic
caaucgucauccucuggcgugac

SEQ ID NO: 7850 - RNA, 24 nt, Artificial Sequence
  Synthetic
acaaucgucauccucuggcgugac

SEQ ID NO: 7851 - RNA, 18 nt, Artificial Sequence
  Synthetic
uuauuggguuacuuacgc

SEQ ID NO: 7852 - RNA, 19 nt, Artificial Sequence
  Synthetic
auuauuggguuacuuacgc

SEQ ID NO: 7853 - RNA, 20 nt, Artificial Sequence
  Synthetic
uauuauuggguuacuuacgc

SEQ ID NO: 7854 - RNA, 21 nt, Artificial Sequence
  Synthetic
cuauuauuggguuacuuacgc

SEQ ID NO: 7855 - RNA, 22 nt, Artificial Sequence
  Synthetic
acuauuauuggguuacuuacgc

SEQ ID NO: 7856 - RNA, 23 nt, Artificial Sequence
  Synthetic
uacuauuauuggguuacuuacgc

SEQ ID NO: 7857 - RNA, 24 nt, Artificial Sequence
  Synthetic
uuacuauuauuggguuacuuacgc

SEQ ID NO: 7858 - RNA, 18 nt, Artificial Sequence
  Synthetic
ucccguuugcuuaagugc

SEQ ID NO: 7859 - RNA, 19 nt, Artificial Sequence
  Synthetic
uucccguuugcuuaagugc

SEQ ID NO: 7860 - RNA, 20 nt, Artificial Sequence
  Synthetic
auucccguuugcuuaagugc

SEQ ID NO: 7861 - RNA, 21 nt, Artificial Sequence
  Synthetic
aauucccguuugcuuaagugc

SEQ ID NO: 7862 - RNA, 22 nt, Artificial Sequence
  Synthetic
gaauucccguuugcuuaagugc

SEQ ID NO: 7863 - RNA, 23 nt, Artificial Sequence
  Synthetic
agaauucccguuugcuuaagugc

SEQ ID NO: 7864 - RNA, 24 nt, Artificial Sequence
  Synthetic
gagaauucccguuugcuuaagugc

SEQ ID NO: 7865 - RNA, 18 nt, Artificial Sequence
  Synthetic
uuugugcucgauaaaaau

SEQ ID NO: 7866 - RNA, 19 nt, Artificial Sequence
  Synthetic
guuugugcucgauaaaaau

SEQ ID NO: 7867 - RNA, 20 nt, Artificial Sequence
  Synthetic
cguuugugcucgauaaaaau

SEQ ID NO: 7868 - RNA, 21 nt, Artificial Sequence
  Synthetic
ccguuugugcucgauaaaaau

SEQ ID NO: 7869 - RNA, 22 nt, Artificial Sequence
  Synthetic
uccguuugugcucgauaaaaau

SEQ ID NO: 7870 - RNA, 23 nt, Artificial Sequence
  Synthetic
uuccguuugugcucgauaaaaau

SEQ ID NO: 7871 - RNA, 24 nt, Artificial Sequence
  Synthetic
uuuccguuugugcucgauaaaaau

SEQ ID NO: 7872 - RNA, 18 nt, Artificial Sequence
  Synthetic
ugcacucaucccaggcgu

SEQ ID NO: 7873 - RNA, 19 nt, Artificial Sequence
  Synthetic
cugcacucaucccaggcgu

SEQ ID NO: 7874 - RNA, 20 nt, Artificial Sequence
  Synthetic
ucugcacucaucccaggcgu

SEQ ID NO: 7875 - RNA, 21 nt, Artificial Sequence
  Synthetic
uucugcacucaucccaggcgu

SEQ ID NO: 7876 - RNA, 22 nt, Artificial Sequence
  Synthetic
auucugcacucaucccaggcgu

SEQ ID NO: 7877 - RNA, 23 nt, Artificial Sequence
  Synthetic
uauucugcacucaucccaggcgu

SEQ ID NO: 7878 - RNA, 24 nt, Artificial Sequence
  Synthetic
auauucugcacucaucccaggcgu

SEQ ID NO: 7879 - RNA, 18 nt, Artificial Sequence
  Synthetic
gucugguucaucaucugu

SEQ ID NO: 7880 - RNA, 19 nt, Artificial Sequence
  Synthetic
ggucugguucaucaucugu

SEQ ID NO: 7881 - RNA, 20 nt, Artificial Sequence
  Synthetic
uggucugguucaucaucugu

SEQ ID NO: 7882 - RNA, 21 nt, Artificial Sequence
  Synthetic
guggucugguucaucaucugu

SEQ ID NO: 7883 - RNA, 22 nt, Artificial Sequence
  Synthetic
cguggucugguucaucaucugu

SEQ ID NO: 7884 - RNA, 23 nt, Artificial Sequence
  Synthetic
ccguggucugguucaucaucugu

SEQ ID NO: 7885 - RNA, 24 nt, Artificial Sequence
  Synthetic
gccguggucugguucaucaucugu

SEQ ID NO: 7886 - RNA, 18 nt, Artificial Sequence
  Synthetic
ccguugggagcuccagaa

SEQ ID NO: 7887 - RNA, 19 nt, Artificial Sequence
  Synthetic
cccguugggagcuccagaa

SEQ ID NO: 7888 - RNA, 20 nt, Artificial Sequence
  Synthetic
gcccguugggagcuccagaa

SEQ ID NO: 7889 - RNA, 21 nt, Artificial Sequence
  Synthetic
ggcccguugggagcuccagaa

SEQ ID NO: 7890 - RNA, 22 nt, Artificial Sequence
  Synthetic
cggcccguugggagcuccagaa

SEQ ID NO: 7891 - RNA, 23 nt, Artificial Sequence
  Synthetic
acggcccguugggagcuccagaa

SEQ ID NO: 7892 - RNA, 24 nt, Artificial Sequence
  Synthetic
cacggcccguugggagcuccagaa

SEQ ID NO: 7893 - RNA, 18 nt, Artificial Sequence
  Synthetic
ggcauccaggucacgcca

SEQ ID NO: 7894 - RNA, 19 nt, Artificial Sequence
  Synthetic
uggcauccaggucacgcca

SEQ ID NO: 7895 - RNA, 20 nt, Artificial Sequence
  Synthetic
uuggcauccaggucacgcca

SEQ ID NO: 7896 - RNA, 21 nt, Artificial Sequence
  Synthetic
guuggcauccaggucacgcca

SEQ ID NO: 7897 - RNA, 22 nt, Artificial Sequence
  Synthetic
gguuggcauccaggucacgcca

SEQ ID NO: 7898 - RNA, 23 nt, Artificial Sequence
  Synthetic
agguuggcauccaggucacgcca

SEQ ID NO: 7899 - RNA, 24 nt, Artificial Sequence
  Synthetic
gagguuggcauccaggucacgcca

SEQ ID NO: 7900 - RNA, 21 nt, Artificial Sequence
  Synthetic
aaccccagcacuuaagcaaac

SEQ ID NO: 7901 - RNA, 22 nt, Artificial Sequence
  Synthetic
aaaccccagcacuuaagcaaac

SEQ ID NO: 7902 - RNA, 23 nt, Artificial Sequence
  Synthetic
caaaccccagcacuuaagcaaac

SEQ ID NO: 7903 - RNA, 24 nt, Artificial Sequence
  Synthetic
gcaaaccccagcacuuaagcaaac

SEQ ID NO: 7904 - RNA, 18 nt, Artificial Sequence
  Synthetic
agcucuaauccccacgcc

SEQ ID NO: 7905 - RNA, 19 nt, Artificial Sequence
  Synthetic
gagcucuaauccccacgcc

SEQ ID NO: 7906 - RNA, 20 nt, Artificial Sequence
  Synthetic
ggagcucuaauccccacgcc

SEQ ID NO: 7907 - RNA, 21 nt, Artificial Sequence
  Synthetic
uggagcucuaauccccacgcc

SEQ ID NO: 7908 - RNA, 22 nt, Artificial Sequence
  Synthetic
auggagcucuaauccccacgcc

SEQ ID NO: 7909 - RNA, 23 nt, Artificial Sequence
  Synthetic
cauggagcucuaauccccacgcc

SEQ ID NO: 7910 - RNA, 24 nt, Artificial Sequence
  Synthetic
acauggagcucuaauccccacgcc

SEQ ID NO: 7911 - RNA, 18 nt, Artificial Sequence
  Synthetic
uuuaucaacgucaucuag

SEQ ID NO: 7912 - RNA, 19 nt, Artificial Sequence
  Synthetic
guuuaucaacgucaucuag

SEQ ID NO: 7913 - RNA, 20 nt, Artificial Sequence
  Synthetic
uguuuaucaacgucaucuag

SEQ ID NO: 7914 - RNA, 21 nt, Artificial Sequence
  Synthetic
uuguuuaucaacgucaucuag

SEQ ID NO: 7915 - RNA, 22 nt, Artificial Sequence
  Synthetic
auuguuuaucaacgucaucuag

SEQ ID NO: 7916 - RNA, 23 nt, Artificial Sequence
  Synthetic
gauuguuuaucaacgucaucuag

SEQ ID NO: 7917 - RNA, 24 nt, Artificial Sequence
  Synthetic
cgauuguuuaucaacgucaucuag

SEQ ID NO: 7918 - RNA, 18 nt, Artificial Sequence
  Synthetic
agugcagaauaugccccg

SEQ ID NO: 7919 - RNA, 19 nt, Artificial Sequence
  Synthetic
gagugcagaauaugccccg

SEQ ID NO: 7920 - RNA, 20 nt, Artificial Sequence
  Synthetic
ugagugcagaauaugccccg

SEQ ID NO: 7921 - RNA, 21 nt, Artificial Sequence
  Synthetic
augagugcagaauaugccccg

SEQ ID NO: 7922 - RNA, 22 nt, Artificial Sequence
  Synthetic
gaugagugcagaauaugccccg

SEQ ID NO: 7923 - RNA, 23 nt, Artificial Sequence
  Synthetic
ggaugagugcagaauaugccccg

SEQ ID NO: 7924 - RNA, 24 nt, Artificial Sequence
  Synthetic
gggaugagugcagaauaugccccg

SEQ ID NO: 7925 - RNA, 18 nt, Artificial Sequence
  Synthetic
cuaauccccacgccuggg

SEQ ID NO: 7926 - RNA, 19 nt, Artificial Sequence
  Synthetic
ucuaauccccacgccuggg

SEQ ID NO: 7927 - RNA, 20 nt, Artificial Sequence
  Synthetic
cucuaauccccacgccuggg

SEQ ID NO: 7928 - RNA, 21 nt, Artificial Sequence
  Synthetic
gcucuaauccccacgccuggg

SEQ ID NO: 7929 - RNA, 22 nt, Artificial Sequence
  Synthetic
agcucuaauccccacgccuggg

SEQ ID NO: 7930 - RNA, 23 nt, Artificial Sequence
  Synthetic
gagcucuaauccccacgccuggg

SEQ ID NO: 7931 - RNA, 24 nt, Artificial Sequence
  Synthetic
ggagcucuaauccccacgccuggg

SEQ ID NO: 7932 - RNA, 18 nt, Artificial Sequence
  Synthetic
ccacgccugggaugagug

SEQ ID NO: 7933 - RNA, 19 nt, Artificial Sequence
  Synthetic
cccacgccugggaugagug

SEQ ID NO: 7934 - RNA, 20 nt, Artificial Sequence
  Synthetic
ccccacgccugggaugagug

SEQ ID NO: 7935 - RNA, 21 nt, Artificial Sequence
  Synthetic
uccccacgccugggaugagug

SEQ ID NO: 7936 - RNA, 22 nt, Artificial Sequence
  Synthetic
auccccacgccugggaugagug

SEQ ID NO: 7937 - RNA, 23 nt, Artificial Sequence
  Synthetic
aauccccacgccugggaugagug

SEQ ID NO: 7938 - RNA, 24 nt, Artificial Sequence
  Synthetic
uaauccccacgccugggaugagug

SEQ ID NO: 7939 - RNA, 18 nt, Artificial Sequence
  Synthetic
cucugcuuagaaaaagcu

SEQ ID NO: 7940 - RNA, 19 nt, Artificial Sequence
  Synthetic
ccucugcuuagaaaaagcu

SEQ ID NO: 7941 - RNA, 20 nt, Artificial Sequence
  Synthetic
gccucugcuuagaaaaagcu

SEQ ID NO: 7942 - RNA, 21 nt, Artificial Sequence
  Synthetic
agccucugcuuagaaaaagcu

SEQ ID NO: 7943 - RNA, 22 nt, Artificial Sequence
  Synthetic
cagccucugcuuagaaaaagcu

SEQ ID NO: 7944 - RNA, 23 nt, Artificial Sequence
  Synthetic
gcagccucugcuuagaaaaagcu

SEQ ID NO: 7945 - RNA, 24 nt, Artificial Sequence
  Synthetic
ggcagccucugcuuagaaaaagcu

SEQ ID NO: 7946 - RNA, 18 nt, Artificial Sequence
  Synthetic
ccuggaugccaaccucca

SEQ ID NO: 7947 - RNA, 19 nt, Artificial Sequence
  Synthetic
accuggaugccaaccucca

SEQ ID NO: 7948 - RNA, 20 nt, Artificial Sequence
  Synthetic
gaccuggaugccaaccucca

SEQ ID NO: 7949 - RNA, 18 nt, Artificial Sequence
  Synthetic
cccagcacuuaagcaaac

SEQ ID NO: 7950 - RNA, 19 nt, Artificial Sequence
  Synthetic
ccccagcacuuaagcaaac

SEQ ID NO: 7951 - RNA, 20 nt, Artificial Sequence
  Synthetic
accccagcacuuaagcaaac

SEQ ID NO: 7952 - RNA, 18 nt, Artificial Sequence
  Synthetic
aauaagaaugucccccaa

SEQ ID NO: 7953 - RNA, 19 nt, Artificial Sequence
  Synthetic
aaauaagaaugucccccaa

SEQ ID NO: 7954 - RNA, 20 nt, Artificial Sequence
  Synthetic
aaaauaagaaugucccccaa

SEQ ID NO: 7955 - RNA, 21 nt, Artificial Sequence
  Synthetic
aaaaauaagaaugucccccaa

SEQ ID NO: 7956 - RNA, 22 nt, Artificial Sequence
  Synthetic
uaaaaauaagaaugucccccaa

SEQ ID NO: 7957 - RNA, 23 nt, Artificial Sequence
  Synthetic
auaaaaauaagaaugucccccaa

SEQ ID NO: 7958 - RNA, 24 nt, Artificial Sequence
  Synthetic
gauaaaaauaagaaugucccccaa

SEQ ID NO: 7959 - RNA, 18 nt, Artificial Sequence
  Synthetic
uucaucucgauuggugaa

SEQ ID NO: 7960 - RNA, 19 nt, Artificial Sequence
  Synthetic
uuucaucucgauuggugaa

SEQ ID NO: 7961 - RNA, 20 nt, Artificial Sequence
  Synthetic
uuuucaucucgauuggugaa

SEQ ID NO: 7962 - RNA, 21 nt, Artificial Sequence
  Synthetic
uuuuucaucucgauuggugaa

SEQ ID NO: 7963 - RNA, 22 nt, Artificial Sequence
  Synthetic
uuuuuucaucucgauuggugaa

SEQ ID NO: 7964 - RNA, 23 nt, Artificial Sequence
  Synthetic
cuuuuuucaucucgauuggugaa

SEQ ID NO: 7965 - RNA, 24 nt, Artificial Sequence
  Synthetic
gcuuuuuucaucucgauuggugaa

SEQ ID NO: 7966 - RNA, 18 nt, Artificial Sequence
  Synthetic
aaauaagaauguccccca

SEQ ID NO: 7967 - RNA, 19 nt, Artificial Sequence
  Synthetic
aaaauaagaauguccccca

SEQ ID NO: 7968 - RNA, 20 nt, Artificial Sequence
  Synthetic
aaaaauaagaauguccccca

SEQ ID NO: 7969 - RNA, 21 nt, Artificial Sequence
  Synthetic
uaaaaauaagaauguccccca

SEQ ID NO: 7970 - RNA, 22 nt, Artificial Sequence
  Synthetic
auaaaaauaagaauguccccca

SEQ ID NO: 7971 - RNA, 23 nt, Artificial Sequence
  Synthetic
gauaaaaauaagaauguccccca

SEQ ID NO: 7972 - RNA, 24 nt, Artificial Sequence
  Synthetic
cgauaaaaauaagaauguccccca

SEQ ID NO: 7973 - RNA, 18 nt, Artificial Sequence
  Synthetic
ccccuucuggagcuccca

SEQ ID NO: 7974 - RNA, 19 nt, Artificial Sequence
  Synthetic
uccccuucuggagcuccca

SEQ ID NO: 7975 - RNA, 20 nt, Artificial Sequence
  Synthetic
auccccuucuggagcuccca

SEQ ID NO: 7976 - RNA, 21 nt, Artificial Sequence
  Synthetic
gauccccuucuggagcuccca

SEQ ID NO: 7977 - RNA, 22 nt, Artificial Sequence
  Synthetic
ugauccccuucuggagcuccca

SEQ ID NO: 7978 - RNA, 23 nt, Artificial Sequence
  Synthetic
augauccccuucuggagcuccca

SEQ ID NO: 7979 - RNA, 24 nt, Artificial Sequence
  Synthetic
caugauccccuucuggagcuccca

SEQ ID NO: 7980 - RNA, 18 nt, Artificial Sequence
  Synthetic
uagagcuccaugugcaga

SEQ ID NO: 7981 - RNA, 19 nt, Artificial Sequence
  Synthetic
uuagagcuccaugugcaga

SEQ ID NO: 7982 - RNA, 20 nt, Artificial Sequence
  Synthetic
auuagagcuccaugugcaga

SEQ ID NO: 7983 - RNA, 21 nt, Artificial Sequence
  Synthetic
gauuagagcuccaugugcaga

SEQ ID NO: 7984 - RNA, 22 nt, Artificial Sequence
  Synthetic
ggauuagagcuccaugugcaga

SEQ ID NO: 7985 - RNA, 23 nt, Artificial Sequence
  Synthetic
gggauuagagcuccaugugcaga

SEQ ID NO: 7986 - RNA, 24 nt, Artificial Sequence
  Synthetic
ggggauuagagcuccaugugcaga

SEQ ID NO: 7987 - RNA, 18 nt, Artificial Sequence
  Synthetic
gcuccaugugcagaacga

SEQ ID NO: 7988 - RNA, 19 nt, Artificial Sequence
  Synthetic
agcuccaugugcagaacga

SEQ ID NO: 7989 - RNA, 20 nt, Artificial Sequence
  Synthetic
gagcuccaugugcagaacga

SEQ ID NO: 7990 - RNA, 21 nt, Artificial Sequence
  Synthetic
agagcuccaugugcagaacga

SEQ ID NO: 7991 - RNA, 22 nt, Artificial Sequence
  Synthetic
uagagcuccaugugcagaacga

SEQ ID NO: 7992 - RNA, 23 nt, Artificial Sequence
  Synthetic
uuagagcuccaugugcagaacga

SEQ ID NO: 7993 - RNA, 24 nt, Artificial Sequence
  Synthetic
auuagagcuccaugugcagaacga

SEQ ID NO: 7994 - RNA, 18 nt, Artificial Sequence
  Synthetic
uuucaucucgauugguga

SEQ ID NO: 7995 - RNA, 19 nt, Artificial Sequence
  Synthetic
uuuucaucucgauugguga

SEQ ID NO: 7996 - RNA, 20 nt, Artificial Sequence
  Synthetic
uuuuucaucucgauugguga

SEQ ID NO: 7997 - RNA, 21 nt, Artificial Sequence
  Synthetic
uuuuuucaucucgauugguga

SEQ ID NO: 7998 - RNA, 22 nt, Artificial Sequence
  Synthetic
cuuuuuucaucucgauugguga

SEQ ID NO: 7999 - RNA, 23 nt, Artificial Sequence
  Synthetic
gcuuuuuucaucucgauugguga

SEQ ID NO: 8000 - RNA, 24 nt, Artificial Sequence
  Synthetic
ugcuuuuuucaucucgauugguga

SEQ ID NO: 8001 - RNA, 18 nt, Artificial Sequence
  Synthetic
gcagaaguuuaucuguga

SEQ ID NO: 8002 - RNA, 19 nt, Artificial Sequence
  Synthetic
ugcagaaguuuaucuguga

SEQ ID NO: 8003 - RNA, 20 nt, Artificial Sequence
  Synthetic
gugcagaaguuuaucuguga

SEQ ID NO: 8004 - RNA, 21 nt, Artificial Sequence
  Synthetic
agugcagaaguuuaucuguga

SEQ ID NO: 8005 - RNA, 22 nt, Artificial Sequence
  Synthetic
cagugcagaaguuuaucuguga

SEQ ID NO: 8006 - RNA, 23 nt, Artificial Sequence
  Synthetic
ccagugcagaaguuuaucuguga

SEQ ID NO: 8007 - RNA, 24 nt, Artificial Sequence
  Synthetic
uccagugcagaaguuuaucuguga

SEQ ID NO: 8008 - RNA, 18 nt, Artificial Sequence
  Synthetic
gagcuccaugugcagaac

SEQ ID NO: 8009 - RNA, 19 nt, Artificial Sequence
  Synthetic
agagcuccaugugcagaac

SEQ ID NO: 8010 - RNA, 20 nt, Artificial Sequence
  Synthetic
uagagcuccaugugcagaac

SEQ ID NO: 8011 - RNA, 21 nt, Artificial Sequence
  Synthetic
uuagagcuccaugugcagaac

SEQ ID NO: 8012 - RNA, 22 nt, Artificial Sequence
  Synthetic
auuagagcuccaugugcagaac

SEQ ID NO: 8013 - RNA, 23 nt, Artificial Sequence
  Synthetic
gauuagagcuccaugugcagaac

SEQ ID NO: 8014 - RNA, 24 nt, Artificial Sequence
  Synthetic
ggauuagagcuccaugugcagaac

SEQ ID NO: 8015 - RNA, 18 nt, Artificial Sequence
  Synthetic
uauuauuggguuacuuac

SEQ ID NO: 8016 - RNA, 19 nt, Artificial Sequence
  Synthetic
cuauuauuggguuacuuac

SEQ ID NO: 8017 - RNA, 20 nt, Artificial Sequence
  Synthetic
acuauuauuggguuacuuac

SEQ ID NO: 8018 - RNA, 21 nt, Artificial Sequence
  Synthetic
uacuauuauuggguuacuuac

SEQ ID NO: 8019 - RNA, 22 nt, Artificial Sequence
  Synthetic
uuacuauuauuggguuacuuac

SEQ ID NO: 8020 - RNA, 23 nt, Artificial Sequence
  Synthetic
auuacuauuauuggguuacuuac

SEQ ID NO: 8021 - RNA, 24 nt, Artificial Sequence
  Synthetic
uauuacuauuauuggguuacuuac

SEQ ID NO: 8022 - RNA, 18 nt, Artificial Sequence
  Synthetic
accuggaugccaaccucc

SEQ ID NO: 8023 - RNA, 19 nt, Artificial Sequence
  Synthetic
gaccuggaugccaaccucc

SEQ ID NO: 8024 - RNA, 20 nt, Artificial Sequence
  Synthetic
ugaccuggaugccaaccucc

SEQ ID NO: 8025 - RNA, 21 nt, Artificial Sequence
  Synthetic
gugaccuggaugccaaccucc

SEQ ID NO: 8026 - RNA, 22 nt, Artificial Sequence
  Synthetic
cgugaccuggaugccaaccucc

SEQ ID NO: 8027 - RNA, 23 nt, Artificial Sequence
  Synthetic
gcgugaccuggaugccaaccucc

SEQ ID NO: 8028 - RNA, 24 nt, Artificial Sequence
  Synthetic
ggcgugaccuggaugccaaccucc

SEQ ID NO: 8029 - RNA, 18 nt, Artificial Sequence
  Synthetic
ucugcacucaucccaggc

SEQ ID NO: 8030 - RNA, 19 nt, Artificial Sequence
  Synthetic
uucugcacucaucccaggc

SEQ ID NO: 8031 - RNA, 20 nt, Artificial Sequence
  Synthetic
auucugcacucaucccaggc

SEQ ID NO: 8032 - RNA, 21 nt, Artificial Sequence
  Synthetic
uauucugcacucaucccaggc

SEQ ID NO: 8033 - RNA, 22 nt, Artificial Sequence
  Synthetic
auauucugcacucaucccaggc

SEQ ID NO: 8034 - RNA, 23 nt, Artificial Sequence
  Synthetic
cauauucugcacucaucccaggc

SEQ ID NO: 8035 - RNA, 24 nt, Artificial Sequence
  Synthetic
gcauauucugcacucaucccaggc

SEQ ID NO: 8036 - RNA, 18 nt, Artificial Sequence
  Synthetic
gaggucaugauccccuuc

SEQ ID NO: 8037 - RNA, 19 nt, Artificial Sequence
  Synthetic
ggaggucaugauccccuuc

SEQ ID NO: 8038 - RNA, 20 nt, Artificial Sequence
  Synthetic
aggaggucaugauccccuuc

SEQ ID NO: 8039 - RNA, 21 nt, Artificial Sequence
  Synthetic
gaggaggucaugauccccuuc

SEQ ID NO: 8040 - RNA, 22 nt, Artificial Sequence
  Synthetic
ugaggaggucaugauccccuuc

SEQ ID NO: 8041 - RNA, 23 nt, Artificial Sequence
  Synthetic
gugaggaggucaugauccccuuc

SEQ ID NO: 8042 - RNA, 24 nt, Artificial Sequence
  Synthetic
ggugaggaggucaugauccccuuc

SEQ ID NO: 8043 - RNA, 18 nt, Artificial Sequence
  Synthetic
aucuguaagaauggcuuc

SEQ ID NO: 8044 - RNA, 19 nt, Artificial Sequence
  Synthetic
caucuguaagaauggcuuc

SEQ ID NO: 8045 - RNA, 20 nt, Artificial Sequence
  Synthetic
ucaucuguaagaauggcuuc

SEQ ID NO: 8046 - RNA, 21 nt, Artificial Sequence
  Synthetic
aucaucuguaagaauggcuuc

SEQ ID NO: 8047 - RNA, 22 nt, Artificial Sequence
  Synthetic
caucaucuguaagaauggcuuc

SEQ ID NO: 8048 - RNA, 23 nt, Artificial Sequence
  Synthetic
ucaucaucuguaagaauggcuuc

SEQ ID NO: 8049 - RNA, 24 nt, Artificial Sequence
  Synthetic
uucaucaucuguaagaauggcuuc

SEQ ID NO: 8050 - RNA, 18 nt, Artificial Sequence
  Synthetic
ucaucucgauuggugaag

SEQ ID NO: 8051 - RNA, 19 nt, Artificial Sequence
  Synthetic
uucaucucgauuggugaag

SEQ ID NO: 8052 - RNA, 20 nt, Artificial Sequence
  Synthetic
uuucaucucgauuggugaag

SEQ ID NO: 8053 - RNA, 21 nt, Artificial Sequence
  Synthetic
uuuucaucucgauuggugaag

SEQ ID NO: 8054 - RNA, 22 nt, Artificial Sequence
  Synthetic
uuuuucaucucgauuggugaag

SEQ ID NO: 8055 - RNA, 23 nt, Artificial Sequence
  Synthetic
uuuuuucaucucgauuggugaag

SEQ ID NO: 8056 - RNA, 24 nt, Artificial Sequence
  Synthetic
cuuuuuucaucucgauuggugaag

SEQ ID NO: 8057 - RNA, 18 nt, Artificial Sequence
  Synthetic
uccacagcuuuuucuaag

SEQ ID NO: 8058 - RNA, 19 nt, Artificial Sequence
  Synthetic
auccacagcuuuuucuaag

SEQ ID NO: 8059 - RNA, 20 nt, Artificial Sequence
  Synthetic
uauccacagcuuuuucuaag

SEQ ID NO: 8060 - RNA, 21 nt, Artificial Sequence
  Synthetic
uuauccacagcuuuuucuaag

SEQ ID NO: 8061 - RNA, 22 nt, Artificial Sequence
  Synthetic
cuuauccacagcuuuuucuaag

SEQ ID NO: 8062 - RNA, 23 nt, Artificial Sequence
  Synthetic
gcuuauccacagcuuuuucuaag

SEQ ID NO: 8063 - RNA, 24 nt, Artificial Sequence
  Synthetic
ggcuuauccacagcuuuuucuaag

SEQ ID NO: 8064 - RNA, 18 nt, Artificial Sequence
  Synthetic
aucuggcacugcccacag

SEQ ID NO: 8065 - RNA, 19 nt, Artificial Sequence
  Synthetic
caucuggcacugcccacag

SEQ ID NO: 8066 - RNA, 20 nt, Artificial Sequence
  Synthetic
ucaucuggcacugcccacag

SEQ ID NO: 8067 - RNA, 21 nt, Artificial Sequence
  Synthetic
uucaucuggcacugcccacag

SEQ ID NO: 8068 - RNA, 22 nt, Artificial Sequence
  Synthetic
guucaucuggcacugcccacag

SEQ ID NO: 8069 - RNA, 23 nt, Artificial Sequence
  Synthetic
aguucaucuggcacugcccacag

SEQ ID NO: 8070 - RNA, 24 nt, Artificial Sequence
  Synthetic
aaguucaucuggcacugcccacag

SEQ ID NO: 8071 - RNA, 18 nt, Artificial Sequence
  Synthetic
cuccaugugcagaacgag

SEQ ID NO: 8072 - RNA, 19 nt, Artificial Sequence
  Synthetic
gcuccaugugcagaacgag

SEQ ID NO: 8073 - RNA, 20 nt, Artificial Sequence
  Synthetic
agcuccaugugcagaacgag

SEQ ID NO: 8074 - RNA, 21 nt, Artificial Sequence
  Synthetic
gagcuccaugugcagaacgag

SEQ ID NO: 8075 - RNA, 22 nt, Artificial Sequence
  Synthetic
agagcuccaugugcagaacgag

SEQ ID NO: 8076 - RNA, 23 nt, Artificial Sequence
  Synthetic
uagagcuccaugugcagaacgag

SEQ ID NO: 8077 - RNA, 24 nt, Artificial Sequence
  Synthetic
uuagagcuccaugugcagaacgag

SEQ ID NO: 8078 - RNA, 18 nt, Artificial Sequence
  Synthetic
ugugcagaacgaggggag

SEQ ID NO: 8079 - RNA, 19 nt, Artificial Sequence
  Synthetic
augugcagaacgaggggag

SEQ ID NO: 8080 - RNA, 20 nt, Artificial Sequence
  Synthetic
caugugcagaacgaggggag

SEQ ID NO: 8081 - RNA, 21 nt, Artificial Sequence
  Synthetic
ccaugugcagaacgaggggag

SEQ ID NO: 8082 - RNA, 22 nt, Artificial Sequence
  Synthetic
uccaugugcagaacgaggggag

SEQ ID NO: 8083 - RNA, 23 nt, Artificial Sequence
  Synthetic
cuccaugugcagaacgaggggag

SEQ ID NO: 8084 - RNA, 24 nt, Artificial Sequence
  Synthetic
gcuccaugugcagaacgaggggag

SEQ ID NO: 8085 - RNA, 18 nt, Artificial Sequence
  Synthetic
agcuccaugugcagaacg

SEQ ID NO: 8086 - RNA, 19 nt, Artificial Sequence
  Synthetic
gagcuccaugugcagaacg

SEQ ID NO: 8087 - RNA, 20 nt, Artificial Sequence
  Synthetic
agagcuccaugugcagaacg

SEQ ID NO: 8088 - RNA, 21 nt, Artificial Sequence
  Synthetic
uagagcuccaugugcagaacg

SEQ ID NO: 8089 - RNA, 22 nt, Artificial Sequence
  Synthetic
uuagagcuccaugugcagaacg

SEQ ID NO: 8090 - RNA, 23 nt, Artificial Sequence
  Synthetic
auuagagcuccaugugcagaacg

SEQ ID NO: 8091 - RNA, 24 nt, Artificial Sequence
  Synthetic
gauuagagcuccaugugcagaacg

SEQ ID NO: 8092 - RNA, 18 nt, Artificial Sequence
  Synthetic
cugcacucaucccaggcg

SEQ ID NO: 8093 - RNA, 19 nt, Artificial Sequence
  Synthetic
ucugcacucaucccaggcg

SEQ ID NO: 8094 - RNA, 20 nt, Artificial Sequence
  Synthetic
uucugcacucaucccaggcg

SEQ ID NO: 8095 - RNA, 21 nt, Artificial Sequence
  Synthetic
auucugcacucaucccaggcg

SEQ ID NO: 8096 - RNA, 22 nt, Artificial Sequence
  Synthetic
uauucugcacucaucccaggcg

SEQ ID NO: 8097 - RNA, 23 nt, Artificial Sequence
  Synthetic
auauucugcacucaucccaggcg

SEQ ID NO: 8098 - RNA, 24 nt, Artificial Sequence
  Synthetic
cauauucugcacucaucccaggcg

SEQ ID NO: 8099 - RNA, 18 nt, Artificial Sequence
  Synthetic
ggguuugccuugcuugcg

SEQ ID NO: 8100 - RNA, 19 nt, Artificial Sequence
  Synthetic
gggguuugccuugcuugcg

SEQ ID NO: 8101 - RNA, 20 nt, Artificial Sequence
  Synthetic
ugggguuugccuugcuugcg

SEQ ID NO: 8102 - RNA, 21 nt, Artificial Sequence
  Synthetic
cugggguuugccuugcuugcg

SEQ ID NO: 8103 - RNA, 22 nt, Artificial Sequence
  Synthetic
gcugggguuugccuugcuugcg

SEQ ID NO: 8104 - RNA, 23 nt, Artificial Sequence
  Synthetic
ugcugggguuugccuugcuugcg

SEQ ID NO: 8105 - RNA, 24 nt, Artificial Sequence
  Synthetic
gugcugggguuugccuugcuugcg

SEQ ID NO: 8106 - RNA, 18 nt, Artificial Sequence
  Synthetic
ccaugugcagaacgaggg

SEQ ID NO: 8107 - RNA, 19 nt, Artificial Sequence
  Synthetic
uccaugugcagaacgaggg

SEQ ID NO: 8108 - RNA, 20 nt, Artificial Sequence
  Synthetic
cuccaugugcagaacgaggg

SEQ ID NO: 8109 - RNA, 21 nt, Artificial Sequence
  Synthetic
gcuccaugugcagaacgaggg

SEQ ID NO: 8110 - RNA, 22 nt, Artificial Sequence
  Synthetic
agcuccaugugcagaacgaggg

SEQ ID NO: 8111 - RNA, 23 nt, Artificial Sequence
  Synthetic
gagcuccaugugcagaacgaggg

SEQ ID NO: 8112 - RNA, 24 nt, Artificial Sequence
  Synthetic
agagcuccaugugcagaacgaggg

SEQ ID NO: 8113 - RNA, 18 nt, Artificial Sequence
  Synthetic
gacauggugggcugcggg

SEQ ID NO: 8114 - RNA, 19 nt, Artificial Sequence
  Synthetic
agacauggugggcugcggg

SEQ ID NO: 8115 - RNA, 20 nt, Artificial Sequence
  Synthetic
gagacauggugggcugcggg

SEQ ID NO: 8116 - RNA, 21 nt, Artificial Sequence
  Synthetic
cgagacauggugggcugcggg

SEQ ID NO: 8117 - RNA, 22 nt, Artificial Sequence
  Synthetic
gcgagacauggugggcugcggg

SEQ ID NO: 8118 - RNA, 23 nt, Artificial Sequence
  Synthetic
ggcgagacauggugggcugcggg

SEQ ID NO: 8119 - RNA, 24 nt, Artificial Sequence
  Synthetic
cggcgagacauggugggcugcggg

SEQ ID NO: 8120 - RNA, 18 nt, Artificial Sequence
  Synthetic
caugugcagaacgagggg

SEQ ID NO: 8121 - RNA, 19 nt, Artificial Sequence
  Synthetic
ccaugugcagaacgagggg

SEQ ID NO: 8122 - RNA, 20 nt, Artificial Sequence
  Synthetic
uccaugugcagaacgagggg

SEQ ID NO: 8123 - RNA, 21 nt, Artificial Sequence
  Synthetic
cuccaugugcagaacgagggg

SEQ ID NO: 8124 - RNA, 22 nt, Artificial Sequence
  Synthetic
gcuccaugugcagaacgagggg

SEQ ID NO: 8125 - RNA, 23 nt, Artificial Sequence
  Synthetic
agcuccaugugcagaacgagggg

SEQ ID NO: 8126 - RNA, 24 nt, Artificial Sequence
  Synthetic
gagcuccaugugcagaacgagggg

SEQ ID NO: 8127 - RNA, 18 nt, Artificial Sequence
  Synthetic
caagaggcucggcugugg

SEQ ID NO: 8128 - RNA, 19 nt, Artificial Sequence
  Synthetic
ucaagaggcucggcugugg

SEQ ID NO: 8129 - RNA, 20 nt, Artificial Sequence
  Synthetic
uucaagaggcucggcugugg

SEQ ID NO: 8130 - RNA, 21 nt, Artificial Sequence
  Synthetic
cuucaagaggcucggcugugg

SEQ ID NO: 8131 - RNA, 22 nt, Artificial Sequence
  Synthetic
gcuucaagaggcucggcugugg

SEQ ID NO: 8132 - RNA, 23 nt, Artificial Sequence
  Synthetic
ggcuucaagaggcucggcugugg

SEQ ID NO: 8133 - RNA, 24 nt, Artificial Sequence
  Synthetic
uggcuucaagaggcucggcugugg

SEQ ID NO: 8134 - RNA, 18 nt, Artificial Sequence
  Synthetic
ugcuugcggcgagacaug

SEQ ID NO: 8135 - RNA, 19 nt, Artificial Sequence
  Synthetic
uugcuugcggcgagacaug

SEQ ID NO: 8136 - RNA, 20 nt, Artificial Sequence
  Synthetic
cuugcuugcggcgagacaug

SEQ ID NO: 8137 - RNA, 21 nt, Artificial Sequence
  Synthetic
ccuugcuugcggcgagacaug

SEQ ID NO: 8138 - RNA, 22 nt, Artificial Sequence
  Synthetic
gccuugcuugcggcgagacaug

SEQ ID NO: 8139 - RNA, 23 nt, Artificial Sequence
  Synthetic
ugccuugcuugcggcgagacaug

SEQ ID NO: 8140 - RNA, 24 nt, Artificial Sequence
  Synthetic
uugccuugcuugcggcgagacaug

SEQ ID NO: 8141 - RNA, 18 nt, Artificial Sequence
  Synthetic
caacuuacaaauacccug

SEQ ID NO: 8142 - RNA, 19 nt, Artificial Sequence
  Synthetic
ucaacuuacaaauacccug

SEQ ID NO: 8143 - RNA, 20 nt, Artificial Sequence
  Synthetic
cucaacuuacaaauacccug

SEQ ID NO: 8144 - RNA, 21 nt, Artificial Sequence
  Synthetic
gcucaacuuacaaauacccug

SEQ ID NO: 8145 - RNA, 22 nt, Artificial Sequence
  Synthetic
ggcucaacuuacaaauacccug

SEQ ID NO: 8146 - RNA, 23 nt, Artificial Sequence
  Synthetic
aggcucaacuuacaaauacccug

SEQ ID NO: 8147 - RNA, 24 nt, Artificial Sequence
  Synthetic
aaggcucaacuuacaaauacccug

SEQ ID NO: 8148 - RNA, 18 nt, Artificial Sequence
  Synthetic
guuguacauguguagcug

SEQ ID NO: 8149 - RNA, 19 nt, Artificial Sequence
  Synthetic
aguuguacauguguagcug

SEQ ID NO: 8150 - RNA, 20 nt, Artificial Sequence
  Synthetic
aaguuguacauguguagcug

SEQ ID NO: 8151 - RNA, 21 nt, Artificial Sequence
  Synthetic
caaguuguacauguguagcug

SEQ ID NO: 8152 - RNA, 22 nt, Artificial Sequence
  Synthetic
gcaaguuguacauguguagcug

SEQ ID NO: 8153 - RNA, 23 nt, Artificial Sequence
  Synthetic
ugcaaguuguacauguguagcug

SEQ ID NO: 8154 - RNA, 24 nt, Artificial Sequence
  Synthetic
uugcaaguuguacauguguagcug

SEQ ID NO: 8155 - RNA, 18 nt, Artificial Sequence
  Synthetic
gcgagacauggugggcug

SEQ ID NO: 8156 - RNA, 19 nt, Artificial Sequence
  Synthetic
ggcgagacauggugggcug

SEQ ID NO: 8157 - RNA, 20 nt, Artificial Sequence
  Synthetic
cggcgagacauggugggcug

SEQ ID NO: 8158 - RNA, 21 nt, Artificial Sequence
  Synthetic
gcggcgagacauggugggcug

SEQ ID NO: 8159 - RNA, 22 nt, Artificial Sequence
  Synthetic
ugcggcgagacauggugggcug

SEQ ID NO: 8160 - RNA, 23 nt, Artificial Sequence
  Synthetic
uugcggcgagacauggugggcug

SEQ ID NO: 8161 - RNA, 24 nt, Artificial Sequence
  Synthetic
cuugcggcgagacauggugggcug

SEQ ID NO: 8162 - RNA, 18 nt, Artificial Sequence
  Synthetic
uucccguuugcuuaagug

SEQ ID NO: 8163 - RNA, 19 nt, Artificial Sequence
  Synthetic
auucccguuugcuuaagug

SEQ ID NO: 8164 - RNA, 20 nt, Artificial Sequence
  Synthetic
aauucccguuugcuuaagug

SEQ ID NO: 8165 - RNA, 21 nt, Artificial Sequence
  Synthetic
gaauucccguuugcuuaagug

SEQ ID NO: 8166 - RNA, 22 nt, Artificial Sequence
  Synthetic
agaauucccguuugcuuaagug

SEQ ID NO: 8167 - RNA, 23 nt, Artificial Sequence
  Synthetic
gagaauucccguuugcuuaagug

SEQ ID NO: 8168 - RNA, 24 nt, Artificial Sequence
  Synthetic
cgagaauucccguuugcuuaagug

SEQ ID NO: 8169 - RNA, 18 nt, Artificial Sequence
  Synthetic
ggagaggccccuccagug

SEQ ID NO: 8170 - RNA, 19 nt, Artificial Sequence
  Synthetic
aggagaggccccuccagug

SEQ ID NO: 8171 - RNA, 20 nt, Artificial Sequence
  Synthetic
gaggagaggccccuccagug

SEQ ID NO: 8172 - RNA, 21 nt, Artificial Sequence
  Synthetic
ggaggagaggccccuccagug

SEQ ID NO: 8173 - RNA, 22 nt, Artificial Sequence
  Synthetic
gggaggagaggccccuccagug

SEQ ID NO: 8174 - RNA, 23 nt, Artificial Sequence
  Synthetic
ggggaggagaggccccuccagug

SEQ ID NO: 8175 - RNA, 24 nt, Artificial Sequence
  Synthetic
aggggaggagaggccccuccagug

SEQ ID NO: 8176 - RNA, 18 nt, Artificial Sequence
  Synthetic
uggcacugcccacaggug

SEQ ID NO: 8177 - RNA, 19 nt, Artificial Sequence
  Synthetic
cuggcacugcccacaggug

SEQ ID NO: 8178 - RNA, 20 nt, Artificial Sequence
  Synthetic
ucuggcacugcccacaggug

SEQ ID NO: 8179 - RNA, 21 nt, Artificial Sequence
  Synthetic
aucuggcacugcccacaggug

SEQ ID NO: 8180 - RNA, 22 nt, Artificial Sequence
  Synthetic
caucuggcacugcccacaggug

SEQ ID NO: 8181 - RNA, 23 nt, Artificial Sequence
  Synthetic
ucaucuggcacugcccacaggug

SEQ ID NO: 8182 - RNA, 24 nt, Artificial Sequence
  Synthetic
uucaucuggcacugcccacaggug

SEQ ID NO: 8183 - RNA, 18 nt, Artificial Sequence
  Synthetic
uuuucaucucgauuggug

SEQ ID NO: 8184 - RNA, 19 nt, Artificial Sequence
  Synthetic
uuuuucaucucgauuggug

SEQ ID NO: 8185 - RNA, 20 nt, Artificial Sequence
  Synthetic
uuuuuucaucucgauuggug

SEQ ID NO: 8186 - RNA, 21 nt, Artificial Sequence
  Synthetic
cuuuuuucaucucgauuggug

SEQ ID NO: 8187 - RNA, 22 nt, Artificial Sequence
  Synthetic
gcuuuuuucaucucgauuggug

SEQ ID NO: 8188 - RNA, 23 nt, Artificial Sequence
  Synthetic
ugcuuuuuucaucucgauuggug

SEQ ID NO: 8189 - RNA, 24 nt, Artificial Sequence
  Synthetic
augcuuuuuucaucucgauuggug

SEQ ID NO: 8190 - RNA, 18 nt, Artificial Sequence
  Synthetic
ggauuagagcuccaugug

SEQ ID NO: 8191 - RNA, 19 nt, Artificial Sequence
  Synthetic
gggauuagagcuccaugug

SEQ ID NO: 8192 - RNA, 20 nt, Artificial Sequence
  Synthetic
ggggauuagagcuccaugug

SEQ ID NO: 8193 - RNA, 21 nt, Artificial Sequence
  Synthetic
uggggauuagagcuccaugug

SEQ ID NO: 8194 - RNA, 22 nt, Artificial Sequence
  Synthetic
guggggauuagagcuccaugug

SEQ ID NO: 8195 - RNA, 23 nt, Artificial Sequence
  Synthetic
cguggggauuagagcuccaugug

SEQ ID NO: 8196 - RNA, 24 nt, Artificial Sequence
  Synthetic
gcguggggauuagagcuccaugug

SEQ ID NO: 8197 - RNA, 18 nt, Artificial Sequence
  Synthetic
cuuuuuucaucucgauug

SEQ ID NO: 8198 - RNA, 19 nt, Artificial Sequence
  Synthetic
gcuuuuuucaucucgauug

SEQ ID NO: 8199 - RNA, 20 nt, Artificial Sequence
  Synthetic
ugcuuuuuucaucucgauug

SEQ ID NO: 8200 - RNA, 21 nt, Artificial Sequence
  Synthetic
augcuuuuuucaucucgauug

SEQ ID NO: 8201 - RNA, 22 nt, Artificial Sequence
  Synthetic
gaugcuuuuuucaucucgauug

SEQ ID NO: 8202 - RNA, 23 nt, Artificial Sequence
  Synthetic
ggaugcuuuuuucaucucgauug

SEQ ID NO: 8203 - RNA, 24 nt, Artificial Sequence
  Synthetic
uggaugcuuuuuucaucucgauug

SEQ ID NO: 8204 - RNA, 18 nt, Artificial Sequence
  Synthetic
gaggcucggcugugguug

SEQ ID NO: 8205 - RNA, 19 nt, Artificial Sequence
  Synthetic
agaggcucggcugugguug

SEQ ID NO: 8206 - RNA, 20 nt, Artificial Sequence
  Synthetic
aagaggcucggcugugguug

SEQ ID NO: 8207 - RNA, 21 nt, Artificial Sequence
  Synthetic
caagaggcucggcugugguug

SEQ ID NO: 8208 - RNA, 22 nt, Artificial Sequence
  Synthetic
ucaagaggcucggcugugguug

SEQ ID NO: 8209 - RNA, 23 nt, Artificial Sequence
  Synthetic
uucaagaggcucggcugugguug

SEQ ID NO: 8210 - RNA, 24 nt, Artificial Sequence
  Synthetic
cuucaagaggcucggcugugguug

SEQ ID NO: 8211 - RNA, 18 nt, Artificial Sequence
  Synthetic
auaagaaugucccccaau

SEQ ID NO: 8212 - RNA, 19 nt, Artificial Sequence
  Synthetic
aauaagaaugucccccaau

SEQ ID NO: 8213 - RNA, 20 nt, Artificial Sequence
  Synthetic
aaauaagaaugucccccaau

SEQ ID NO: 8214 - RNA, 21 nt, Artificial Sequence
  Synthetic
aaaauaagaaugucccccaau

SEQ ID NO: 8215 - RNA, 22 nt, Artificial Sequence
  Synthetic
aaaaauaagaaugucccccaau

SEQ ID NO: 8216 - RNA, 23 nt, Artificial Sequence
  Synthetic
uaaaaauaagaaugucccccaau

SEQ ID NO: 8217 - RNA, 24 nt, Artificial Sequence
  Synthetic
auaaaaauaagaaugucccccaau

SEQ ID NO: 8218 - RNA, 18 nt, Artificial Sequence
  Synthetic
caucccaggcguggggau

SEQ ID NO: 8219 - RNA, 19 nt, Artificial Sequence
  Synthetic
ucaucccaggcguggggau

SEQ ID NO: 8220 - RNA, 20 nt, Artificial Sequence
  Synthetic
cucaucccaggcguggggau

SEQ ID NO: 8221 - RNA, 21 nt, Artificial Sequence
  Synthetic
acucaucccaggcguggggau

SEQ ID NO: 8222 - RNA, 22 nt, Artificial Sequence
  Synthetic
cacucaucccaggcguggggau

SEQ ID NO: 8223 - RNA, 23 nt, Artificial Sequence
  Synthetic
gcacucaucccaggcguggggau

SEQ ID NO: 8224 - RNA, 24 nt, Artificial Sequence
  Synthetic
ugcacucaucccaggcguggggau

SEQ ID NO: 8225 - RNA, 18 nt, Artificial Sequence
  Synthetic
ucaacuuacaaauacccu

SEQ ID NO: 8226 - RNA, 19 nt, Artificial Sequence
  Synthetic
cucaacuuacaaauacccu

SEQ ID NO: 8227 - RNA, 20 nt, Artificial Sequence
  Synthetic
gcucaacuuacaaauacccu

SEQ ID NO: 8228 - RNA, 21 nt, Artificial Sequence
  Synthetic
ggcucaacuuacaaauacccu

SEQ ID NO: 8229 - RNA, 22 nt, Artificial Sequence
  Synthetic
aggcucaacuuacaaauacccu

SEQ ID NO: 8230 - RNA, 23 nt, Artificial Sequence
  Synthetic
aaggcucaacuuacaaauacccu

SEQ ID NO: 8231 - RNA, 24 nt, Artificial Sequence
  Synthetic
uaaggcucaacuuacaaauacccu

SEQ ID NO: 8232 - RNA, 18 nt, Artificial Sequence
  Synthetic
ggcgagacauggugggcu

SEQ ID NO: 8233 - RNA, 19 nt, Artificial Sequence
  Synthetic
cggcgagacauggugggcu

SEQ ID NO: 8234 - RNA, 20 nt, Artificial Sequence
  Synthetic
gcggcgagacauggugggcu

SEQ ID NO: 8235 - RNA, 21 nt, Artificial Sequence
  Synthetic
ugcggcgagacauggugggcu

SEQ ID NO: 8236 - RNA, 22 nt, Artificial Sequence
  Synthetic
uugcggcgagacauggugggcu

SEQ ID NO: 8237 - RNA, 23 nt, Artificial Sequence
  Synthetic
cuugcggcgagacauggugggcu

SEQ ID NO: 8238 - RNA, 24 nt, Artificial Sequence
  Synthetic
gcuugcggcgagacauggugggcu

SEQ ID NO: 8239 - RNA, 18 nt, Artificial Sequence
  Synthetic
cagugcagaaguuuaucu

SEQ ID NO: 8240 - RNA, 19 nt, Artificial Sequence
  Synthetic
ccagugcagaaguuuaucu

SEQ ID NO: 8241 - RNA, 20 nt, Artificial Sequence
  Synthetic
uccagugcagaaguuuaucu

SEQ ID NO: 8242 - RNA, 21 nt, Artificial Sequence
  Synthetic
cuccagugcagaaguuuaucu

SEQ ID NO: 8243 - RNA, 22 nt, Artificial Sequence
  Synthetic
ccuccagugcagaaguuuaucu

SEQ ID NO: 8244 - RNA, 23 nt, Artificial Sequence
  Synthetic
cccuccagugcagaaguuuaucu

SEQ ID NO: 8245 - RNA, 24 nt, Artificial Sequence
  Synthetic
ccccuccagugcagaaguuuaucu

SEQ ID NO: 8246 - RNA, 18 nt, Artificial Sequence
  Synthetic
cuggcacugcccacaggu

SEQ ID NO: 8247 - RNA, 19 nt, Artificial Sequence
  Synthetic
ucuggcacugcccacaggu

SEQ ID NO: 8248 - RNA, 20 nt, Artificial Sequence
  Synthetic
aucuggcacugcccacaggu

SEQ ID NO: 8249 - RNA, 21 nt, Artificial Sequence
  Synthetic
caucuggcacugcccacaggu

SEQ ID NO: 8250 - RNA, 22 nt, Artificial Sequence
  Synthetic
ucaucuggcacugcccacaggu

SEQ ID NO: 8251 - RNA, 23 nt, Artificial Sequence
  Synthetic
uucaucuggcacugcccacaggu

SEQ ID NO: 8252 - RNA, 24 nt, Artificial Sequence
  Synthetic
guucaucuggcacugcccacaggu

SEQ ID NO: 8253 - RNA, 18 nt, Artificial Sequence
  Synthetic
aagaggcucggcuguggu

SEQ ID NO: 8254 - RNA, 19 nt, Artificial Sequence
  Synthetic
caagaggcucggcuguggu

SEQ ID NO: 8255 - RNA, 20 nt, Artificial Sequence
  Synthetic
ucaagaggcucggcuguggu

SEQ ID NO: 8256 - RNA, 21 nt, Artificial Sequence
  Synthetic
uucaagaggcucggcuguggu

SEQ ID NO: 8257 - RNA, 22 nt, Artificial Sequence
  Synthetic
cuucaagaggcucggcuguggu

SEQ ID NO: 8258 - RNA, 23 nt, Artificial Sequence
  Synthetic
gcuucaagaggcucggcuguggu

SEQ ID NO: 8259 - RNA, 24 nt, Artificial Sequence
  Synthetic
ggcuucaagaggcucggcuguggu

SEQ ID NO: 8260 - RNA, 18 nt, Artificial Sequence
  Synthetic
ccugcuauguguuccugu

SEQ ID NO: 8261 - RNA, 19 nt, Artificial Sequence
  Synthetic
accugcuauguguuccugu

SEQ ID NO: 8262 - RNA, 20 nt, Artificial Sequence
  Synthetic
uaccugcuauguguuccugu

SEQ ID NO: 8263 - RNA, 21 nt, Artificial Sequence
  Synthetic
uuaccugcuauguguuccugu

SEQ ID NO: 8264 - RNA, 22 nt, Artificial Sequence
  Synthetic
uuuaccugcuauguguuccugu

SEQ ID NO: 8265 - RNA, 23 nt, Artificial Sequence
  Synthetic
auuuaccugcuauguguuccugu

SEQ ID NO: 8266 - RNA, 24 nt, Artificial Sequence
  Synthetic
cauuuaccugcuauguguuccugu

SEQ ID NO: 8267 - RNA, 18 nt, Artificial Sequence
  Synthetic
ggaggucaugauccccuu

SEQ ID NO: 8268 - RNA, 19 nt, Artificial Sequence
  Synthetic
aggaggucaugauccccuu

SEQ ID NO: 8269 - RNA, 20 nt, Artificial Sequence
  Synthetic
gaggaggucaugauccccuu

SEQ ID NO: 8270 - RNA, 21 nt, Artificial Sequence
  Synthetic
ugaggaggucaugauccccuu

SEQ ID NO: 8271 - RNA, 22 nt, Artificial Sequence
  Synthetic
gugaggaggucaugauccccuu

SEQ ID NO: 8272 - RNA, 23 nt, Artificial Sequence
  Synthetic
ggugaggaggucaugauccccuu

SEQ ID NO: 8273 - RNA, 24 nt, Artificial Sequence
  Synthetic
aggugaggaggucaugauccccuu

SEQ ID NO: 8274 - RNA, 18 nt, Artificial Sequence
  Synthetic
cugcuauguguuccuguu

SEQ ID NO: 8275 - RNA, 19 nt, Artificial Sequence
  Synthetic
ccugcuauguguuccuguu

SEQ ID NO: 8276 - RNA, 20 nt, Artificial Sequence
  Synthetic
accugcuauguguuccuguu

SEQ ID NO: 8277 - RNA, 21 nt, Artificial Sequence
  Synthetic
uaccugcuauguguuccuguu

SEQ ID NO: 8278 - RNA, 22 nt, Artificial Sequence
  Synthetic
uuaccugcuauguguuccuguu

SEQ ID NO: 8279 - RNA, 23 nt, Artificial Sequence
  Synthetic
uuuaccugcuauguguuccuguu

SEQ ID NO: 8280 - RNA, 24 nt, Artificial Sequence
  Synthetic
auuuaccugcuauguguuccuguu

SEQ ID NO: 8281 - RNA, 18 nt, Artificial Sequence
  Synthetic
auuuuuaucgagcacaaa

SEQ ID NO: 8282 - RNA, 19 nt, Artificial Sequence
  Synthetic
uauuuuuaucgagcacaaa

SEQ ID NO: 8283 - RNA, 20 nt, Artificial Sequence
  Synthetic
uuauuuuuaucgagcacaaa

SEQ ID NO: 8284 - RNA, 21 nt, Artificial Sequence
  Synthetic
cuuauuuuuaucgagcacaaa

SEQ ID NO: 8285 - RNA, 22 nt, Artificial Sequence
  Synthetic
ucuuauuuuuaucgagcacaaa

SEQ ID NO: 8286 - RNA, 23 nt, Artificial Sequence
  Synthetic
uucuuauuuuuaucgagcacaaa

SEQ ID NO: 8287 - RNA, 24 nt, Artificial Sequence
  Synthetic
auucuuauuuuuaucgagcacaaa

SEQ ID NO: 8288 - RNA, 18 nt, Artificial Sequence
  Synthetic
agaggaauuugccccaaa

SEQ ID NO: 8289 - RNA, 19 nt, Artificial Sequence
  Synthetic
uagaggaauuugccccaaa

SEQ ID NO: 8290 - RNA, 20 nt, Artificial Sequence
  Synthetic
cuagaggaauuugccccaaa

SEQ ID NO: 8291 - RNA, 21 nt, Artificial Sequence
  Synthetic
ucuagaggaauuugccccaaa

SEQ ID NO: 8292 - RNA, 22 nt, Artificial Sequence
  Synthetic
aucuagaggaauuugccccaaa

SEQ ID NO: 8293 - RNA, 23 nt, Artificial Sequence
  Synthetic
caucuagaggaauuugccccaaa

SEQ ID NO: 8294 - RNA, 24 nt, Artificial Sequence
  Synthetic
ucaucuagaggaauuugccccaaa

SEQ ID NO: 8295 - RNA, 18 nt, Artificial Sequence
  Synthetic
ccccagcacuuaagcaaa

SEQ ID NO: 8296 - RNA, 19 nt, Artificial Sequence
  Synthetic
accccagcacuuaagcaaa

SEQ ID NO: 8297 - RNA, 20 nt, Artificial Sequence
  Synthetic
aaccccagcacuuaagcaaa

SEQ ID NO: 8298 - RNA, 21 nt, Artificial Sequence
  Synthetic
aaaccccagcacuuaagcaaa

SEQ ID NO: 8299 - RNA, 22 nt, Artificial Sequence
  Synthetic
caaaccccagcacuuaagcaaa

SEQ ID NO: 8300 - RNA, 23 nt, Artificial Sequence
  Synthetic
gcaaaccccagcacuuaagcaaa

SEQ ID NO: 8301 - RNA, 24 nt, Artificial Sequence
  Synthetic
ggcaaaccccagcacuuaagcaaa

SEQ ID NO: 8302 - RNA, 18 nt, Artificial Sequence
  Synthetic
uauuuuuaucgagcacaa

SEQ ID NO: 8303 - RNA, 19 nt, Artificial Sequence
  Synthetic
uuauuuuuaucgagcacaa

SEQ ID NO: 8304 - RNA, 20 nt, Artificial Sequence
  Synthetic
cuuauuuuuaucgagcacaa

SEQ ID NO: 8305 - RNA, 21 nt, Artificial Sequence
  Synthetic
ucuuauuuuuaucgagcacaa

SEQ ID NO: 8306 - RNA, 22 nt, Artificial Sequence
  Synthetic
uucuuauuuuuaucgagcacaa

SEQ ID NO: 8307 - RNA, 23 nt, Artificial Sequence
  Synthetic
auucuuauuuuuaucgagcacaa

SEQ ID NO: 8308 - RNA, 24 nt, Artificial Sequence
  Synthetic
cauucuuauuuuuaucgagcacaa

SEQ ID NO: 8309 - RNA, 18 nt, Artificial Sequence
  Synthetic
caccuuccccuucaccaa

SEQ ID NO: 8310 - RNA, 19 nt, Artificial Sequence
  Synthetic
ccaccuuccccuucaccaa

SEQ ID NO: 8311 - RNA, 20 nt, Artificial Sequence
  Synthetic
gccaccuuccccuucaccaa

SEQ ID NO: 8312 - RNA, 21 nt, Artificial Sequence
  Synthetic
agccaccuuccccuucaccaa

SEQ ID NO: 8313 - RNA, 22 nt, Artificial Sequence
  Synthetic
aagccaccuuccccuucaccaa

SEQ ID NO: 8314 - RNA, 23 nt, Artificial Sequence
  Synthetic
uaagccaccuuccccuucaccaa

SEQ ID NO: 8315 - RNA, 24 nt, Artificial Sequence
  Synthetic
auaagccaccuuccccuucaccaa

SEQ ID NO: 8316 - RNA, 18 nt, Artificial Sequence
  Synthetic
accccagcacuuaagcaa

SEQ ID NO: 8317 - RNA, 19 nt, Artificial Sequence
  Synthetic
aaccccagcacuuaagcaa

SEQ ID NO: 8318 - RNA, 20 nt, Artificial Sequence
  Synthetic
aaaccccagcacuuaagcaa

SEQ ID NO: 8319 - RNA, 21 nt, Artificial Sequence
  Synthetic
caaaccccagcacuuaagcaa

SEQ ID NO: 8320 - RNA, 22 nt, Artificial Sequence
  Synthetic
gcaaaccccagcacuuaagcaa

SEQ ID NO: 8321 - RNA, 23 nt, Artificial Sequence
  Synthetic
ggcaaaccccagcacuuaagcaa

SEQ ID NO: 8322 - RNA, 24 nt, Artificial Sequence
  Synthetic
aggcaaaccccagcacuuaagcaa

SEQ ID NO: 8323 - RNA, 18 nt, Artificial Sequence
  Synthetic
ggaacacauagcagguaa

SEQ ID NO: 8324 - RNA, 19 nt, Artificial Sequence
  Synthetic
aggaacacauagcagguaa

SEQ ID NO: 8325 - RNA, 20 nt, Artificial Sequence
  Synthetic
caggaacacauagcagguaa

SEQ ID NO: 8326 - RNA, 21 nt, Artificial Sequence
  Synthetic
acaggaacacauagcagguaa

SEQ ID NO: 8327 - RNA, 22 nt, Artificial Sequence
  Synthetic
aacaggaacacauagcagguaa

SEQ ID NO: 8328 - RNA, 23 nt, Artificial Sequence
  Synthetic
aaacaggaacacauagcagguaa

SEQ ID NO: 8329 - RNA, 24 nt, Artificial Sequence
  Synthetic
caaacaggaacacauagcagguaa

SEQ ID NO: 8330 - RNA, 18 nt, Artificial Sequence
  Synthetic
cuccccucguucugcaca

SEQ ID NO: 8331 - RNA, 19 nt, Artificial Sequence
  Synthetic
ccuccccucguucugcaca

SEQ ID NO: 8332 - RNA, 20 nt, Artificial Sequence
  Synthetic
uccuccccucguucugcaca

SEQ ID NO: 8333 - RNA, 21 nt, Artificial Sequence
  Synthetic
cuccuccccucguucugcaca

SEQ ID NO: 8334 - RNA, 22 nt, Artificial Sequence
  Synthetic
ucuccuccccucguucugcaca

SEQ ID NO: 8335 - RNA, 23 nt, Artificial Sequence
  Synthetic
cucuccuccccucguucugcaca

SEQ ID NO: 8336 - RNA, 24 nt, Artificial Sequence
  Synthetic
ccucuccuccccucguucugcaca

SEQ ID NO: 8337 - RNA, 18 nt, Artificial Sequence
  Synthetic
ugccagaugaacuuccca

SEQ ID NO: 8338 - RNA, 19 nt, Artificial Sequence
  Synthetic
gugccagaugaacuuccca

SEQ ID NO: 8339 - RNA, 20 nt, Artificial Sequence
  Synthetic
agugccagaugaacuuccca

SEQ ID NO: 8340 - RNA, 21 nt, Artificial Sequence
  Synthetic
cagugccagaugaacuuccca

SEQ ID NO: 8341 - RNA, 22 nt, Artificial Sequence
  Synthetic
gcagugccagaugaacuuccca

SEQ ID NO: 8342 - RNA, 23 nt, Artificial Sequence
  Synthetic
ggcagugccagaugaacuuccca

SEQ ID NO: 8343 - RNA, 24 nt, Artificial Sequence
  Synthetic
gggcagugccagaugaacuuccca

SEQ ID NO: 8344 - RNA, 18 nt, Artificial Sequence
  Synthetic
gcagguaaaugagaagca

SEQ ID NO: 8345 - RNA, 19 nt, Artificial Sequence
  Synthetic
agcagguaaaugagaagca

SEQ ID NO: 8346 - RNA, 20 nt, Artificial Sequence
  Synthetic
uagcagguaaaugagaagca

SEQ ID NO: 8347 - RNA, 21 nt, Artificial Sequence
  Synthetic
auagcagguaaaugagaagca

SEQ ID NO: 8348 - RNA, 22 nt, Artificial Sequence
  Synthetic
cauagcagguaaaugagaagca

SEQ ID NO: 8349 - RNA, 23 nt, Artificial Sequence
  Synthetic
acauagcagguaaaugagaagca

SEQ ID NO: 8350 - RNA, 24 nt, Artificial Sequence
  Synthetic
cacauagcagguaaaugagaagca

SEQ ID NO: 8351 - RNA, 18 nt, Artificial Sequence
  Synthetic
cacagauaaacuucugca

SEQ ID NO: 8352 - RNA, 19 nt, Artificial Sequence
  Synthetic
ucacagauaaacuucugca

SEQ ID NO: 8353 - RNA, 20 nt, Artificial Sequence
  Synthetic
uucacagauaaacuucugca

SEQ ID NO: 8354 - RNA, 21 nt, Artificial Sequence
  Synthetic
uuucacagauaaacuucugca

SEQ ID NO: 8355 - RNA, 22 nt, Artificial Sequence
  Synthetic
cuuucacagauaaacuucugca

SEQ ID NO: 8356 - RNA, 23 nt, Artificial Sequence
  Synthetic
ucuuucacagauaaacuucugca

SEQ ID NO: 8357 - RNA, 24 nt, Artificial Sequence
  Synthetic
uucuuucacagauaaacuucugca

SEQ ID NO: 8358 - RNA, 18 nt, Artificial Sequence
  Synthetic
cccguugggagcuccaga

SEQ ID NO: 8359 - RNA, 19 nt, Artificial Sequence
  Synthetic
gcccguugggagcuccaga

SEQ ID NO: 8360 - RNA, 20 nt, Artificial Sequence
  Synthetic
ggcccguugggagcuccaga

SEQ ID NO: 8361 - RNA, 21 nt, Artificial Sequence
  Synthetic
cggcccguugggagcuccaga

SEQ ID NO: 8362 - RNA, 22 nt, Artificial Sequence
  Synthetic
acggcccguugggagcuccaga

SEQ ID NO: 8363 - RNA, 23 nt, Artificial Sequence
  Synthetic
cacggcccguugggagcuccaga

SEQ ID NO: 8364 - RNA, 24 nt, Artificial Sequence
  Synthetic
ccacggcccguugggagcuccaga

SEQ ID NO: 8365 - RNA, 18 nt, Artificial Sequence
  Synthetic
guuuaucaacgucaucua

SEQ ID NO: 8366 - RNA, 19 nt, Artificial Sequence
  Synthetic
uguuuaucaacgucaucua

SEQ ID NO: 8367 - RNA, 20 nt, Artificial Sequence
  Synthetic
uuguuuaucaacgucaucua

SEQ ID NO: 8368 - RNA, 21 nt, Artificial Sequence
  Synthetic
auuguuuaucaacgucaucua

SEQ ID NO: 8369 - RNA, 22 nt, Artificial Sequence
  Synthetic
gauuguuuaucaacgucaucua

SEQ ID NO: 8370 - RNA, 23 nt, Artificial Sequence
  Synthetic
cgauuguuuaucaacgucaucua

SEQ ID NO: 8371 - RNA, 24 nt, Artificial Sequence
  Synthetic
acgauuguuuaucaacgucaucua

SEQ ID NO: 8372 - RNA, 18 nt, Artificial Sequence
  Synthetic
gggacauucuuauuuuua

SEQ ID NO: 8373 - RNA, 19 nt, Artificial Sequence
  Synthetic
ggggacauucuuauuuuua

SEQ ID NO: 8374 - RNA, 20 nt, Artificial Sequence
  Synthetic
gggggacauucuuauuuuua

SEQ ID NO: 8375 - RNA, 21 nt, Artificial Sequence
  Synthetic
ugggggacauucuuauuuuua

SEQ ID NO: 8376 - RNA, 22 nt, Artificial Sequence
  Synthetic
uugggggacauucuuauuuuua

SEQ ID NO: 8377 - RNA, 23 nt, Artificial Sequence
  Synthetic
auugggggacauucuuauuuuua

SEQ ID NO: 8378 - RNA, 24 nt, Artificial Sequence
  Synthetic
cauugggggacauucuuauuuuua

SEQ ID NO: 8379 - RNA, 18 nt, Artificial Sequence
  Synthetic
gaggaauuugccccaaac

SEQ ID NO: 8380 - RNA, 19 nt, Artificial Sequence
  Synthetic
agaggaauuugccccaaac

SEQ ID NO: 8381 - RNA, 20 nt, Artificial Sequence
  Synthetic
uagaggaauuugccccaaac

SEQ ID NO: 8382 - RNA, 21 nt, Artificial Sequence
  Synthetic
cuagaggaauuugccccaaac

SEQ ID NO: 8383 - RNA, 22 nt, Artificial Sequence
  Synthetic
ucuagaggaauuugccccaaac

SEQ ID NO: 8384 - RNA, 23 nt, Artificial Sequence
  Synthetic
aucuagaggaauuugccccaaac

SEQ ID NO: 8385 - RNA, 24 nt, Artificial Sequence
  Synthetic
caucuagaggaauuugccccaaac

SEQ ID NO: 8386 - RNA, 18 nt, Artificial Sequence
  Synthetic
acagauaaacuucugcac

SEQ ID NO: 8387 - RNA, 19 nt, Artificial Sequence
  Synthetic
cacagauaaacuucugcac

SEQ ID NO: 8388 - RNA, 20 nt, Artificial Sequence
  Synthetic
ucacagauaaacuucugcac

SEQ ID NO: 8389 - RNA, 21 nt, Artificial Sequence
  Synthetic
uucacagauaaacuucugcac

SEQ ID NO: 8390 - RNA, 22 nt, Artificial Sequence
  Synthetic
uuucacagauaaacuucugcac

SEQ ID NO: 8391 - RNA, 23 nt, Artificial Sequence
  Synthetic
cuuucacagauaaacuucugcac

SEQ ID NO: 8392 - RNA, 24 nt, Artificial Sequence
  Synthetic
ucuuucacagauaaacuucugcac

SEQ ID NO: 8393 - RNA, 18 nt, Artificial Sequence
  Synthetic
ccuccccucguucugcac

SEQ ID NO: 8394 - RNA, 19 nt, Artificial Sequence
  Synthetic
uccuccccucguucugcac

SEQ ID NO: 8395 - RNA, 20 nt, Artificial Sequence
  Synthetic
cuccuccccucguucugcac

SEQ ID NO: 8396 - RNA, 21 nt, Artificial Sequence
  Synthetic
ucuccuccccucguucugcac

SEQ ID NO: 8397 - RNA, 22 nt, Artificial Sequence
  Synthetic
cucuccuccccucguucugcac

SEQ ID NO: 8398 - RNA, 23 nt, Artificial Sequence
  Synthetic
ccucuccuccccucguucugcac

SEQ ID NO: 8399 - RNA, 24 nt, Artificial Sequence
  Synthetic
gccucuccuccccucguucugcac

SEQ ID NO: 8400 - RNA, 18 nt, Artificial Sequence
  Synthetic
aaaaaagcauccaauccc

SEQ ID NO: 8401 - RNA, 19 nt, Artificial Sequence
  Synthetic
gaaaaaagcauccaauccc

SEQ ID NO: 8402 - RNA, 20 nt, Artificial Sequence
  Synthetic
ugaaaaaagcauccaauccc

SEQ ID NO: 8403 - RNA, 21 nt, Artificial Sequence
  Synthetic
augaaaaaagcauccaauccc

SEQ ID NO: 8404 - RNA, 22 nt, Artificial Sequence
  Synthetic
gaugaaaaaagcauccaauccc

SEQ ID NO: 8405 - RNA, 23 nt, Artificial Sequence
  Synthetic
agaugaaaaaagcauccaauccc

SEQ ID NO: 8406 - RNA, 24 nt, Artificial Sequence
  Synthetic
gagaugaaaaaagcauccaauccc

SEQ ID NO: 8407 - RNA, 18 nt, Artificial Sequence
  Synthetic
agcagguaaaugagaagc

SEQ ID NO: 8408 - RNA, 19 nt, Artificial Sequence
  Synthetic
uagcagguaaaugagaagc

SEQ ID NO: 8409 - RNA, 20 nt, Artificial Sequence
  Synthetic
auagcagguaaaugagaagc

SEQ ID NO: 8410 - RNA, 21 nt, Artificial Sequence
  Synthetic
cauagcagguaaaugagaagc

SEQ ID NO: 8411 - RNA, 22 nt, Artificial Sequence
  Synthetic
acauagcagguaaaugagaagc

SEQ ID NO: 8412 - RNA, 23 nt, Artificial Sequence
  Synthetic
cacauagcagguaaaugagaagc

SEQ ID NO: 8413 - RNA, 24 nt, Artificial Sequence
  Synthetic
acacauagcagguaaaugagaagc

SEQ ID NO: 8414 - RNA, 18 nt, Artificial Sequence
  Synthetic
gagcucuaauccccacgc

SEQ ID NO: 8415 - RNA, 19 nt, Artificial Sequence
  Synthetic
ggagcucuaauccccacgc

SEQ ID NO: 8416 - RNA, 20 nt, Artificial Sequence
  Synthetic
uggagcucuaauccccacgc

SEQ ID NO: 8417 - RNA, 21 nt, Artificial Sequence
  Synthetic
auggagcucuaauccccacgc

SEQ ID NO: 8418 - RNA, 22 nt, Artificial Sequence
  Synthetic
cauggagcucuaauccccacgc

SEQ ID NO: 8419 - RNA, 23 nt, Artificial Sequence
  Synthetic
acauggagcucuaauccccacgc

SEQ ID NO: 8420 - RNA, 24 nt, Artificial Sequence
  Synthetic
cacauggagcucuaauccccacgc

SEQ ID NO: 8421 - RNA, 18 nt, Artificial Sequence
  Synthetic
uuggcauccaggucacgc

SEQ ID NO: 8422 - RNA, 19 nt, Artificial Sequence
  Synthetic
guuggcauccaggucacgc

SEQ ID NO: 8423 - RNA, 20 nt, Artificial Sequence
  Synthetic
gguuggcauccaggucacgc

SEQ ID NO: 8424 - RNA, 21 nt, Artificial Sequence
  Synthetic
agguuggcauccaggucacgc

SEQ ID NO: 8425 - RNA, 22 nt, Artificial Sequence
  Synthetic
gagguuggcauccaggucacgc

SEQ ID NO: 8426 - RNA, 23 nt, Artificial Sequence
  Synthetic
ggagguuggcauccaggucacgc

SEQ ID NO: 8427 - RNA, 24 nt, Artificial Sequence
  Synthetic
uggagguuggcauccaggucacgc

SEQ ID NO: 8428 - RNA, 18 nt, Artificial Sequence
  Synthetic
uuguuuaucaacgucauc

SEQ ID NO: 8429 - RNA, 19 nt, Artificial Sequence
  Synthetic
auuguuuaucaacgucauc

SEQ ID NO: 8430 - RNA, 20 nt, Artificial Sequence
  Synthetic
gauuguuuaucaacgucauc

SEQ ID NO: 8431 - RNA, 21 nt, Artificial Sequence
  Synthetic
cgauuguuuaucaacgucauc

SEQ ID NO: 8432 - RNA, 22 nt, Artificial Sequence
  Synthetic
acgauuguuuaucaacgucauc

SEQ ID NO: 8433 - RNA, 23 nt, Artificial Sequence
  Synthetic
gacgauuguuuaucaacgucauc

SEQ ID NO: 8434 - RNA, 24 nt, Artificial Sequence
  Synthetic
ugacgauuguuuaucaacgucauc

SEQ ID NO: 8435 - RNA, 18 nt, Artificial Sequence
  Synthetic
caaccacagccgagccuc

SEQ ID NO: 8436 - RNA, 19 nt, Artificial Sequence
  Synthetic
ccaaccacagccgagccuc

SEQ ID NO: 8437 - RNA, 20 nt, Artificial Sequence
  Synthetic
uccaaccacagccgagccuc

SEQ ID NO: 8438 - RNA, 21 nt, Artificial Sequence
  Synthetic
cuccaaccacagccgagccuc

SEQ ID NO: 8439 - RNA, 22 nt, Artificial Sequence
  Synthetic
ucuccaaccacagccgagccuc

SEQ ID NO: 8440 - RNA, 23 nt, Artificial Sequence
  Synthetic
uucuccaaccacagccgagccuc

SEQ ID NO: 8441 - RNA, 24 nt, Artificial Sequence
  Synthetic
uuucuccaaccacagccgagccuc

SEQ ID NO: 8442 - RNA, 18 nt, Artificial Sequence
  Synthetic
acggcccguugggagcuc

SEQ ID NO: 8443 - RNA, 19 nt, Artificial Sequence
  Synthetic
cacggcccguugggagcuc

SEQ ID NO: 8444 - RNA, 20 nt, Artificial Sequence
  Synthetic
ccacggcccguugggagcuc

SEQ ID NO: 8445 - RNA, 21 nt, Artificial Sequence
  Synthetic
accacggcccguugggagcuc

SEQ ID NO: 8446 - RNA, 22 nt, Artificial Sequence
  Synthetic
gaccacggcccguugggagcuc

SEQ ID NO: 8447 - RNA, 23 nt, Artificial Sequence
  Synthetic
agaccacggcccguugggagcuc

SEQ ID NO: 8448 - RNA, 24 nt, Artificial Sequence
  Synthetic
cagaccacggcccguugggagcuc

SEQ ID NO: 8449 - RNA, 18 nt, Artificial Sequence
  Synthetic
auuauuuugcagguaaag

SEQ ID NO: 8450 - RNA, 19 nt, Artificial Sequence
  Synthetic
uauuauuuugcagguaaag

SEQ ID NO: 8451 - RNA, 20 nt, Artificial Sequence
  Synthetic
guauuauuuugcagguaaag

SEQ ID NO: 8452 - RNA, 21 nt, Artificial Sequence
  Synthetic
uguauuauuuugcagguaaag

SEQ ID NO: 8453 - RNA, 22 nt, Artificial Sequence
  Synthetic
uuguauuauuuugcagguaaag

SEQ ID NO: 8454 - RNA, 23 nt, Artificial Sequence
  Synthetic
guuguauuauuuugcagguaaag

SEQ ID NO: 8455 - RNA, 24 nt, Artificial Sequence
  Synthetic
uguuguauuauuuugcagguaaag

SEQ ID NO: 8456 - RNA, 18 nt, Artificial Sequence
  Synthetic
agguaaaugagaagcaag

SEQ ID NO: 8457 - RNA, 19 nt, Artificial Sequence
  Synthetic
cagguaaaugagaagcaag

SEQ ID NO: 8458 - RNA, 20 nt, Artificial Sequence
  Synthetic
gcagguaaaugagaagcaag

SEQ ID NO: 8459 - RNA, 21 nt, Artificial Sequence
  Synthetic
agcagguaaaugagaagcaag

SEQ ID NO: 8460 - RNA, 22 nt, Artificial Sequence
  Synthetic
uagcagguaaaugagaagcaag

SEQ ID NO: 8461 - RNA, 23 nt, Artificial Sequence
  Synthetic
auagcagguaaaugagaagcaag

SEQ ID NO: 8462 - RNA, 24 nt, Artificial Sequence
  Synthetic
cauagcagguaaaugagaagcaag

SEQ ID NO: 8463 - RNA, 18 nt, Artificial Sequence
  Synthetic
ccgcaggguauuuguaag

SEQ ID NO: 8464 - RNA, 19 nt, Artificial Sequence
  Synthetic
cccgcaggguauuuguaag

SEQ ID NO: 8465 - RNA, 20 nt, Artificial Sequence
  Synthetic
ccccgcaggguauuuguaag

SEQ ID NO: 8466 - RNA, 21 nt, Artificial Sequence
  Synthetic
gccccgcaggguauuuguaag

SEQ ID NO: 8467 - RNA, 22 nt, Artificial Sequence
  Synthetic
ugccccgcaggguauuuguaag

SEQ ID NO: 8468 - RNA, 23 nt, Artificial Sequence
  Synthetic
augccccgcaggguauuuguaag

SEQ ID NO: 8469 - RNA, 24 nt, Artificial Sequence
  Synthetic
uaugccccgcaggguauuuguaag

SEQ ID NO: 8470 - RNA, 18 nt, Artificial Sequence
  Synthetic
uuguuucuccaaccacag

SEQ ID NO: 8471 - RNA, 19 nt, Artificial Sequence
  Synthetic
uuuguuucuccaaccacag

SEQ ID NO: 8472 - RNA, 20 nt, Artificial Sequence
  Synthetic
uuuuguuucuccaaccacag

SEQ ID NO: 8473 - RNA, 21 nt, Artificial Sequence
  Synthetic
cuuuuguuucuccaaccacag

SEQ ID NO: 8474 - RNA, 22 nt, Artificial Sequence
  Synthetic
gcuuuuguuucuccaaccacag

SEQ ID NO: 8475 - RNA, 23 nt, Artificial Sequence
  Synthetic
ugcuuuuguuucuccaaccacag

SEQ ID NO: 8476 - RNA, 24 nt, Artificial Sequence
  Synthetic
gugcuuuuguuucuccaaccacag

SEQ ID NO: 8477 - RNA, 18 nt, Artificial Sequence
  Synthetic
accugugggcagugccag

SEQ ID NO: 8478 - RNA, 19 nt, Artificial Sequence
  Synthetic
caccugugggcagugccag

SEQ ID NO: 8479 - RNA, 20 nt, Artificial Sequence
  Synthetic
ucaccugugggcagugccag

SEQ ID NO: 8480 - RNA, 21 nt, Artificial Sequence
  Synthetic
cucaccugugggcagugccag

SEQ ID NO: 8481 - RNA, 22 nt, Artificial Sequence
  Synthetic
ccucaccugugggcagugccag

SEQ ID NO: 8482 - RNA, 23 nt, Artificial Sequence
  Synthetic
uccucaccugugggcagugccag

SEQ ID NO: 8483 - RNA, 24 nt, Artificial Sequence
  Synthetic
cuccucaccugugggcagugccag

SEQ ID NO: 8484 - RNA, 18 nt, Artificial Sequence
  Synthetic
gcccguugggagcuccag

SEQ ID NO: 8485 - RNA, 19 nt, Artificial Sequence
  Synthetic
ggcccguugggagcuccag

SEQ ID NO: 8486 - RNA, 20 nt, Artificial Sequence
  Synthetic
cggcccguugggagcuccag

SEQ ID NO: 8487 - RNA, 21 nt, Artificial Sequence
  Synthetic
acggcccguugggagcuccag

SEQ ID NO: 8488 - RNA, 22 nt, Artificial Sequence
  Synthetic
cacggcccguugggagcuccag

SEQ ID NO: 8489 - RNA, 23 nt, Artificial Sequence
  Synthetic
ccacggcccguugggagcuccag

SEQ ID NO: 8490 - RNA, 24 nt, Artificial Sequence
  Synthetic
accacggcccguugggagcuccag

SEQ ID NO: 8491 - RNA, 18 nt, Artificial Sequence
  Synthetic
uccccuucaccaaucgag

SEQ ID NO: 8492 - RNA, 19 nt, Artificial Sequence
  Synthetic
uuccccuucaccaaucgag

SEQ ID NO: 8493 - RNA, 20 nt, Artificial Sequence
  Synthetic
cuuccccuucaccaaucgag

SEQ ID NO: 8494 - RNA, 21 nt, Artificial Sequence
  Synthetic
ccuuccccuucaccaaucgag

SEQ ID NO: 8495 - RNA, 22 nt, Artificial Sequence
  Synthetic
accuuccccuucaccaaucgag

SEQ ID NO: 8496 - RNA, 23 nt, Artificial Sequence
  Synthetic
caccuuccccuucaccaaucgag

SEQ ID NO: 8497 - RNA, 24 nt, Artificial Sequence
  Synthetic
ccaccuuccccuucaccaaucgag

SEQ ID NO: 8498 - RNA, 18 nt, Artificial Sequence
  Synthetic
gaaccagaccacggcccg

SEQ ID NO: 8499 - RNA, 19 nt, Artificial Sequence
  Synthetic
ugaaccagaccacggcccg

SEQ ID NO: 8500 - RNA, 20 nt, Artificial Sequence
  Synthetic
augaaccagaccacggcccg

SEQ ID NO: 8501 - RNA, 21 nt, Artificial Sequence
  Synthetic
gaugaaccagaccacggcccg

SEQ ID NO: 8502 - RNA, 22 nt, Artificial Sequence
  Synthetic
ugaugaaccagaccacggcccg

SEQ ID NO: 8503 - RNA, 23 nt, Artificial Sequence
  Synthetic
augaugaaccagaccacggcccg

SEQ ID NO: 8504 - RNA, 24 nt, Artificial Sequence
  Synthetic
gaugaugaaccagaccacggcccg

SEQ ID NO: 8505 - RNA, 18 nt, Artificial Sequence
  Synthetic
aaaaagcauccaaucccg

SEQ ID NO: 8506 - RNA, 19 nt, Artificial Sequence
  Synthetic
aaaaaagcauccaaucccg

SEQ ID NO: 8507 - RNA, 20 nt, Artificial Sequence
  Synthetic
gaaaaaagcauccaaucccg

SEQ ID NO: 8508 - RNA, 21 nt, Artificial Sequence
  Synthetic
ugaaaaaagcauccaaucccg

SEQ ID NO: 8509 - RNA, 22 nt, Artificial Sequence
  Synthetic
augaaaaaagcauccaaucccg

SEQ ID NO: 8510 - RNA, 23 nt, Artificial Sequence
  Synthetic
gaugaaaaaagcauccaaucccg

SEQ ID NO: 8511 - RNA, 24 nt, Artificial Sequence
  Synthetic
agaugaaaaaagcauccaaucccg

SEQ ID NO: 8512 - RNA, 18 nt, Artificial Sequence
  Synthetic
gauaaacuucugcacugg

SEQ ID NO: 8513 - RNA, 19 nt, Artificial Sequence
  Synthetic
agauaaacuucugcacugg

SEQ ID NO: 8514 - RNA, 20 nt, Artificial Sequence
  Synthetic
cagauaaacuucugcacugg

SEQ ID NO: 8515 - RNA, 21 nt, Artificial Sequence
  Synthetic
acagauaaacuucugcacugg

SEQ ID NO: 8516 - RNA, 22 nt, Artificial Sequence
  Synthetic
cacagauaaacuucugcacugg

SEQ ID NO: 8517 - RNA, 23 nt, Artificial Sequence
  Synthetic
ucacagauaaacuucugcacugg

SEQ ID NO: 8518 - RNA, 24 nt, Artificial Sequence
  Synthetic
uucacagauaaacuucugcacugg

SEQ ID NO: 8519 - RNA, 18 nt, Artificial Sequence
  Synthetic
aagccauucuuacagaug

SEQ ID NO: 8520 - RNA, 19 nt, Artificial Sequence
  Synthetic
gaagccauucuuacagaug

SEQ ID NO: 8521 - RNA, 20 nt, Artificial Sequence
  Synthetic
ugaagccauucuuacagaug

SEQ ID NO: 8522 - RNA, 21 nt, Artificial Sequence
  Synthetic
uugaagccauucuuacagaug

SEQ ID NO: 8523 - RNA, 22 nt, Artificial Sequence
  Synthetic
cuugaagccauucuuacagaug

SEQ ID NO: 8524 - RNA, 23 nt, Artificial Sequence
  Synthetic
ucuugaagccauucuuacagaug

SEQ ID NO: 8525 - RNA, 24 nt, Artificial Sequence
  Synthetic
cucuugaagccauucuuacagaug

SEQ ID NO: 8526 - RNA, 18 nt, Artificial Sequence
  Synthetic
agauaaacuucugcacug

SEQ ID NO: 8527 - RNA, 19 nt, Artificial Sequence
  Synthetic
cagauaaacuucugcacug

SEQ ID NO: 8528 - RNA, 20 nt, Artificial Sequence
  Synthetic
acagauaaacuucugcacug

SEQ ID NO: 8529 - RNA, 21 nt, Artificial Sequence
  Synthetic
cacagauaaacuucugcacug

SEQ ID NO: 8530 - RNA, 22 nt, Artificial Sequence
  Synthetic
ucacagauaaacuucugcacug

SEQ ID NO: 8531 - RNA, 23 nt, Artificial Sequence
  Synthetic
uucacagauaaacuucugcacug

SEQ ID NO: 8532 - RNA, 24 nt, Artificial Sequence
  Synthetic
uuucacagauaaacuucugcacug

SEQ ID NO: 8533 - RNA, 18 nt, Artificial Sequence
  Synthetic
cagaugaacuucccauug

SEQ ID NO: 8534 - RNA, 19 nt, Artificial Sequence
  Synthetic
ccagaugaacuucccauug

SEQ ID NO: 8535 - RNA, 20 nt, Artificial Sequence
  Synthetic
gccagaugaacuucccauug

SEQ ID NO: 8536 - RNA, 21 nt, Artificial Sequence
  Synthetic
ugccagaugaacuucccauug

SEQ ID NO: 8537 - RNA, 22 nt, Artificial Sequence
  Synthetic
gugccagaugaacuucccauug

SEQ ID NO: 8538 - RNA, 23 nt, Artificial Sequence
  Synthetic
agugccagaugaacuucccauug

SEQ ID NO: 8539 - RNA, 24 nt, Artificial Sequence
  Synthetic
cagugccagaugaacuucccauug

SEQ ID NO: 8540 - RNA, 18 nt, Artificial Sequence
  Synthetic
aacacauagcagguaaau

SEQ ID NO: 8541 - RNA, 19 nt, Artificial Sequence
  Synthetic
gaacacauagcagguaaau

SEQ ID NO: 8542 - RNA, 20 nt, Artificial Sequence
  Synthetic
ggaacacauagcagguaaau

SEQ ID NO: 8543 - RNA, 21 nt, Artificial Sequence
  Synthetic
aggaacacauagcagguaaau

SEQ ID NO: 8544 - RNA, 22 nt, Artificial Sequence
  Synthetic
caggaacacauagcagguaaau

SEQ ID NO: 8545 - RNA, 23 nt, Artificial Sequence
  Synthetic
acaggaacacauagcagguaaau

SEQ ID NO: 8546 - RNA, 24 nt, Artificial Sequence
  Synthetic
aacaggaacacauagcagguaaau

SEQ ID NO: 8547 - RNA, 18 nt, Artificial Sequence
  Synthetic
gccagaugaacuucccau

SEQ ID NO: 8548 - RNA, 19 nt, Artificial Sequence
  Synthetic
ugccagaugaacuucccau

SEQ ID NO: 8549 - RNA, 20 nt, Artificial Sequence
  Synthetic
gugccagaugaacuucccau

SEQ ID NO: 8550 - RNA, 21 nt, Artificial Sequence
  Synthetic
agugccagaugaacuucccau

SEQ ID NO: 8551 - RNA, 22 nt, Artificial Sequence
  Synthetic
cagugccagaugaacuucccau

SEQ ID NO: 8552 - RNA, 23 nt, Artificial Sequence
  Synthetic
gcagugccagaugaacuucccau

SEQ ID NO: 8553 - RNA, 24 nt, Artificial Sequence
  Synthetic
ggcagugccagaugaacuucccau

SEQ ID NO: 8554 - RNA, 18 nt, Artificial Sequence
  Synthetic
aucaugaccuccucaccu

SEQ ID NO: 8555 - RNA, 19 nt, Artificial Sequence
  Synthetic
gaucaugaccuccucaccu

SEQ ID NO: 8556 - RNA, 20 nt, Artificial Sequence
  Synthetic
ggaucaugaccuccucaccu

SEQ ID NO: 8557 - RNA, 21 nt, Artificial Sequence
  Synthetic
gggaucaugaccuccucaccu

SEQ ID NO: 8558 - RNA, 22 nt, Artificial Sequence
  Synthetic
ggggaucaugaccuccucaccu

SEQ ID NO: 8559 - RNA, 23 nt, Artificial Sequence
  Synthetic
aggggaucaugaccuccucaccu

SEQ ID NO: 8560 - RNA, 24 nt, Artificial Sequence
  Synthetic
aaggggaucaugaccuccucaccu

SEQ ID NO: 8561 - RNA, 18 nt, Artificial Sequence
  Synthetic
gcaauggcagccucugcu

SEQ ID NO: 8562 - RNA, 19 nt, Artificial Sequence
  Synthetic
ugcaauggcagccucugcu

SEQ ID NO: 8563 - RNA, 20 nt, Artificial Sequence
  Synthetic
augcaauggcagccucugcu

SEQ ID NO: 8564 - RNA, 21 nt, Artificial Sequence
  Synthetic
aaugcaauggcagccucugcu

SEQ ID NO: 8565 - RNA, 22 nt, Artificial Sequence
  Synthetic
caaugcaauggcagccucugcu

SEQ ID NO: 8566 - RNA, 23 nt, Artificial Sequence
  Synthetic
acaaugcaauggcagccucugcu

SEQ ID NO: 8567 - RNA, 24 nt, Artificial Sequence
  Synthetic
aacaaugcaauggcagccucugcu

SEQ ID NO: 8568 - RNA, 18 nt, Artificial Sequence
  Synthetic
aaccagaccacggcccgu

SEQ ID NO: 8569 - RNA, 19 nt, Artificial Sequence
  Synthetic
gaaccagaccacggcccgu

SEQ ID NO: 8570 - RNA, 20 nt, Artificial Sequence
  Synthetic
ugaaccagaccacggcccgu

SEQ ID NO: 8571 - RNA, 21 nt, Artificial Sequence
  Synthetic
augaaccagaccacggcccgu

SEQ ID NO: 8572 - RNA, 22 nt, Artificial Sequence
  Synthetic
gaugaaccagaccacggcccgu

SEQ ID NO: 8573 - RNA, 23 nt, Artificial Sequence
  Synthetic
ugaugaaccagaccacggcccgu

SEQ ID NO: 8574 - RNA, 24 nt, Artificial Sequence
  Synthetic
augaugaaccagaccacggcccgu

SEQ ID NO: 8575 - RNA, 18 nt, Artificial Sequence
  Synthetic
ccagaugaacuucccauu

SEQ ID NO: 8576 - RNA, 19 nt, Artificial Sequence
  Synthetic
gccagaugaacuucccauu

SEQ ID NO: 8577 - RNA, 20 nt, Artificial Sequence
  Synthetic
ugccagaugaacuucccauu

SEQ ID NO: 8578 - RNA, 21 nt, Artificial Sequence
  Synthetic
gugccagaugaacuucccauu

SEQ ID NO: 8579 - RNA, 22 nt, Artificial Sequence
  Synthetic
agugccagaugaacuucccauu

SEQ ID NO: 8580 - RNA, 23 nt, Artificial Sequence
  Synthetic
cagugccagaugaacuucccauu

SEQ ID NO: 8581 - RNA, 24 nt, Artificial Sequence
  Synthetic
gcagugccagaugaacuucccauu

SEQ ID NO: 8582 - RNA, 18 nt, Artificial Sequence
  Synthetic
accagaccacggcccguu

SEQ ID NO: 8583 - RNA, 19 nt, Artificial Sequence
  Synthetic
aaccagaccacggcccguu

SEQ ID NO: 8584 - RNA, 20 nt, Artificial Sequence
  Synthetic
gaaccagaccacggcccguu

SEQ ID NO: 8585 - RNA, 21 nt, Artificial Sequence
  Synthetic
ugaaccagaccacggcccguu

SEQ ID NO: 8586 - RNA, 22 nt, Artificial Sequence
  Synthetic
augaaccagaccacggcccguu

SEQ ID NO: 8587 - RNA, 23 nt, Artificial Sequence
  Synthetic
gaugaaccagaccacggcccguu

SEQ ID NO: 8588 - RNA, 24 nt, Artificial Sequence
  Synthetic
ugaugaaccagaccacggcccguu

SEQ ID NO: 8589 - RNA, 18 nt, Artificial Sequence
  Synthetic
guauucuuagcagguuaa

SEQ ID NO: 8590 - RNA, 19 nt, Artificial Sequence
  Synthetic
gguauucuuagcagguuaa

SEQ ID NO: 8591 - RNA, 20 nt, Artificial Sequence
  Synthetic
ugguauucuuagcagguuaa

SEQ ID NO: 8592 - RNA, 21 nt, Artificial Sequence
  Synthetic
cugguauucuuagcagguuaa

SEQ ID NO: 8593 - RNA, 22 nt, Artificial Sequence
  Synthetic
ccugguauucuuagcagguuaa

SEQ ID NO: 8594 - RNA, 23 nt, Artificial Sequence
  Synthetic
uccugguauucuuagcagguuaa

SEQ ID NO: 8595 - RNA, 24 nt, Artificial Sequence
  Synthetic
auccugguauucuuagcagguuaa

SEQ ID NO: 8596 - RNA, 18 nt, Artificial Sequence
  Synthetic
cgggaggcuccauagcca

SEQ ID NO: 8597 - RNA, 19 nt, Artificial Sequence
  Synthetic
gcgggaggcuccauagcca

SEQ ID NO: 8598 - RNA, 20 nt, Artificial Sequence
  Synthetic
ggcgggaggcuccauagcca

SEQ ID NO: 8599 - RNA, 21 nt, Artificial Sequence
  Synthetic
uggcgggaggcuccauagcca

SEQ ID NO: 8600 - RNA, 22 nt, Artificial Sequence
  Synthetic
auggcgggaggcuccauagcca

SEQ ID NO: 8601 - RNA, 23 nt, Artificial Sequence
  Synthetic
cauggcgggaggcuccauagcca

SEQ ID NO: 8602 - RNA, 24 nt, Artificial Sequence
  Synthetic
ccauggcgggaggcuccauagcca

SEQ ID NO: 8603 - RNA, 18 nt, Artificial Sequence
  Synthetic
gguccgacucgccggcca

SEQ ID NO: 8604 - RNA, 19 nt, Artificial Sequence
  Synthetic
cgguccgacucgccggcca

SEQ ID NO: 8605 - RNA, 20 nt, Artificial Sequence
  Synthetic
gcgguccgacucgccggcca

SEQ ID NO: 8606 - RNA, 21 nt, Artificial Sequence
  Synthetic
ugcgguccgacucgccggcca

SEQ ID NO: 8607 - RNA, 22 nt, Artificial Sequence
  Synthetic
augcgguccgacucgccggcca

SEQ ID NO: 8608 - RNA, 23 nt, Artificial Sequence
  Synthetic
uaugcgguccgacucgccggcca

SEQ ID NO: 8609 - RNA, 24 nt, Artificial Sequence
  Synthetic
cuaugcgguccgacucgccggcca

SEQ ID NO: 8610 - RNA, 18 nt, Artificial Sequence
  Synthetic
agucuccgaagcuaagga

SEQ ID NO: 8611 - RNA, 19 nt, Artificial Sequence
  Synthetic
gagucuccgaagcuaagga

SEQ ID NO: 8612 - RNA, 20 nt, Artificial Sequence
  Synthetic
ggagucuccgaagcuaagga

SEQ ID NO: 8613 - RNA, 21 nt, Artificial Sequence
  Synthetic
uggagucuccgaagcuaagga

SEQ ID NO: 8614 - RNA, 22 nt, Artificial Sequence
  Synthetic
cuggagucuccgaagcuaagga

SEQ ID NO: 8615 - RNA, 23 nt, Artificial Sequence
  Synthetic
ucuggagucuccgaagcuaagga

SEQ ID NO: 8616 - RNA, 24 nt, Artificial Sequence
  Synthetic
gucuggagucuccgaagcuaagga

SEQ ID NO: 8617 - RNA, 18 nt, Artificial Sequence
  Synthetic
ggacuaaacaggggggga

SEQ ID NO: 8618 - RNA, 19 nt, Artificial Sequence
  Synthetic
uggacuaaacaggggggga

SEQ ID NO: 8619 - RNA, 20 nt, Artificial Sequence
  Synthetic
guggacuaaacaggggggga

SEQ ID NO: 8620 - RNA, 21 nt, Artificial Sequence
  Synthetic
gguggacuaaacaggggggga

SEQ ID NO: 8621 - RNA, 22 nt, Artificial Sequence
  Synthetic
ugguggacuaaacaggggggga

SEQ ID NO: 8622 - RNA, 23 nt, Artificial Sequence
  Synthetic
gugguggacuaaacaggggggga

SEQ ID NO: 8623 - RNA, 24 nt, Artificial Sequence
  Synthetic
ggugguggacuaaacaggggggga

SEQ ID NO: 8624 - RNA, 18 nt, Artificial Sequence
  Synthetic
uucugcaccuaguccuga

SEQ ID NO: 8625 - RNA, 19 nt, Artificial Sequence
  Synthetic
auucugcaccuaguccuga

SEQ ID NO: 8626 - RNA, 20 nt, Artificial Sequence
  Synthetic
cauucugcaccuaguccuga

SEQ ID NO: 8627 - RNA, 21 nt, Artificial Sequence
  Synthetic
acauucugcaccuaguccuga

SEQ ID NO: 8628 - RNA, 22 nt, Artificial Sequence
  Synthetic
gacauucugcaccuaguccuga

SEQ ID NO: 8629 - RNA, 23 nt, Artificial Sequence
  Synthetic
ggacauucugcaccuaguccuga

SEQ ID NO: 8630 - RNA, 24 nt, Artificial Sequence
  Synthetic
aggacauucugcaccuaguccuga

SEQ ID NO: 8631 - RNA, 18 nt, Artificial Sequence
  Synthetic
gcacccugucaaaggcac

SEQ ID NO: 8632 - RNA, 19 nt, Artificial Sequence
  Synthetic
agcacccugucaaaggcac

SEQ ID NO: 8633 - RNA, 20 nt, Artificial Sequence
  Synthetic
cagcacccugucaaaggcac

SEQ ID NO: 8634 - RNA, 21 nt, Artificial Sequence
  Synthetic
gcagcacccugucaaaggcac

SEQ ID NO: 8635 - RNA, 22 nt, Artificial Sequence
  Synthetic
cgcagcacccugucaaaggcac

SEQ ID NO: 8636 - RNA, 23 nt, Artificial Sequence
  Synthetic
ccgcagcacccugucaaaggcac

SEQ ID NO: 8637 - RNA, 24 nt, Artificial Sequence
  Synthetic
accgcagcacccugucaaaggcac

SEQ ID NO: 8638 - RNA, 18 nt, Artificial Sequence
  Synthetic
uaaguagauucuuaaucc

SEQ ID NO: 8639 - RNA, 19 nt, Artificial Sequence
  Synthetic
cuaaguagauucuuaaucc

SEQ ID NO: 8640 - RNA, 20 nt, Artificial Sequence
  Synthetic
ucuaaguagauucuuaaucc

SEQ ID NO: 8641 - RNA, 21 nt, Artificial Sequence
  Synthetic
uucuaaguagauucuuaaucc

SEQ ID NO: 8642 - RNA, 22 nt, Artificial Sequence
  Synthetic
uuucuaaguagauucuuaaucc

SEQ ID NO: 8643 - RNA, 23 nt, Artificial Sequence
  Synthetic
cuuucuaaguagauucuuaaucc

SEQ ID NO: 8644 - RNA, 24 nt, Artificial Sequence
  Synthetic
gcuuucuaaguagauucuuaaucc

SEQ ID NO: 8645 - RNA, 18 nt, Artificial Sequence
  Synthetic
ggcggcuugcuaccuggc

SEQ ID NO: 8646 - RNA, 19 nt, Artificial Sequence
  Synthetic
gggcggcuugcuaccuggc

SEQ ID NO: 8647 - RNA, 20 nt, Artificial Sequence
  Synthetic
agggcggcuugcuaccuggc

SEQ ID NO: 8648 - RNA, 21 nt, Artificial Sequence
  Synthetic
aagggcggcuugcuaccuggc

SEQ ID NO: 8649 - RNA, 22 nt, Artificial Sequence
  Synthetic
gaagggcggcuugcuaccuggc

SEQ ID NO: 8650 - RNA, 23 nt, Artificial Sequence
  Synthetic
ggaagggcggcuugcuaccuggc

SEQ ID NO: 8651 - RNA, 24 nt, Artificial Sequence
  Synthetic
aggaagggcggcuugcuaccuggc

SEQ ID NO: 8652 - RNA, 18 nt, Artificial Sequence
  Synthetic
gcgcuucagcuugcuggc

SEQ ID NO: 8653 - RNA, 19 nt, Artificial Sequence
  Synthetic
ggcgcuucagcuugcuggc

SEQ ID NO: 8654 - RNA, 20 nt, Artificial Sequence
  Synthetic
uggcgcuucagcuugcuggc

SEQ ID NO: 8655 - RNA, 21 nt, Artificial Sequence
  Synthetic
guggcgcuucagcuugcuggc

SEQ ID NO: 8656 - RNA, 22 nt, Artificial Sequence
  Synthetic
uguggcgcuucagcuugcuggc

SEQ ID NO: 8657 - RNA, 23 nt, Artificial Sequence
  Synthetic
auguggcgcuucagcuugcuggc

SEQ ID NO: 8658 - RNA, 24 nt, Artificial Sequence
  Synthetic
cauguggcgcuucagcuugcuggc

SEQ ID NO: 8659 - RNA, 18 nt, Artificial Sequence
  Synthetic
cuccucguccccguucuc

SEQ ID NO: 8660 - RNA, 19 nt, Artificial Sequence
  Synthetic
ccuccucguccccguucuc

SEQ ID NO: 8661 - RNA, 20 nt, Artificial Sequence
  Synthetic
uccuccucguccccguucuc

SEQ ID NO: 8662 - RNA, 21 nt, Artificial Sequence
  Synthetic
uuccuccucguccccguucuc

SEQ ID NO: 8663 - RNA, 22 nt, Artificial Sequence
  Synthetic
cuuccuccucguccccguucuc

SEQ ID NO: 8664 - RNA, 23 nt, Artificial Sequence
  Synthetic
ucuuccuccucguccccguucuc

SEQ ID NO: 8665 - RNA, 24 nt, Artificial Sequence
  Synthetic
cucuuccuccucguccccguucuc

SEQ ID NO: 8666 - RNA, 18 nt, Artificial Sequence
  Synthetic
aggcaaaaggcgauuguc

SEQ ID NO: 8667 - RNA, 19 nt, Artificial Sequence
  Synthetic
gaggcaaaaggcgauuguc

SEQ ID NO: 8668 - RNA, 20 nt, Artificial Sequence
  Synthetic
ggaggcaaaaggcgauuguc

SEQ ID NO: 8669 - RNA, 21 nt, Artificial Sequence
  Synthetic
aggaggcaaaaggcgauuguc

SEQ ID NO: 8670 - RNA, 22 nt, Artificial Sequence
  Synthetic
gaggaggcaaaaggcgauuguc

SEQ ID NO: 8671 - RNA, 23 nt, Artificial Sequence
  Synthetic
cgaggaggcaaaaggcgauuguc

SEQ ID NO: 8672 - RNA, 24 nt, Artificial Sequence
  Synthetic
acgaggaggcaaaaggcgauuguc

SEQ ID NO: 8673 - RNA, 18 nt, Artificial Sequence
  Synthetic
agcucucuggguacuacg

SEQ ID NO: 8674 - RNA, 19 nt, Artificial Sequence
  Synthetic
gagcucucuggguacuacg

SEQ ID NO: 8675 - RNA, 20 nt, Artificial Sequence
  Synthetic
ugagcucucuggguacuacg

SEQ ID NO: 8676 - RNA, 21 nt, Artificial Sequence
  Synthetic
uugagcucucuggguacuacg

SEQ ID NO: 8677 - RNA, 22 nt, Artificial Sequence
  Synthetic
cuugagcucucuggguacuacg

SEQ ID NO: 8678 - RNA, 23 nt, Artificial Sequence
  Synthetic
ucuugagcucucuggguacuacg

SEQ ID NO: 8679 - RNA, 24 nt, Artificial Sequence
  Synthetic
aucuugagcucucuggguacuacg

SEQ ID NO: 8680 - RNA, 18 nt, Artificial Sequence
  Synthetic
ugaagggauaccaacccg

SEQ ID NO: 8681 - RNA, 19 nt, Artificial Sequence
  Synthetic
cugaagggauaccaacccg

SEQ ID NO: 8682 - RNA, 20 nt, Artificial Sequence
  Synthetic
ccugaagggauaccaacccg

SEQ ID NO: 8683 - RNA, 21 nt, Artificial Sequence
  Synthetic
uccugaagggauaccaacccg

SEQ ID NO: 8684 - RNA, 22 nt, Artificial Sequence
  Synthetic
guccugaagggauaccaacccg

SEQ ID NO: 8685 - RNA, 23 nt, Artificial Sequence
  Synthetic
aguccugaagggauaccaacccg

SEQ ID NO: 8686 - RNA, 24 nt, Artificial Sequence
  Synthetic
uaguccugaagggauaccaacccg

SEQ ID NO: 8687 - RNA, 18 nt, Artificial Sequence
  Synthetic
gcaaacucccguucuccg

SEQ ID NO: 8688 - RNA, 19 nt, Artificial Sequence
  Synthetic
cgcaaacucccguucuccg

SEQ ID NO: 8689 - RNA, 20 nt, Artificial Sequence
  Synthetic
gcgcaaacucccguucuccg

SEQ ID NO: 8690 - RNA, 21 nt, Artificial Sequence
  Synthetic
agcgcaaacucccguucuccg

SEQ ID NO: 8691 - RNA, 22 nt, Artificial Sequence
  Synthetic
aagcgcaaacucccguucuccg

SEQ ID NO: 8692 - RNA, 23 nt, Artificial Sequence
  Synthetic
gaagcgcaaacucccguucuccg

SEQ ID NO: 8693 - RNA, 24 nt, Artificial Sequence
  Synthetic
agaagcgcaaacucccguucuccg

SEQ ID NO: 8694 - RNA, 18 nt, Artificial Sequence
  Synthetic
ggcugggagggaggaggg

SEQ ID NO: 8695 - RNA, 19 nt, Artificial Sequence
  Synthetic
gggcugggagggaggaggg

SEQ ID NO: 8696 - RNA, 20 nt, Artificial Sequence
  Synthetic
ggggcugggagggaggaggg

SEQ ID NO: 8697 - RNA, 21 nt, Artificial Sequence
  Synthetic
gggggcugggagggaggaggg

SEQ ID NO: 8698 - RNA, 22 nt, Artificial Sequence
  Synthetic
cgggggcugggagggaggaggg

SEQ ID NO: 8699 - RNA, 23 nt, Artificial Sequence
  Synthetic
ccgggggcugggagggaggaggg

SEQ ID NO: 8700 - RNA, 24 nt, Artificial Sequence
  Synthetic
accgggggcugggagggaggaggg

SEQ ID NO: 8701 - RNA, 18 nt, Artificial Sequence
  Synthetic
ugguggacuaaacagggg

SEQ ID NO: 8702 - RNA, 19 nt, Artificial Sequence
  Synthetic
gugguggacuaaacagggg

SEQ ID NO: 8703 - RNA, 20 nt, Artificial Sequence
  Synthetic
ggugguggacuaaacagggg

SEQ ID NO: 8704 - RNA, 21 nt, Artificial Sequence
  Synthetic
cggugguggacuaaacagggg

SEQ ID NO: 8705 - RNA, 22 nt, Artificial Sequence
  Synthetic
ucggugguggacuaaacagggg

SEQ ID NO: 8706 - RNA, 23 nt, Artificial Sequence
  Synthetic
cucggugguggacuaaacagggg

SEQ ID NO: 8707 - RNA, 24 nt, Artificial Sequence
  Synthetic
ucucggugguggacuaaacagggg

SEQ ID NO: 8708 - RNA, 18 nt, Artificial Sequence
  Synthetic
aagagaaaccaugcacug

SEQ ID NO: 8709 - RNA, 19 nt, Artificial Sequence
  Synthetic
caagagaaaccaugcacug

SEQ ID NO: 8710 - RNA, 20 nt, Artificial Sequence
  Synthetic
gcaagagaaaccaugcacug

SEQ ID NO: 8711 - RNA, 21 nt, Artificial Sequence
  Synthetic
ugcaagagaaaccaugcacug

SEQ ID NO: 8712 - RNA, 22 nt, Artificial Sequence
  Synthetic
uugcaagagaaaccaugcacug

SEQ ID NO: 8713 - RNA, 23 nt, Artificial Sequence
  Synthetic
guugcaagagaaaccaugcacug

SEQ ID NO: 8714 - RNA, 24 nt, Artificial Sequence
  Synthetic
uguugcaagagaaaccaugcacug

SEQ ID NO: 8715 - RNA, 18 nt, Artificial Sequence
  Synthetic
gucaaaggcacucgggug

SEQ ID NO: 8716 - RNA, 19 nt, Artificial Sequence
  Synthetic
ugucaaaggcacucgggug

SEQ ID NO: 8717 - RNA, 20 nt, Artificial Sequence
  Synthetic
cugucaaaggcacucgggug

SEQ ID NO: 8718 - RNA, 21 nt, Artificial Sequence
  Synthetic
ccugucaaaggcacucgggug

SEQ ID NO: 8719 - RNA, 22 nt, Artificial Sequence
  Synthetic
cccugucaaaggcacucgggug

SEQ ID NO: 8720 - RNA, 23 nt, Artificial Sequence
  Synthetic
acccugucaaaggcacucgggug

SEQ ID NO: 8721 - RNA, 24 nt, Artificial Sequence
  Synthetic
cacccugucaaaggcacucgggug

SEQ ID NO: 8722 - RNA, 18 nt, Artificial Sequence
  Synthetic
cccaccaagucgcuggug

SEQ ID NO: 8723 - RNA, 19 nt, Artificial Sequence
  Synthetic
gcccaccaagucgcuggug

SEQ ID NO: 8724 - RNA, 20 nt, Artificial Sequence
  Synthetic
ugcccaccaagucgcuggug

SEQ ID NO: 8725 - RNA, 21 nt, Artificial Sequence
  Synthetic
cugcccaccaagucgcuggug

SEQ ID NO: 8726 - RNA, 22 nt, Artificial Sequence
  Synthetic
gcugcccaccaagucgcuggug

SEQ ID NO: 8727 - RNA, 23 nt, Artificial Sequence
  Synthetic
cgcugcccaccaagucgcuggug

SEQ ID NO: 8728 - RNA, 24 nt, Artificial Sequence
  Synthetic
gcgcugcccaccaagucgcuggug

SEQ ID NO: 8729 - RNA, 18 nt, Artificial Sequence
  Synthetic
gggguuauugucugcaau

SEQ ID NO: 8730 - RNA, 19 nt, Artificial Sequence
  Synthetic
agggguuauugucugcaau

SEQ ID NO: 8731 - RNA, 20 nt, Artificial Sequence
  Synthetic
aagggguuauugucugcaau

SEQ ID NO: 8732 - RNA, 21 nt, Artificial Sequence
  Synthetic
aaagggguuauugucugcaau

SEQ ID NO: 8733 - RNA, 22 nt, Artificial Sequence
  Synthetic
uaaagggguuauugucugcaau

SEQ ID NO: 8734 - RNA, 23 nt, Artificial Sequence
  Synthetic
uuaaagggguuauugucugcaau

SEQ ID NO: 8735 - RNA, 24 nt, Artificial Sequence
  Synthetic
guuaaagggguuauugucugcaau

SEQ ID NO: 8736 - RNA, 18 nt, Artificial Sequence
  Synthetic
cuggguacuacgccgaau

SEQ ID NO: 8737 - RNA, 19 nt, Artificial Sequence
  Synthetic
ucuggguacuacgccgaau

SEQ ID NO: 8738 - RNA, 20 nt, Artificial Sequence
  Synthetic
cucuggguacuacgccgaau

SEQ ID NO: 8739 - RNA, 21 nt, Artificial Sequence
  Synthetic
ucucuggguacuacgccgaau

SEQ ID NO: 8740 - RNA, 22 nt, Artificial Sequence
  Synthetic
cucucuggguacuacgccgaau

SEQ ID NO: 8741 - RNA, 23 nt, Artificial Sequence
  Synthetic
gcucucuggguacuacgccgaau

SEQ ID NO: 8742 - RNA, 24 nt, Artificial Sequence
  Synthetic
agcucucuggguacuacgccgaau

SEQ ID NO: 8743 - RNA, 18 nt, Artificial Sequence
  Synthetic
cguagccggcgagccacu

SEQ ID NO: 8744 - RNA, 19 nt, Artificial Sequence
  Synthetic
gcguagccggcgagccacu

SEQ ID NO: 8745 - RNA, 20 nt, Artificial Sequence
  Synthetic
cgcguagccggcgagccacu

SEQ ID NO: 8746 - RNA, 21 nt, Artificial Sequence
  Synthetic
ccgcguagccggcgagccacu

SEQ ID NO: 8747 - RNA, 22 nt, Artificial Sequence
  Synthetic
gccgcguagccggcgagccacu

SEQ ID NO: 8748 - RNA, 23 nt, Artificial Sequence
  Synthetic
ggccgcguagccggcgagccacu

SEQ ID NO: 8749 - RNA, 24 nt, Artificial Sequence
  Synthetic
aggccgcguagccggcgagccacu

SEQ ID NO: 8750 - RNA, 18 nt, Artificial Sequence
  Synthetic
ccacacaucuugagcucu

SEQ ID NO: 8751 - RNA, 19 nt, Artificial Sequence
  Synthetic
gccacacaucuugagcucu

SEQ ID NO: 8752 - RNA, 20 nt, Artificial Sequence
  Synthetic
ugccacacaucuugagcucu

SEQ ID NO: 8753 - RNA, 21 nt, Artificial Sequence
  Synthetic
cugccacacaucuugagcucu

SEQ ID NO: 8754 - RNA, 22 nt, Artificial Sequence
  Synthetic
acugccacacaucuugagcucu

SEQ ID NO: 8755 - RNA, 23 nt, Artificial Sequence
  Synthetic
aacugccacacaucuugagcucu

SEQ ID NO: 8756 - RNA, 24 nt, Artificial Sequence
  Synthetic
aaacugccacacaucuugagcucu

SEQ ID NO: 8757 - RNA, 18 nt, Artificial Sequence
  Synthetic
cguucuccgggaucaggu

SEQ ID NO: 8758 - RNA, 19 nt, Artificial Sequence
  Synthetic
ccguucuccgggaucaggu

SEQ ID NO: 8759 - RNA, 20 nt, Artificial Sequence
  Synthetic
cccguucuccgggaucaggu

SEQ ID NO: 8760 - RNA, 21 nt, Artificial Sequence
  Synthetic
ccccguucuccgggaucaggu

SEQ ID NO: 8761 - RNA, 22 nt, Artificial Sequence
  Synthetic
uccccguucuccgggaucaggu

SEQ ID NO: 8762 - RNA, 23 nt, Artificial Sequence
  Synthetic
guccccguucuccgggaucaggu

SEQ ID NO: 8763 - RNA, 24 nt, Artificial Sequence
  Synthetic
cguccccguucuccgggaucaggu

SEQ ID NO: 8764 - RNA, 18 nt, Artificial Sequence
  Synthetic
ccaggcgcucuaugcggu

SEQ ID NO: 8765 - RNA, 19 nt, Artificial Sequence
  Synthetic
cccaggcgcucuaugcggu

SEQ ID NO: 8766 - RNA, 20 nt, Artificial Sequence
  Synthetic
ccccaggcgcucuaugcggu

SEQ ID NO: 8767 - RNA, 21 nt, Artificial Sequence
  Synthetic
cccccaggcgcucuaugcggu

SEQ ID NO: 8768 - RNA, 22 nt, Artificial Sequence
  Synthetic
gcccccaggcgcucuaugcggu

SEQ ID NO: 8769 - RNA, 23 nt, Artificial Sequence
  Synthetic
cgcccccaggcgcucuaugcggu

SEQ ID NO: 8770 - RNA, 24 nt, Artificial Sequence
  Synthetic
ccgcccccaggcgcucuaugcggu

SEQ ID NO: 8771 - RNA, 18 nt, Artificial Sequence
  Synthetic
uucccagccaccucucca

SEQ ID NO: 8772 - RNA, 19 nt, Artificial Sequence
  Synthetic
cuucccagccaccucucca

SEQ ID NO: 8773 - RNA, 20 nt, Artificial Sequence
  Synthetic
ccuucccagccaccucucca

SEQ ID NO: 8774 - RNA, 21 nt, Artificial Sequence
  Synthetic
uccuucccagccaccucucca

SEQ ID NO: 8775 - RNA, 22 nt, Artificial Sequence
  Synthetic
guccuucccagccaccucucca

SEQ ID NO: 8776 - RNA, 23 nt, Artificial Sequence
  Synthetic
uguccuucccagccaccucucca

SEQ ID NO: 8777 - RNA, 24 nt, Artificial Sequence
  Synthetic
auguccuucccagccaccucucca

SEQ ID NO: 8778 - RNA, 18 nt, Artificial Sequence
  Synthetic
agcgcaucaagcucgaga

SEQ ID NO: 8779 - RNA, 19 nt, Artificial Sequence
  Synthetic
aagcgcaucaagcucgaga

SEQ ID NO: 8780 - RNA, 20 nt, Artificial Sequence
  Synthetic
uaagcgcaucaagcucgaga

SEQ ID NO: 8781 - RNA, 21 nt, Artificial Sequence
  Synthetic
cuaagcgcaucaagcucgaga

SEQ ID NO: 8782 - RNA, 22 nt, Artificial Sequence
  Synthetic
ucuaagcgcaucaagcucgaga

SEQ ID NO: 8783 - RNA, 23 nt, Artificial Sequence
  Synthetic
cucuaagcgcaucaagcucgaga

SEQ ID NO: 8784 - RNA, 24 nt, Artificial Sequence
  Synthetic
ucucuaagcgcaucaagcucgaga

SEQ ID NO: 8785 - RNA, 18 nt, Artificial Sequence
  Synthetic
ggagcugacggagagcga

SEQ ID NO: 8786 - RNA, 19 nt, Artificial Sequence
  Synthetic
aggagcugacggagagcga

SEQ ID NO: 8787 - RNA, 20 nt, Artificial Sequence
  Synthetic
gaggagcugacggagagcga

SEQ ID NO: 8788 - RNA, 21 nt, Artificial Sequence
  Synthetic
ggaggagcugacggagagcga

SEQ ID NO: 8789 - RNA, 22 nt, Artificial Sequence
  Synthetic
aggaggagcugacggagagcga

SEQ ID NO: 8790 - RNA, 23 nt, Artificial Sequence
  Synthetic
gaggaggagcugacggagagcga

SEQ ID NO: 8791 - RNA, 24 nt, Artificial Sequence
  Synthetic
ggaggaggagcugacggagagcga

SEQ ID NO: 8792 - RNA, 18 nt, Artificial Sequence
  Synthetic
ucacccgagugccuuuga

SEQ ID NO: 8793 - RNA, 19 nt, Artificial Sequence
  Synthetic
aucacccgagugccuuuga

SEQ ID NO: 8794 - RNA, 20 nt, Artificial Sequence
  Synthetic
caucacccgagugccuuuga

SEQ ID NO: 8795 - RNA, 21 nt, Artificial Sequence
  Synthetic
ccaucacccgagugccuuuga

SEQ ID NO: 8796 - RNA, 22 nt, Artificial Sequence
  Synthetic
cccaucacccgagugccuuuga

SEQ ID NO: 8797 - RNA, 23 nt, Artificial Sequence
  Synthetic
acccaucacccgagugccuuuga

SEQ ID NO: 8798 - RNA, 24 nt, Artificial Sequence
  Synthetic
cacccaucacccgagugccuuuga

SEQ ID NO: 8799 - RNA, 18 nt, Artificial Sequence
  Synthetic
gagcacuccucggagaac

SEQ ID NO: 8800 - RNA, 19 nt, Artificial Sequence
  Synthetic
ggagcacuccucggagaac

SEQ ID NO: 8801 - RNA, 20 nt, Artificial Sequence
  Synthetic
cggagcacuccucggagaac

SEQ ID NO: 8802 - RNA, 21 nt, Artificial Sequence
  Synthetic
ucggagcacuccucggagaac

SEQ ID NO: 8803 - RNA, 22 nt, Artificial Sequence
  Synthetic
gucggagcacuccucggagaac

SEQ ID NO: 8804 - RNA, 23 nt, Artificial Sequence
  Synthetic
cgucggagcacuccucggagaac

SEQ ID NO: 8805 - RNA, 24 nt, Artificial Sequence
  Synthetic
ucgucggagcacuccucggagaac

SEQ ID NO: 8806 - RNA, 18 nt, Artificial Sequence
  Synthetic
gcccuggccacccaucac

SEQ ID NO: 8807 - RNA, 19 nt, Artificial Sequence
  Synthetic
ggcccuggccacccaucac

SEQ ID NO: 8808 - RNA, 20 nt, Artificial Sequence
  Synthetic
uggcccuggccacccaucac

SEQ ID NO: 8809 - RNA, 21 nt, Artificial Sequence
  Synthetic
auggcccuggccacccaucac

SEQ ID NO: 8810 - RNA, 22 nt, Artificial Sequence
  Synthetic
gauggcccuggccacccaucac

SEQ ID NO: 8811 - RNA, 23 nt, Artificial Sequence
  Synthetic
agauggcccuggccacccaucac

SEQ ID NO: 8812 - RNA, 24 nt, Artificial Sequence
  Synthetic
gagauggcccuggccacccaucac

SEQ ID NO: 8813 - RNA, 18 nt, Artificial Sequence
  Synthetic
uuaaccugcuaagaauac

SEQ ID NO: 8814 - RNA, 19 nt, Artificial Sequence
  Synthetic
uuuaaccugcuaagaauac

SEQ ID NO: 8815 - RNA, 20 nt, Artificial Sequence
  Synthetic
cuuuaaccugcuaagaauac

SEQ ID NO: 8816 - RNA, 21 nt, Artificial Sequence
  Synthetic
ccuuuaaccugcuaagaauac

SEQ ID NO: 8817 - RNA, 22 nt, Artificial Sequence
  Synthetic
cccuuuaaccugcuaagaauac

SEQ ID NO: 8818 - RNA, 23 nt, Artificial Sequence
  Synthetic
ccccuuuaaccugcuaagaauac

SEQ ID NO: 8819 - RNA, 24 nt, Artificial Sequence
  Synthetic
accccuuuaaccugcuaagaauac

SEQ ID NO: 8820 - RNA, 18 nt, Artificial Sequence
  Synthetic
cggaaguccccugacccc

SEQ ID NO: 8821 - RNA, 19 nt, Artificial Sequence
  Synthetic
acggaaguccccugacccc

SEQ ID NO: 8822 - RNA, 20 nt, Artificial Sequence
  Synthetic
cacggaaguccccugacccc

SEQ ID NO: 8823 - RNA, 21 nt, Artificial Sequence
  Synthetic
acacggaaguccccugacccc

SEQ ID NO: 8824 - RNA, 22 nt, Artificial Sequence
  Synthetic
aacacggaaguccccugacccc

SEQ ID NO: 8825 - RNA, 23 nt, Artificial Sequence
  Synthetic
gaacacggaaguccccugacccc

SEQ ID NO: 8826 - RNA, 24 nt, Artificial Sequence
  Synthetic
cgaacacggaaguccccugacccc

SEQ ID NO: 8827 - RNA, 18 nt, Artificial Sequence
  Synthetic
agaaaauuugaagccccc

SEQ ID NO: 8828 - RNA, 19 nt, Artificial Sequence
  Synthetic
gagaaaauuugaagccccc

SEQ ID NO: 8829 - RNA, 20 nt, Artificial Sequence
  Synthetic
ugagaaaauuugaagccccc

SEQ ID NO: 8830 - RNA, 21 nt, Artificial Sequence
  Synthetic
cugagaaaauuugaagccccc

SEQ ID NO: 8831 - RNA, 22 nt, Artificial Sequence
  Synthetic
ucugagaaaauuugaagccccc

SEQ ID NO: 8832 - RNA, 23 nt, Artificial Sequence
  Synthetic
uucugagaaaauuugaagccccc

SEQ ID NO: 8833 - RNA, 24 nt, Artificial Sequence
  Synthetic
guucugagaaaauuugaagccccc

SEQ ID NO: 8834 - RNA, 18 nt, Artificial Sequence
  Synthetic
gcuauggagccucccgcc

SEQ ID NO: 8835 - RNA, 19 nt, Artificial Sequence
  Synthetic
ggcuauggagccucccgcc

SEQ ID NO: 8836 - RNA, 20 nt, Artificial Sequence
  Synthetic
uggcuauggagccucccgcc

SEQ ID NO: 8837 - RNA, 21 nt, Artificial Sequence
  Synthetic
auggcuauggagccucccgcc

SEQ ID NO: 8838 - RNA, 22 nt, Artificial Sequence
  Synthetic
aauggcuauggagccucccgcc

SEQ ID NO: 8839 - RNA, 23 nt, Artificial Sequence
  Synthetic
caauggcuauggagccucccgcc

SEQ ID NO: 8840 - RNA, 24 nt, Artificial Sequence
  Synthetic
ccaauggcuauggagccucccgcc

SEQ ID NO: 8841 - RNA, 18 nt, Artificial Sequence
  Synthetic
aacacgcacagaacacuc

SEQ ID NO: 8842 - RNA, 19 nt, Artificial Sequence
  Synthetic
caacacgcacagaacacuc

SEQ ID NO: 8843 - RNA, 20 nt, Artificial Sequence
  Synthetic
gcaacacgcacagaacacuc

SEQ ID NO: 8844 - RNA, 21 nt, Artificial Sequence
  Synthetic
ugcaacacgcacagaacacuc

SEQ ID NO: 8845 - RNA, 22 nt, Artificial Sequence
  Synthetic
uugcaacacgcacagaacacuc

SEQ ID NO: 8846 - RNA, 23 nt, Artificial Sequence
  Synthetic
cuugcaacacgcacagaacacuc

SEQ ID NO: 8847 - RNA, 24 nt, Artificial Sequence
  Synthetic
ucuugcaacacgcacagaacacuc

SEQ ID NO: 8848 - RNA, 18 nt, Artificial Sequence
  Synthetic
acgaagacucgguggccg

SEQ ID NO: 8849 - RNA, 19 nt, Artificial Sequence
  Synthetic
gacgaagacucgguggccg

SEQ ID NO: 8850 - RNA, 20 nt, Artificial Sequence
  Synthetic
cgacgaagacucgguggccg

SEQ ID NO: 8851 - RNA, 21 nt, Artificial Sequence
  Synthetic
gcgacgaagacucgguggccg

SEQ ID NO: 8852 - RNA, 22 nt, Artificial Sequence
  Synthetic
ugcgacgaagacucgguggccg

SEQ ID NO: 8853 - RNA, 23 nt, Artificial Sequence
  Synthetic
uugcgacgaagacucgguggccg

SEQ ID NO: 8854 - RNA, 24 nt, Artificial Sequence
  Synthetic
cuugcgacgaagacucgguggccg

SEQ ID NO: 8855 - RNA, 18 nt, Artificial Sequence
  Synthetic
gcccggggagcuggacgg

SEQ ID NO: 8856 - RNA, 19 nt, Artificial Sequence
  Synthetic
cgcccggggagcuggacgg

SEQ ID NO: 8857 - RNA, 20 nt, Artificial Sequence
  Synthetic
ccgcccggggagcuggacgg

SEQ ID NO: 8858 - RNA, 21 nt, Artificial Sequence
  Synthetic
accgcccggggagcuggacgg

SEQ ID NO: 8859 - RNA, 22 nt, Artificial Sequence
  Synthetic
caccgcccggggagcuggacgg

SEQ ID NO: 8860 - RNA, 23 nt, Artificial Sequence
  Synthetic
acaccgcccggggagcuggacgg

SEQ ID NO: 8861 - RNA, 24 nt, Artificial Sequence
  Synthetic
cacaccgcccggggagcuggacgg

SEQ ID NO: 8862 - RNA, 18 nt, Artificial Sequence
  Synthetic
gccgcggcugcuccccgg

SEQ ID NO: 8863 - RNA, 19 nt, Artificial Sequence
  Synthetic
ggccgcggcugcuccccgg

SEQ ID NO: 8864 - RNA, 20 nt, Artificial Sequence
  Synthetic
uggccgcggcugcuccccgg

SEQ ID NO: 8865 - RNA, 21 nt, Artificial Sequence
  Synthetic
auggccgcggcugcuccccgg

SEQ ID NO: 8866 - RNA, 22 nt, Artificial Sequence
  Synthetic
aauggccgcggcugcuccccgg

SEQ ID NO: 8867 - RNA, 23 nt, Artificial Sequence
  Synthetic
uaauggccgcggcugcuccccgg

SEQ ID NO: 8868 - RNA, 24 nt, Artificial Sequence
  Synthetic
uuaauggccgcggcugcuccccgg

SEQ ID NO: 8869 - RNA, 18 nt, Artificial Sequence
  Synthetic
uuugacagggugcugcgg

SEQ ID NO: 8870 - RNA, 19 nt, Artificial Sequence
  Synthetic
cuuugacagggugcugcgg

SEQ ID NO: 8871 - RNA, 20 nt, Artificial Sequence
  Synthetic
ccuuugacagggugcugcgg

SEQ ID NO: 8872 - RNA, 21 nt, Artificial Sequence
  Synthetic
gccuuugacagggugcugcgg

SEQ ID NO: 8873 - RNA, 22 nt, Artificial Sequence
  Synthetic
ugccuuugacagggugcugcgg

SEQ ID NO: 8874 - RNA, 23 nt, Artificial Sequence
  Synthetic
gugccuuugacagggugcugcgg

SEQ ID NO: 8875 - RNA, 24 nt, Artificial Sequence
  Synthetic
agugccuuugacagggugcugcgg

SEQ ID NO: 8876 - RNA, 18 nt, Artificial Sequence
  Synthetic
auuugaagcccccagggg

SEQ ID NO: 8877 - RNA, 19 nt, Artificial Sequence
  Synthetic
aauuugaagcccccagggg

SEQ ID NO: 8878 - RNA, 20 nt, Artificial Sequence
  Synthetic
aaauuugaagcccccagggg

SEQ ID NO: 8879 - RNA, 21 nt, Artificial Sequence
  Synthetic
aaaauuugaagcccccagggg

SEQ ID NO: 8880 - RNA, 22 nt, Artificial Sequence
  Synthetic
gaaaauuugaagcccccagggg

SEQ ID NO: 8881 - RNA, 23 nt, Artificial Sequence
  Synthetic
agaaaauuugaagcccccagggg

SEQ ID NO: 8882 - RNA, 24 nt, Artificial Sequence
  Synthetic
gagaaaauuugaagcccccagggg

SEQ ID NO: 8883 - RNA, 18 nt, Artificial Sequence
  Synthetic
ucccuucaggacuaggug

SEQ ID NO: 8884 - RNA, 19 nt, Artificial Sequence
  Synthetic
aucccuucaggacuaggug

SEQ ID NO: 8885 - RNA, 20 nt, Artificial Sequence
  Synthetic
uaucccuucaggacuaggug

SEQ ID NO: 8886 - RNA, 21 nt, Artificial Sequence
  Synthetic
guaucccuucaggacuaggug

SEQ ID NO: 8887 - RNA, 22 nt, Artificial Sequence
  Synthetic
gguaucccuucaggacuaggug

SEQ ID NO: 8888 - RNA, 23 nt, Artificial Sequence
  Synthetic
ugguaucccuucaggacuaggug

SEQ ID NO: 8889 - RNA, 24 nt, Artificial Sequence
  Synthetic
uugguaucccuucaggacuaggug

SEQ ID NO: 8890 - RNA, 18 nt, Artificial Sequence
  Synthetic
cggucaaguccaagucau

SEQ ID NO: 8891 - RNA, 19 nt, Artificial Sequence
  Synthetic
ccggucaaguccaagucau

SEQ ID NO: 8892 - RNA, 20 nt, Artificial Sequence
  Synthetic
cccggucaaguccaagucau

SEQ ID NO: 8893 - RNA, 21 nt, Artificial Sequence
  Synthetic
ccccggucaaguccaagucau

SEQ ID NO: 8894 - RNA, 22 nt, Artificial Sequence
  Synthetic
cccccggucaaguccaagucau

SEQ ID NO: 8895 - RNA, 23 nt, Artificial Sequence
  Synthetic
gcccccggucaaguccaagucau

SEQ ID NO: 8896 - RNA, 24 nt, Artificial Sequence
  Synthetic
agcccccggucaaguccaagucau

SEQ ID NO: 8897 - RNA, 18 nt, Artificial Sequence
  Synthetic
uaaccccuuuaaccugcu

SEQ ID NO: 8898 - RNA, 19 nt, Artificial Sequence
  Synthetic
auaaccccuuuaaccugcu

SEQ ID NO: 8899 - RNA, 20 nt, Artificial Sequence
  Synthetic
aauaaccccuuuaaccugcu

SEQ ID NO: 8900 - RNA, 21 nt, Artificial Sequence
  Synthetic
caauaaccccuuuaaccugcu

SEQ ID NO: 8901 - RNA, 22 nt, Artificial Sequence
  Synthetic
acaauaaccccuuuaaccugcu

SEQ ID NO: 8902 - RNA, 23 nt, Artificial Sequence
  Synthetic
gacaauaaccccuuuaaccugcu

SEQ ID NO: 8903 - RNA, 24 nt, Artificial Sequence
  Synthetic
agacaauaaccccuuuaaccugcu

SEQ ID NO: 8904 - RNA, 18 nt, Artificial Sequence
  Synthetic
acagaacacucauggauu

SEQ ID NO: 8905 - RNA, 19 nt, Artificial Sequence
  Synthetic
cacagaacacucauggauu

SEQ ID NO: 8906 - RNA, 20 nt, Artificial Sequence
  Synthetic
gcacagaacacucauggauu

SEQ ID NO: 8907 - RNA, 21 nt, Artificial Sequence
  Synthetic
cgcacagaacacucauggauu

SEQ ID NO: 8908 - RNA, 22 nt, Artificial Sequence
  Synthetic
acgcacagaacacucauggauu

SEQ ID NO: 8909 - RNA, 23 nt, Artificial Sequence
  Synthetic
cacgcacagaacacucauggauu

SEQ ID NO: 8910 - RNA, 24 nt, Artificial Sequence
  Synthetic
acacgcacagaacacucauggauu

SEQ ID NO: 8911 - RNA, 18 nt, Artificial Sequence
  Synthetic
gcagacgcagcgacacuu

SEQ ID NO: 8912 - RNA, 19 nt, Artificial Sequence
  Synthetic
ggcagacgcagcgacacuu

SEQ ID NO: 8913 - RNA, 20 nt, Artificial Sequence
  Synthetic
gggcagacgcagcgacacuu

SEQ ID NO: 8914 - RNA, 21 nt, Artificial Sequence
  Synthetic
agggcagacgcagcgacacuu

SEQ ID NO: 8915 - RNA, 22 nt, Artificial Sequence
  Synthetic
gagggcagacgcagcgacacuu

SEQ ID NO: 8916 - RNA, 23 nt, Artificial Sequence
  Synthetic
agagggcagacgcagcgacacuu

SEQ ID NO: 8917 - RNA, 24 nt, Artificial Sequence
  Synthetic
aagagggcagacgcagcgacacuu

SEQ ID NO: 8918 - RNA, 18 nt, Artificial Sequence
  Synthetic
caagauguguggcaguuu

SEQ ID NO: 8919 - RNA, 19 nt, Artificial Sequence
  Synthetic
ucaagauguguggcaguuu

SEQ ID NO: 8920 - RNA, 20 nt, Artificial Sequence
  Synthetic
cucaagauguguggcaguuu

SEQ ID NO: 8921 - RNA, 21 nt, Artificial Sequence
  Synthetic
gcucaagauguguggcaguuu

SEQ ID NO: 8922 - RNA, 22 nt, Artificial Sequence
  Synthetic
agcucaagauguguggcaguuu

SEQ ID NO: 8923 - RNA, 23 nt, Artificial Sequence
  Synthetic
gagcucaagauguguggcaguuu

SEQ ID NO: 8924 - RNA, 24 nt, Artificial Sequence
  Synthetic
agagcucaagauguguggcaguuu

SEQ ID NO: 8925 - RNA, 18 nt, Artificial Sequence
  Synthetic
ucucggugguggacuaaa

SEQ ID NO: 8926 - RNA, 19 nt, Artificial Sequence
  Synthetic
gucucggugguggacuaaa

SEQ ID NO: 8927 - RNA, 20 nt, Artificial Sequence
  Synthetic
ugucucggugguggacuaaa

SEQ ID NO: 8928 - RNA, 21 nt, Artificial Sequence
  Synthetic
augucucggugguggacuaaa

SEQ ID NO: 8929 - RNA, 22 nt, Artificial Sequence
  Synthetic
gaugucucggugguggacuaaa

SEQ ID NO: 8930 - RNA, 23 nt, Artificial Sequence
  Synthetic
ugaugucucggugguggacuaaa

SEQ ID NO: 8931 - RNA, 24 nt, Artificial Sequence
  Synthetic
gugaugucucggugguggacuaaa

SEQ ID NO: 8932 - RNA, 18 nt, Artificial Sequence
  Synthetic
guucugugcguguugcaa

SEQ ID NO: 8933 - RNA, 19 nt, Artificial Sequence
  Synthetic
uguucugugcguguugcaa

SEQ ID NO: 8934 - RNA, 20 nt, Artificial Sequence
  Synthetic
guguucugugcguguugcaa

SEQ ID NO: 8935 - RNA, 21 nt, Artificial Sequence
  Synthetic
aguguucugugcguguugcaa

SEQ ID NO: 8936 - RNA, 22 nt, Artificial Sequence
  Synthetic
gaguguucugugcguguugcaa

SEQ ID NO: 8937 - RNA, 23 nt, Artificial Sequence
  Synthetic
ugaguguucugugcguguugcaa

SEQ ID NO: 8938 - RNA, 24 nt, Artificial Sequence
  Synthetic
augaguguucugugcguguugcaa

SEQ ID NO: 8939 - RNA, 18 nt, Artificial Sequence
  Synthetic
ucuggguacuacgccgaa

SEQ ID NO: 8940 - RNA, 19 nt, Artificial Sequence
  Synthetic
cucuggguacuacgccgaa

SEQ ID NO: 8941 - RNA, 20 nt, Artificial Sequence
  Synthetic
ucucuggguacuacgccgaa

SEQ ID NO: 8942 - RNA, 21 nt, Artificial Sequence
  Synthetic
cucucuggguacuacgccgaa

SEQ ID NO: 8943 - RNA, 22 nt, Artificial Sequence
  Synthetic
gcucucuggguacuacgccgaa

SEQ ID NO: 8944 - RNA, 23 nt, Artificial Sequence
  Synthetic
agcucucuggguacuacgccgaa

SEQ ID NO: 8945 - RNA, 24 nt, Artificial Sequence
  Synthetic
gagcucucuggguacuacgccgaa

SEQ ID NO: 8946 - RNA, 18 nt, Artificial Sequence
  Synthetic
ucggugguggacuaaaca

SEQ ID NO: 8947 - RNA, 19 nt, Artificial Sequence
  Synthetic
cucggugguggacuaaaca

SEQ ID NO: 8948 - RNA, 20 nt, Artificial Sequence
  Synthetic
ucucggugguggacuaaaca

SEQ ID NO: 8949 - RNA, 21 nt, Artificial Sequence
  Synthetic
gucucggugguggacuaaaca

SEQ ID NO: 8950 - RNA, 22 nt, Artificial Sequence
  Synthetic
ugucucggugguggacuaaaca

SEQ ID NO: 8951 - RNA, 23 nt, Artificial Sequence
  Synthetic
augucucggugguggacuaaaca

SEQ ID NO: 8952 - RNA, 24 nt, Artificial Sequence
  Synthetic
gaugucucggugguggacuaaaca

SEQ ID NO: 8953 - RNA, 18 nt, Artificial Sequence
  Synthetic
agaaagagguuggagaca

SEQ ID NO: 8954 - RNA, 19 nt, Artificial Sequence
  Synthetic
uagaaagagguuggagaca

SEQ ID NO: 8955 - RNA, 20 nt, Artificial Sequence
  Synthetic
cuagaaagagguuggagaca

SEQ ID NO: 8956 - RNA, 21 nt, Artificial Sequence
  Synthetic
ccuagaaagagguuggagaca

SEQ ID NO: 8957 - RNA, 22 nt, Artificial Sequence
  Synthetic
accuagaaagagguuggagaca

SEQ ID NO: 8958 - RNA, 23 nt, Artificial Sequence
  Synthetic
aaccuagaaagagguuggagaca

SEQ ID NO: 8959 - RNA, 24 nt, Artificial Sequence
  Synthetic
gaaccuagaaagagguuggagaca

SEQ ID NO: 8960 - RNA, 18 nt, Artificial Sequence
  Synthetic
ucugcaauaugaauccca

SEQ ID NO: 8961 - RNA, 19 nt, Artificial Sequence
  Synthetic
gucugcaauaugaauccca

SEQ ID NO: 8962 - RNA, 20 nt, Artificial Sequence
  Synthetic
ugucugcaauaugaauccca

SEQ ID NO: 8963 - RNA, 21 nt, Artificial Sequence
  Synthetic
uugucugcaauaugaauccca

SEQ ID NO: 8964 - RNA, 22 nt, Artificial Sequence
  Synthetic
auugucugcaauaugaauccca

SEQ ID NO: 8965 - RNA, 23 nt, Artificial Sequence
  Synthetic
uauugucugcaauaugaauccca

SEQ ID NO: 8966 - RNA, 24 nt, Artificial Sequence
  Synthetic
uuauugucugcaauaugaauccca

SEQ ID NO: 8967 - RNA, 18 nt, Artificial Sequence
  Synthetic
ccucgcugaagugcugca

SEQ ID NO: 8968 - RNA, 19 nt, Artificial Sequence
  Synthetic
gccucgcugaagugcugca

SEQ ID NO: 8969 - RNA, 20 nt, Artificial Sequence
  Synthetic
ggccucgcugaagugcugca

SEQ ID NO: 8970 - RNA, 21 nt, Artificial Sequence
  Synthetic
aggccucgcugaagugcugca

SEQ ID NO: 8971 - RNA, 22 nt, Artificial Sequence
  Synthetic
aaggccucgcugaagugcugca

SEQ ID NO: 8972 - RNA, 23 nt, Artificial Sequence
  Synthetic
gaaggccucgcugaagugcugca

SEQ ID NO: 8973 - RNA, 24 nt, Artificial Sequence
  Synthetic
ggaaggccucgcugaagugcugca

SEQ ID NO: 8974 - RNA, 18 nt, Artificial Sequence
  Synthetic
gaggaggggcggauugca

SEQ ID NO: 8975 - RNA, 19 nt, Artificial Sequence
  Synthetic
ggaggaggggcggauugca

SEQ ID NO: 8976 - RNA, 20 nt, Artificial Sequence
  Synthetic
gggaggaggggcggauugca

SEQ ID NO: 8977 - RNA, 21 nt, Artificial Sequence
  Synthetic
agggaggaggggcggauugca

SEQ ID NO: 8978 - RNA, 22 nt, Artificial Sequence
  Synthetic
gagggaggaggggcggauugca

SEQ ID NO: 8979 - RNA, 23 nt, Artificial Sequence
  Synthetic
ggagggaggaggggcggauugca

SEQ ID NO: 8980 - RNA, 24 nt, Artificial Sequence
  Synthetic
gggagggaggaggggcggauugca

SEQ ID NO: 8981 - RNA, 18 nt, Artificial Sequence
  Synthetic
guugcaguaaccuuugca

SEQ ID NO: 8982 - RNA, 19 nt, Artificial Sequence
  Synthetic
gguugcaguaaccuuugca

SEQ ID NO: 8983 - RNA, 20 nt, Artificial Sequence
  Synthetic
ugguugcaguaaccuuugca

SEQ ID NO: 8984 - RNA, 21 nt, Artificial Sequence
  Synthetic
augguugcaguaaccuuugca

SEQ ID NO: 8985 - RNA, 22 nt, Artificial Sequence
  Synthetic
aaugguugcaguaaccuuugca

SEQ ID NO: 8986 - RNA, 23 nt, Artificial Sequence
  Synthetic
gaaugguugcaguaaccuuugca

SEQ ID NO: 8987 - RNA, 24 nt, Artificial Sequence
  Synthetic
ggaaugguugcaguaaccuuugca

SEQ ID NO: 8988 - RNA, 18 nt, Artificial Sequence
  Synthetic
gcuuagagaaggggcuca

SEQ ID NO: 8989 - RNA, 19 nt, Artificial Sequence
  Synthetic
cgcuuagagaaggggcuca

SEQ ID NO: 8990 - RNA, 20 nt, Artificial Sequence
  Synthetic
gcgcuuagagaaggggcuca

SEQ ID NO: 8991 - RNA, 21 nt, Artificial Sequence
  Synthetic
ugcgcuuagagaaggggcuca

SEQ ID NO: 8992 - RNA, 22 nt, Artificial Sequence
  Synthetic
augcgcuuagagaaggggcuca

SEQ ID NO: 8993 - RNA, 23 nt, Artificial Sequence
  Synthetic
gaugcgcuuagagaaggggcuca

SEQ ID NO: 8994 - RNA, 24 nt, Artificial Sequence
  Synthetic
ugaugcgcuuagagaaggggcuca

SEQ ID NO: 8995 - RNA, 18 nt, Artificial Sequence
  Synthetic
cgucggacuugaccguca

SEQ ID NO: 8996 - RNA, 19 nt, Artificial Sequence
  Synthetic
ucgucggacuugaccguca

SEQ ID NO: 8997 - RNA, 20 nt, Artificial Sequence
  Synthetic
gucgucggacuugaccguca

SEQ ID NO: 8998 - RNA, 21 nt, Artificial Sequence
  Synthetic
cgucgucggacuugaccguca

SEQ ID NO: 8999 - RNA, 22 nt, Artificial Sequence
  Synthetic
ccgucgucggacuugaccguca

SEQ ID NO: 9000 - RNA, 23 nt, Artificial Sequence
  Synthetic
accgucgucggacuugaccguca

SEQ ID NO: 9001 - RNA, 24 nt, Artificial Sequence
  Synthetic
gaccgucgucggacuugaccguca

SEQ ID NO: 9002 - RNA, 18 nt, Artificial Sequence
  Synthetic
uaccaacccgcgggguca

SEQ ID NO: 9003 - RNA, 19 nt, Artificial Sequence
  Synthetic
auaccaacccgcgggguca

SEQ ID NO: 9004 - RNA, 20 nt, Artificial Sequence
  Synthetic
gauaccaacccgcgggguca

SEQ ID NO: 9005 - RNA, 21 nt, Artificial Sequence
  Synthetic
ggauaccaacccgcgggguca

SEQ ID NO: 9006 - RNA, 22 nt, Artificial Sequence
  Synthetic
gggauaccaacccgcgggguca

SEQ ID NO: 9007 - RNA, 23 nt, Artificial Sequence
  Synthetic
agggauaccaacccgcgggguca

SEQ ID NO: 9008 - RNA, 24 nt, Artificial Sequence
  Synthetic
aagggauaccaacccgcgggguca

SEQ ID NO: 9009 - RNA, 18 nt, Artificial Sequence
  Synthetic
gcuugaugcgcuuagaga

SEQ ID NO: 9010 - RNA, 19 nt, Artificial Sequence
  Synthetic
agcuugaugcgcuuagaga

SEQ ID NO: 9011 - RNA, 20 nt, Artificial Sequence
  Synthetic
gagcuugaugcgcuuagaga

SEQ ID NO: 9012 - RNA, 21 nt, Artificial Sequence
  Synthetic
cgagcuugaugcgcuuagaga

SEQ ID NO: 9013 - RNA, 22 nt, Artificial Sequence
  Synthetic
ucgagcuugaugcgcuuagaga

SEQ ID NO: 9014 - RNA, 23 nt, Artificial Sequence
  Synthetic
cucgagcuugaugcgcuuagaga

SEQ ID NO: 9015 - RNA, 24 nt, Artificial Sequence
  Synthetic
ucucgagcuugaugcgcuuagaga

SEQ ID NO: 9016 - RNA, 18 nt, Artificial Sequence
  Synthetic
cuagaaagagguuggaga

SEQ ID NO: 9017 - RNA, 19 nt, Artificial Sequence
  Synthetic
ccuagaaagagguuggaga

SEQ ID NO: 9018 - RNA, 20 nt, Artificial Sequence
  Synthetic
accuagaaagagguuggaga

SEQ ID NO: 9019 - RNA, 21 nt, Artificial Sequence
  Synthetic
aaccuagaaagagguuggaga

SEQ ID NO: 9020 - RNA, 22 nt, Artificial Sequence
  Synthetic
gaaccuagaaagagguuggaga

SEQ ID NO: 9021 - RNA, 23 nt, Artificial Sequence
  Synthetic
agaaccuagaaagagguuggaga

SEQ ID NO: 9022 - RNA, 24 nt, Artificial Sequence
  Synthetic
aagaaccuagaaagagguuggaga

SEQ ID NO: 9023 - RNA, 18 nt, Artificial Sequence
  Synthetic
gugugugaagaaccuaga

SEQ ID NO: 9024 - RNA, 19 nt, Artificial Sequence
  Synthetic
ggugugugaagaaccuaga

SEQ ID NO: 9025 - RNA, 20 nt, Artificial Sequence
  Synthetic
gggugugugaagaaccuaga

SEQ ID NO: 9026 - RNA, 21 nt, Artificial Sequence
  Synthetic
ggggugugugaagaaccuaga

SEQ ID NO: 9027 - RNA, 22 nt, Artificial Sequence
  Synthetic
gggggugugugaagaaccuaga

SEQ ID NO: 9028 - RNA, 23 nt, Artificial Sequence
  Synthetic
ugggggugugugaagaaccuaga

SEQ ID NO: 9029 - RNA, 24 nt, Artificial Sequence
  Synthetic
augggggugugugaagaaccuaga

SEQ ID NO: 9030 - RNA, 18 nt, Artificial Sequence
  Synthetic
cucuggguacuacgccga

SEQ ID NO: 9031 - RNA, 19 nt, Artificial Sequence
  Synthetic
ucucuggguacuacgccga

SEQ ID NO: 9032 - RNA, 20 nt, Artificial Sequence
  Synthetic
cucucuggguacuacgccga

SEQ ID NO: 9033 - RNA, 21 nt, Artificial Sequence
  Synthetic
gcucucuggguacuacgccga

SEQ ID NO: 9034 - RNA, 22 nt, Artificial Sequence
  Synthetic
agcucucuggguacuacgccga

SEQ ID NO: 9035 - RNA, 23 nt, Artificial Sequence
  Synthetic
gagcucucuggguacuacgccga

SEQ ID NO: 9036 - RNA, 24 nt, Artificial Sequence
  Synthetic
ugagcucucuggguacuacgccga

SEQ ID NO: 9037 - RNA, 18 nt, Artificial Sequence
  Synthetic
gagguuggagacagagga

SEQ ID NO: 9038 - RNA, 19 nt, Artificial Sequence
  Synthetic
agagguuggagacagagga

SEQ ID NO: 9039 - RNA, 20 nt, Artificial Sequence
  Synthetic
aagagguuggagacagagga

SEQ ID NO: 9040 - RNA, 21 nt, Artificial Sequence
  Synthetic
aaagagguuggagacagagga

SEQ ID NO: 9041 - RNA, 22 nt, Artificial Sequence
  Synthetic
gaaagagguuggagacagagga

SEQ ID NO: 9042 - RNA, 23 nt, Artificial Sequence
  Synthetic
agaaagagguuggagacagagga

SEQ ID NO: 9043 - RNA, 24 nt, Artificial Sequence
  Synthetic
uagaaagagguuggagacagagga

SEQ ID NO: 9044 - RNA, 18 nt, Artificial Sequence
  Synthetic
ggggcggauugcagagga

SEQ ID NO: 9045 - RNA, 19 nt, Artificial Sequence
  Synthetic
aggggcggauugcagagga

SEQ ID NO: 9046 - RNA, 20 nt, Artificial Sequence
  Synthetic
gaggggcggauugcagagga

SEQ ID NO: 9047 - RNA, 21 nt, Artificial Sequence
  Synthetic
ggaggggcggauugcagagga

SEQ ID NO: 9048 - RNA, 22 nt, Artificial Sequence
  Synthetic
aggaggggcggauugcagagga

SEQ ID NO: 9049 - RNA, 23 nt, Artificial Sequence
  Synthetic
gaggaggggcggauugcagagga

SEQ ID NO: 9050 - RNA, 24 nt, Artificial Sequence
  Synthetic
ggaggaggggcggauugcagagga

SEQ ID NO: 9051 - RNA, 18 nt, Artificial Sequence
  Synthetic
cggauugcagaggaggga

SEQ ID NO: 9052 - RNA, 19 nt, Artificial Sequence
  Synthetic
gcggauugcagaggaggga

SEQ ID NO: 9053 - RNA, 20 nt, Artificial Sequence
  Synthetic
ggcggauugcagaggaggga

SEQ ID NO: 9054 - RNA, 21 nt, Artificial Sequence
  Synthetic
gggcggauugcagaggaggga

SEQ ID NO: 9055 - RNA, 22 nt, Artificial Sequence
  Synthetic
ggggcggauugcagaggaggga

SEQ ID NO: 9056 - RNA, 23 nt, Artificial Sequence
  Synthetic
aggggcggauugcagaggaggga

SEQ ID NO: 9057 - RNA, 24 nt, Artificial Sequence
  Synthetic
gaggggcggauugcagaggaggga

SEQ ID NO: 9058 - RNA, 18 nt, Artificial Sequence
  Synthetic
cuugaccgggggcuggga

SEQ ID NO: 9059 - RNA, 19 nt, Artificial Sequence
  Synthetic
acuugaccgggggcuggga

SEQ ID NO: 9060 - RNA, 20 nt, Artificial Sequence
  Synthetic
gacuugaccgggggcuggga

SEQ ID NO: 9061 - RNA, 21 nt, Artificial Sequence
  Synthetic
ggacuugaccgggggcuggga

SEQ ID NO: 9062 - RNA, 22 nt, Artificial Sequence
  Synthetic
uggacuugaccgggggcuggga

SEQ ID NO: 9063 - RNA, 23 nt, Artificial Sequence
  Synthetic
uuggacuugaccgggggcuggga

SEQ ID NO: 9064 - RNA, 24 nt, Artificial Sequence
  Synthetic
cuuggacuugaccgggggcuggga

SEQ ID NO: 9065 - RNA, 18 nt, Artificial Sequence
  Synthetic
cgcaugacuuggacuuga

SEQ ID NO: 9066 - RNA, 19 nt, Artificial Sequence
  Synthetic
ucgcaugacuuggacuuga

SEQ ID NO: 9067 - RNA, 20 nt, Artificial Sequence
  Synthetic
cucgcaugacuuggacuuga

SEQ ID NO: 9068 - RNA, 21 nt, Artificial Sequence
  Synthetic
acucgcaugacuuggacuuga

SEQ ID NO: 9069 - RNA, 22 nt, Artificial Sequence
  Synthetic
aacucgcaugacuuggacuuga

SEQ ID NO: 9070 - RNA, 23 nt, Artificial Sequence
  Synthetic
gaacucgcaugacuuggacuuga

SEQ ID NO: 9071 - RNA, 24 nt, Artificial Sequence
  Synthetic
agaacucgcaugacuuggacuuga

SEQ ID NO: 9072 - RNA, 18 nt, Artificial Sequence
  Synthetic
gggcccggaccacuaaua

SEQ ID NO: 9073 - RNA, 19 nt, Artificial Sequence
  Synthetic
cgggcccggaccacuaaua

SEQ ID NO: 9074 - RNA, 20 nt, Artificial Sequence
  Synthetic
ccgggcccggaccacuaaua

SEQ ID NO: 9075 - RNA, 21 nt, Artificial Sequence
  Synthetic
cccgggcccggaccacuaaua

SEQ ID NO: 9076 - RNA, 22 nt, Artificial Sequence
  Synthetic
gcccgggcccggaccacuaaua

SEQ ID NO: 9077 - RNA, 23 nt, Artificial Sequence
  Synthetic
ugcccgggcccggaccacuaaua

SEQ ID NO: 9078 - RNA, 24 nt, Artificial Sequence
  Synthetic
cugcccgggcccggaccacuaaua

SEQ ID NO: 9079 - RNA, 18 nt, Artificial Sequence
  Synthetic
agcucucuaagucuccua

SEQ ID NO: 9080 - RNA, 19 nt, Artificial Sequence
  Synthetic
cagcucucuaagucuccua

SEQ ID NO: 9081 - RNA, 20 nt, Artificial Sequence
  Synthetic
ccagcucucuaagucuccua

SEQ ID NO: 9082 - RNA, 21 nt, Artificial Sequence
  Synthetic
gccagcucucuaagucuccua

SEQ ID NO: 9083 - RNA, 22 nt, Artificial Sequence
  Synthetic
ugccagcucucuaagucuccua

SEQ ID NO: 9084 - RNA, 23 nt, Artificial Sequence
  Synthetic
cugccagcucucuaagucuccua

SEQ ID NO: 9085 - RNA, 24 nt, Artificial Sequence
  Synthetic
ccugccagcucucuaagucuccua

SEQ ID NO: 9086 - RNA, 18 nt, Artificial Sequence
  Synthetic
cuggagucuccgaagcua

SEQ ID NO: 9087 - RNA, 19 nt, Artificial Sequence
  Synthetic
ucuggagucuccgaagcua

SEQ ID NO: 9088 - RNA, 20 nt, Artificial Sequence
  Synthetic
gucuggagucuccgaagcua

SEQ ID NO: 9089 - RNA, 21 nt, Artificial Sequence
  Synthetic
ugucuggagucuccgaagcua

SEQ ID NO: 9090 - RNA, 22 nt, Artificial Sequence
  Synthetic
uugucuggagucuccgaagcua

SEQ ID NO: 9091 - RNA, 23 nt, Artificial Sequence
  Synthetic
auugucuggagucuccgaagcua

SEQ ID NO: 9092 - RNA, 24 nt, Artificial Sequence
  Synthetic
gauugucuggagucuccgaagcua

SEQ ID NO: 9093 - RNA, 18 nt, Artificial Sequence
  Synthetic
ucgagcuugaugcgcuua

SEQ ID NO: 9094 - RNA, 19 nt, Artificial Sequence
  Synthetic
cucgagcuugaugcgcuua

SEQ ID NO: 9095 - RNA, 20 nt, Artificial Sequence
  Synthetic
ucucgagcuugaugcgcuua

SEQ ID NO: 9096 - RNA, 21 nt, Artificial Sequence
  Synthetic
uucucgagcuugaugcgcuua

SEQ ID NO: 9097 - RNA, 22 nt, Artificial Sequence
  Synthetic
cuucucgagcuugaugcgcuua

SEQ ID NO: 9098 - RNA, 23 nt, Artificial Sequence
  Synthetic
ccuucucgagcuugaugcgcuua

SEQ ID NO: 9099 - RNA, 24 nt, Artificial Sequence
  Synthetic
uccuucucgagcuugaugcgcuua

SEQ ID NO: 9100 - RNA, 18 nt, Artificial Sequence
  Synthetic
gguauucuuagcagguua

SEQ ID NO: 9101 - RNA, 19 nt, Artificial Sequence
  Synthetic
ugguauucuuagcagguua

SEQ ID NO: 9102 - RNA, 20 nt, Artificial Sequence
  Synthetic
cugguauucuuagcagguua

SEQ ID NO: 9103 - RNA, 21 nt, Artificial Sequence
  Synthetic
ccugguauucuuagcagguua

SEQ ID NO: 9104 - RNA, 22 nt, Artificial Sequence
  Synthetic
uccugguauucuuagcagguua

SEQ ID NO: 9105 - RNA, 23 nt, Artificial Sequence
  Synthetic
auccugguauucuuagcagguua

SEQ ID NO: 9106 - RNA, 24 nt, Artificial Sequence
  Synthetic
gauccugguauucuuagcagguua

SEQ ID NO: 9107 - RNA, 18 nt, Artificial Sequence
  Synthetic
cucggugguggacuaaac

SEQ ID NO: 9108 - RNA, 19 nt, Artificial Sequence
  Synthetic
ucucggugguggacuaaac

SEQ ID NO: 9109 - RNA, 20 nt, Artificial Sequence
  Synthetic
gucucggugguggacuaaac

SEQ ID NO: 9110 - RNA, 21 nt, Artificial Sequence
  Synthetic
ugucucggugguggacuaaac

SEQ ID NO: 9111 - RNA, 22 nt, Artificial Sequence
  Synthetic
augucucggugguggacuaaac

SEQ ID NO: 9112 - RNA, 23 nt, Artificial Sequence
  Synthetic
gaugucucggugguggacuaaac

SEQ ID NO: 9113 - RNA, 24 nt, Artificial Sequence
  Synthetic
ugaugucucggugguggacuaaac

SEQ ID NO: 9114 - RNA, 18 nt, Artificial Sequence
  Synthetic
uccgaggagugcuccgac

SEQ ID NO: 9115 - RNA, 19 nt, Artificial Sequence
  Synthetic
cuccgaggagugcuccgac

SEQ ID NO: 9116 - RNA, 20 nt, Artificial Sequence
  Synthetic
ucuccgaggagugcuccgac

SEQ ID NO: 9117 - RNA, 21 nt, Artificial Sequence
  Synthetic
uucuccgaggagugcuccgac

SEQ ID NO: 9118 - RNA, 22 nt, Artificial Sequence
  Synthetic
guucuccgaggagugcuccgac

SEQ ID NO: 9119 - RNA, 23 nt, Artificial Sequence
  Synthetic
cguucuccgaggagugcuccgac

SEQ ID NO: 9120 - RNA, 24 nt, Artificial Sequence
  Synthetic
ccguucuccgaggagugcuccgac

SEQ ID NO: 9121 - RNA, 18 nt, Artificial Sequence
  Synthetic
aacuuggccaccacggac

SEQ ID NO: 9122 - RNA, 19 nt, Artificial Sequence
  Synthetic
gaacuuggccaccacggac

SEQ ID NO: 9123 - RNA, 20 nt, Artificial Sequence
  Synthetic
ugaacuuggccaccacggac

SEQ ID NO: 9124 - RNA, 21 nt, Artificial Sequence
  Synthetic
uugaacuuggccaccacggac

SEQ ID NO: 9125 - RNA, 22 nt, Artificial Sequence
  Synthetic
cuugaacuuggccaccacggac

SEQ ID NO: 9126 - RNA, 23 nt, Artificial Sequence
  Synthetic
ucuugaacuuggccaccacggac

SEQ ID NO: 9127 - RNA, 24 nt, Artificial Sequence
  Synthetic
cucuugaacuuggccaccacggac

SEQ ID NO: 9128 - RNA, 18 nt, Artificial Sequence
  Synthetic
ccgcagaacucgcaugac

SEQ ID NO: 9129 - RNA, 19 nt, Artificial Sequence
  Synthetic
gccgcagaacucgcaugac

SEQ ID NO: 9130 - RNA, 20 nt, Artificial Sequence
  Synthetic
ugccgcagaacucgcaugac

SEQ ID NO: 9131 - RNA, 21 nt, Artificial Sequence
  Synthetic
uugccgcagaacucgcaugac

SEQ ID NO: 9132 - RNA, 22 nt, Artificial Sequence
  Synthetic
cuugccgcagaacucgcaugac

SEQ ID NO: 9133 - RNA, 23 nt, Artificial Sequence
  Synthetic
ucuugccgcagaacucgcaugac

SEQ ID NO: 9134 - RNA, 24 nt, Artificial Sequence
  Synthetic
gucuugccgcagaacucgcaugac

SEQ ID NO: 9135 - RNA, 18 nt, Artificial Sequence
  Synthetic
gcaugacuuggacuugac

SEQ ID NO: 9136 - RNA, 19 nt, Artificial Sequence
  Synthetic
cgcaugacuuggacuugac

SEQ ID NO: 9137 - RNA, 20 nt, Artificial Sequence
  Synthetic
ucgcaugacuuggacuugac

SEQ ID NO: 9138 - RNA, 21 nt, Artificial Sequence
  Synthetic
cucgcaugacuuggacuugac

SEQ ID NO: 9139 - RNA, 22 nt, Artificial Sequence
  Synthetic
acucgcaugacuuggacuugac

SEQ ID NO: 9140 - RNA, 23 nt, Artificial Sequence
  Synthetic
aacucgcaugacuuggacuugac

SEQ ID NO: 9141 - RNA, 24 nt, Artificial Sequence
  Synthetic
gaacucgcaugacuuggacuugac

SEQ ID NO: 9142 - RNA, 18 nt, Artificial Sequence
  Synthetic
gggggugugugaagaacc

SEQ ID NO: 9143 - RNA, 19 nt, Artificial Sequence
  Synthetic
ugggggugugugaagaacc

SEQ ID NO: 9144 - RNA, 20 nt, Artificial Sequence
  Synthetic
augggggugugugaagaacc

SEQ ID NO: 9145 - RNA, 21 nt, Artificial Sequence
  Synthetic
aaugggggugugugaagaacc

SEQ ID NO: 9146 - RNA, 22 nt, Artificial Sequence
  Synthetic
gaaugggggugugugaagaacc

SEQ ID NO: 9147 - RNA, 23 nt, Artificial Sequence
  Synthetic
cgaaugggggugugugaagaacc

SEQ ID NO: 9148 - RNA, 24 nt, Artificial Sequence
  Synthetic
ccgaaugggggugugugaagaacc

SEQ ID NO: 9149 - RNA, 18 nt, Artificial Sequence
  Synthetic
cucuugaacuuggccacc

SEQ ID NO: 9150 - RNA, 19 nt, Artificial Sequence
  Synthetic
gcucuugaacuuggccacc

SEQ ID NO: 9151 - RNA, 20 nt, Artificial Sequence
  Synthetic
cgcucuugaacuuggccacc

SEQ ID NO: 9152 - RNA, 21 nt, Artificial Sequence
  Synthetic
ucgcucuugaacuuggccacc

SEQ ID NO: 9153 - RNA, 22 nt, Artificial Sequence
  Synthetic
cucgcucuugaacuuggccacc

SEQ ID NO: 9154 - RNA, 23 nt, Artificial Sequence
  Synthetic
ucucgcucuugaacuuggccacc

SEQ ID NO: 9155 - RNA, 24 nt, Artificial Sequence
  Synthetic
uucucgcucuugaacuuggccacc

SEQ ID NO: 9156 - RNA, 18 nt, Artificial Sequence
  Synthetic
caugacuuggacuugacc

SEQ ID NO: 9157 - RNA, 19 nt, Artificial Sequence
  Synthetic
gcaugacuuggacuugacc

SEQ ID NO: 9158 - RNA, 20 nt, Artificial Sequence
  Synthetic
cgcaugacuuggacuugacc

SEQ ID NO: 9159 - RNA, 21 nt, Artificial Sequence
  Synthetic
ucgcaugacuuggacuugacc

SEQ ID NO: 9160 - RNA, 22 nt, Artificial Sequence
  Synthetic
cucgcaugacuuggacuugacc

SEQ ID NO: 9161 - RNA, 23 nt, Artificial Sequence
  Synthetic
acucgcaugacuuggacuugacc

SEQ ID NO: 9162 - RNA, 24 nt, Artificial Sequence
  Synthetic
aacucgcaugacuuggacuugacc

SEQ ID NO: 9163 - RNA, 18 nt, Artificial Sequence
  Synthetic
cugaagggauaccaaccc

SEQ ID NO: 9164 - RNA, 19 nt, Artificial Sequence
  Synthetic
ccugaagggauaccaaccc

SEQ ID NO: 9165 - RNA, 20 nt, Artificial Sequence
  Synthetic
uccugaagggauaccaaccc

SEQ ID NO: 9166 - RNA, 21 nt, Artificial Sequence
  Synthetic
guccugaagggauaccaaccc

SEQ ID NO: 9167 - RNA, 22 nt, Artificial Sequence
  Synthetic
aguccugaagggauaccaaccc

SEQ ID NO: 9168 - RNA, 23 nt, Artificial Sequence
  Synthetic
uaguccugaagggauaccaaccc

SEQ ID NO: 9169 - RNA, 24 nt, Artificial Sequence
  Synthetic
cuaguccugaagggauaccaaccc

SEQ ID NO: 9170 - RNA, 18 nt, Artificial Sequence
  Synthetic
cgcccacgaccgcgcccc

SEQ ID NO: 9171 - RNA, 19 nt, Artificial Sequence
  Synthetic
acgcccacgaccgcgcccc

SEQ ID NO: 9172 - RNA, 20 nt, Artificial Sequence
  Synthetic
cacgcccacgaccgcgcccc

SEQ ID NO: 9173 - RNA, 21 nt, Artificial Sequence
  Synthetic
ccacgcccacgaccgcgcccc

SEQ ID NO: 9174 - RNA, 22 nt, Artificial Sequence
  Synthetic
cccacgcccacgaccgcgcccc

SEQ ID NO: 9175 - RNA, 23 nt, Artificial Sequence
  Synthetic
gcccacgcccacgaccgcgcccc

SEQ ID NO: 9176 - RNA, 24 nt, Artificial Sequence
  Synthetic
cgcccacgcccacgaccgcgcccc

SEQ ID NO: 9177 - RNA, 18 nt, Artificial Sequence
  Synthetic
gcuuuuuggacaggcccc

SEQ ID NO: 9178 - RNA, 19 nt, Artificial Sequence
  Synthetic
agcuuuuuggacaggcccc

SEQ ID NO: 9179 - RNA, 20 nt, Artificial Sequence
  Synthetic
cagcuuuuuggacaggcccc

SEQ ID NO: 9180 - RNA, 21 nt, Artificial Sequence
  Synthetic
gcagcuuuuuggacaggcccc

SEQ ID NO: 9181 - RNA, 22 nt, Artificial Sequence
  Synthetic
agcagcuuuuuggacaggcccc

SEQ ID NO: 9182 - RNA, 23 nt, Artificial Sequence
  Synthetic
cagcagcuuuuuggacaggcccc

SEQ ID NO: 9183 - RNA, 24 nt, Artificial Sequence
  Synthetic
gcagcagcuuuuuggacaggcccc

SEQ ID NO: 9184 - RNA, 18 nt, Artificial Sequence
  Synthetic
cccgaggccgacucgccc

SEQ ID NO: 9185 - RNA, 19 nt, Artificial Sequence
  Synthetic
ccccgaggccgacucgccc

SEQ ID NO: 9186 - RNA, 20 nt, Artificial Sequence
  Synthetic
cccccgaggccgacucgccc

SEQ ID NO: 9187 - RNA, 21 nt, Artificial Sequence
  Synthetic
ccccccgaggccgacucgccc

SEQ ID NO: 9188 - RNA, 22 nt, Artificial Sequence
  Synthetic
gccccccgaggccgacucgccc

SEQ ID NO: 9189 - RNA, 23 nt, Artificial Sequence
  Synthetic
ggccccccgaggccgacucgccc

SEQ ID NO: 9190 - RNA, 24 nt, Artificial Sequence
  Synthetic
aggccccccgaggccgacucgccc

SEQ ID NO: 9191 - RNA, 18 nt, Artificial Sequence
  Synthetic
gucugcaauaugaauccc

SEQ ID NO: 9192 - RNA, 19 nt, Artificial Sequence
  Synthetic
ugucugcaauaugaauccc

SEQ ID NO: 9193 - RNA, 20 nt, Artificial Sequence
  Synthetic
uugucugcaauaugaauccc

SEQ ID NO: 9194 - RNA, 21 nt, Artificial Sequence
  Synthetic
auugucugcaauaugaauccc

SEQ ID NO: 9195 - RNA, 22 nt, Artificial Sequence
  Synthetic
uauugucugcaauaugaauccc

SEQ ID NO: 9196 - RNA, 23 nt, Artificial Sequence
  Synthetic
uuauugucugcaauaugaauccc

SEQ ID NO: 9197 - RNA, 24 nt, Artificial Sequence
  Synthetic
guuauugucugcaauaugaauccc

SEQ ID NO: 9198 - RNA, 18 nt, Artificial Sequence
  Synthetic
uucccgugccgcugcgcc

SEQ ID NO: 9199 - RNA, 19 nt, Artificial Sequence
  Synthetic
cuucccgugccgcugcgcc

SEQ ID NO: 9200 - RNA, 20 nt, Artificial Sequence
  Synthetic
acuucccgugccgcugcgcc

SEQ ID NO: 9201 - RNA, 21 nt, Artificial Sequence
  Synthetic
cacuucccgugccgcugcgcc

SEQ ID NO: 9202 - RNA, 22 nt, Artificial Sequence
  Synthetic
ccacuucccgugccgcugcgcc

SEQ ID NO: 9203 - RNA, 23 nt, Artificial Sequence
  Synthetic
uccacuucccgugccgcugcgcc

SEQ ID NO: 9204 - RNA, 24 nt, Artificial Sequence
  Synthetic
cuccacuucccgugccgcugcgcc

SEQ ID NO: 9205 - RNA, 18 nt, Artificial Sequence
  Synthetic
ccccgaggccgacucgcc

SEQ ID NO: 9206 - RNA, 19 nt, Artificial Sequence
  Synthetic
cccccgaggccgacucgcc

SEQ ID NO: 9207 - RNA, 20 nt, Artificial Sequence
  Synthetic
ccccccgaggccgacucgcc

SEQ ID NO: 9208 - RNA, 21 nt, Artificial Sequence
  Synthetic
gccccccgaggccgacucgcc

SEQ ID NO: 9209 - RNA, 22 nt, Artificial Sequence
  Synthetic
ggccccccgaggccgacucgcc

SEQ ID NO: 9210 - RNA, 23 nt, Artificial Sequence
  Synthetic
aggccccccgaggccgacucgcc

SEQ ID NO: 9211 - RNA, 24 nt, Artificial Sequence
  Synthetic
caggccccccgaggccgacucgcc

SEQ ID NO: 9212 - RNA, 18 nt, Artificial Sequence
  Synthetic
gcgcuuaugcuucucgcc

SEQ ID NO: 9213 - RNA, 19 nt, Artificial Sequence
  Synthetic
cgcgcuuaugcuucucgcc

SEQ ID NO: 9214 - RNA, 20 nt, Artificial Sequence
  Synthetic
ccgcgcuuaugcuucucgcc

SEQ ID NO: 9215 - RNA, 21 nt, Artificial Sequence
  Synthetic
gccgcgcuuaugcuucucgcc

SEQ ID NO: 9216 - RNA, 22 nt, Artificial Sequence
  Synthetic
ggccgcgcuuaugcuucucgcc

SEQ ID NO: 9217 - RNA, 23 nt, Artificial Sequence
  Synthetic
uggccgcgcuuaugcuucucgcc

SEQ ID NO: 9218 - RNA, 24 nt, Artificial Sequence
  Synthetic
guggccgcgcuuaugcuucucgcc

SEQ ID NO: 9219 - RNA, 18 nt, Artificial Sequence
  Synthetic
gggagggggggcgucgcc

SEQ ID NO: 9220 - RNA, 19 nt, Artificial Sequence
  Synthetic
agggagggggggcgucgcc

SEQ ID NO: 9221 - RNA, 20 nt, Artificial Sequence
  Synthetic
gagggagggggggcgucgcc

SEQ ID NO: 9222 - RNA, 21 nt, Artificial Sequence
  Synthetic
ggagggagggggggcgucgcc

SEQ ID NO: 9223 - RNA, 22 nt, Artificial Sequence
  Synthetic
aggagggagggggggcgucgcc

SEQ ID NO: 9224 - RNA, 23 nt, Artificial Sequence
  Synthetic
gaggagggagggggggcgucgcc

SEQ ID NO: 9225 - RNA, 24 nt, Artificial Sequence
  Synthetic
agaggagggagggggggcgucgcc

SEQ ID NO: 9226 - RNA, 18 nt, Artificial Sequence
  Synthetic
cauagggcugggccggcc

SEQ ID NO: 9227 - RNA, 19 nt, Artificial Sequence
  Synthetic
gcauagggcugggccggcc

SEQ ID NO: 9228 - RNA, 20 nt, Artificial Sequence
  Synthetic
ugcauagggcugggccggcc

SEQ ID NO: 9229 - RNA, 21 nt, Artificial Sequence
  Synthetic
uugcauagggcugggccggcc

SEQ ID NO: 9230 - RNA, 22 nt, Artificial Sequence
  Synthetic
uuugcauagggcugggccggcc

SEQ ID NO: 9231 - RNA, 23 nt, Artificial Sequence
  Synthetic
cuuugcauagggcugggccggcc

SEQ ID NO: 9232 - RNA, 24 nt, Artificial Sequence
  Synthetic
ccuuugcauagggcugggccggcc

SEQ ID NO: 9233 - RNA, 18 nt, Artificial Sequence
  Synthetic
guguugggcaucgcggcc

SEQ ID NO: 9234 - RNA, 19 nt, Artificial Sequence
  Synthetic
cguguugggcaucgcggcc

SEQ ID NO: 9235 - RNA, 20 nt, Artificial Sequence
  Synthetic
ccguguugggcaucgcggcc

SEQ ID NO: 9236 - RNA, 21 nt, Artificial Sequence
  Synthetic
uccguguugggcaucgcggcc

SEQ ID NO: 9237 - RNA, 22 nt, Artificial Sequence
  Synthetic
cuccguguugggcaucgcggcc

SEQ ID NO: 9238 - RNA, 23 nt, Artificial Sequence
  Synthetic
ucuccguguugggcaucgcggcc

SEQ ID NO: 9239 - RNA, 24 nt, Artificial Sequence
  Synthetic
uucuccguguugggcaucgcggcc

SEQ ID NO: 9240 - RNA, 18 nt, Artificial Sequence
  Synthetic
agggaucuuugagcugcc

SEQ ID NO: 9241 - RNA, 19 nt, Artificial Sequence
  Synthetic
aagggaucuuugagcugcc

SEQ ID NO: 9242 - RNA, 20 nt, Artificial Sequence
  Synthetic
gaagggaucuuugagcugcc

SEQ ID NO: 9243 - RNA, 21 nt, Artificial Sequence
  Synthetic
ggaagggaucuuugagcugcc

SEQ ID NO: 9244 - RNA, 22 nt, Artificial Sequence
  Synthetic
aggaagggaucuuugagcugcc

SEQ ID NO: 9245 - RNA, 23 nt, Artificial Sequence
  Synthetic
aaggaagggaucuuugagcugcc

SEQ ID NO: 9246 - RNA, 24 nt, Artificial Sequence
  Synthetic
uaaggaagggaucuuugagcugcc

SEQ ID NO: 9247 - RNA, 18 nt, Artificial Sequence
  Synthetic
aucccuccguccagcucc

SEQ ID NO: 9248 - RNA, 19 nt, Artificial Sequence
  Synthetic
gaucccuccguccagcucc

SEQ ID NO: 9249 - RNA, 20 nt, Artificial Sequence
  Synthetic
agaucccuccguccagcucc

SEQ ID NO: 9250 - RNA, 21 nt, Artificial Sequence
  Synthetic
gagaucccuccguccagcucc

SEQ ID NO: 9251 - RNA, 22 nt, Artificial Sequence
  Synthetic
cgagaucccuccguccagcucc

SEQ ID NO: 9252 - RNA, 23 nt, Artificial Sequence
  Synthetic
ccgagaucccuccguccagcucc

SEQ ID NO: 9253 - RNA, 24 nt, Artificial Sequence
  Synthetic
cccgagaucccuccguccagcucc

SEQ ID NO: 9254 - RNA, 18 nt, Artificial Sequence
  Synthetic
ccagcucucuaagucucc

SEQ ID NO: 9255 - RNA, 19 nt, Artificial Sequence
  Synthetic
gccagcucucuaagucucc

SEQ ID NO: 9256 - RNA, 20 nt, Artificial Sequence
  Synthetic
ugccagcucucuaagucucc

SEQ ID NO: 9257 - RNA, 21 nt, Artificial Sequence
  Synthetic
cugccagcucucuaagucucc

SEQ ID NO: 9258 - RNA, 22 nt, Artificial Sequence
  Synthetic
ccugccagcucucuaagucucc

SEQ ID NO: 9259 - RNA, 23 nt, Artificial Sequence
  Synthetic
cccugccagcucucuaagucucc

SEQ ID NO: 9260 - RNA, 24 nt, Artificial Sequence
  Synthetic
ucccugccagcucucuaagucucc

SEQ ID NO: 9261 - RNA, 18 nt, Artificial Sequence
  Synthetic
cgcaaacucccguucucc

SEQ ID NO: 9262 - RNA, 19 nt, Artificial Sequence
  Synthetic
gcgcaaacucccguucucc

SEQ ID NO: 9263 - RNA, 20 nt, Artificial Sequence
  Synthetic
agcgcaaacucccguucucc

SEQ ID NO: 9264 - RNA, 21 nt, Artificial Sequence
  Synthetic
aagcgcaaacucccguucucc

SEQ ID NO: 9265 - RNA, 22 nt, Artificial Sequence
  Synthetic
gaagcgcaaacucccguucucc

SEQ ID NO: 9266 - RNA, 23 nt, Artificial Sequence
  Synthetic
agaagcgcaaacucccguucucc

SEQ ID NO: 9267 - RNA, 24 nt, Artificial Sequence
  Synthetic
gagaagcgcaaacucccguucucc

SEQ ID NO: 9268 - RNA, 18 nt, Artificial Sequence
  Synthetic
ucgcuggugccggguucc

SEQ ID NO: 9269 - RNA, 19 nt, Artificial Sequence
  Synthetic
gucgcuggugccggguucc

SEQ ID NO: 9270 - RNA, 20 nt, Artificial Sequence
  Synthetic
agucgcuggugccggguucc

SEQ ID NO: 9271 - RNA, 21 nt, Artificial Sequence
  Synthetic
aagucgcuggugccggguucc

SEQ ID NO: 9272 - RNA, 22 nt, Artificial Sequence
  Synthetic
caagucgcuggugccggguucc

SEQ ID NO: 9273 - RNA, 23 nt, Artificial Sequence
  Synthetic
ccaagucgcuggugccggguucc

SEQ ID NO: 9274 - RNA, 24 nt, Artificial Sequence
  Synthetic
accaagucgcuggugccggguucc

SEQ ID NO: 9275 - RNA, 18 nt, Artificial Sequence
  Synthetic
gccgccuccaggcucagc

SEQ ID NO: 9276 - RNA, 19 nt, Artificial Sequence
  Synthetic
cgccgccuccaggcucagc

SEQ ID NO: 9277 - RNA, 20 nt, Artificial Sequence
  Synthetic
gcgccgccuccaggcucagc

SEQ ID NO: 9278 - RNA, 21 nt, Artificial Sequence
  Synthetic
cgcgccgccuccaggcucagc

SEQ ID NO: 9279 - RNA, 22 nt, Artificial Sequence
  Synthetic
gcgcgccgccuccaggcucagc

SEQ ID NO: 9280 - RNA, 23 nt, Artificial Sequence
  Synthetic
ggcgcgccgccuccaggcucagc

SEQ ID NO: 9281 - RNA, 24 nt, Artificial Sequence
  Synthetic
uggcgcgccgccuccaggcucagc

SEQ ID NO: 9282 - RNA, 18 nt, Artificial Sequence
  Synthetic
agaaggggcucagcgagc

SEQ ID NO: 9283 - RNA, 19 nt, Artificial Sequence
  Synthetic
gagaaggggcucagcgagc

SEQ ID NO: 9284 - RNA, 20 nt, Artificial Sequence
  Synthetic
agagaaggggcucagcgagc

SEQ ID NO: 9285 - RNA, 21 nt, Artificial Sequence
  Synthetic
uagagaaggggcucagcgagc

SEQ ID NO: 9286 - RNA, 22 nt, Artificial Sequence
  Synthetic
uuagagaaggggcucagcgagc

SEQ ID NO: 9287 - RNA, 23 nt, Artificial Sequence
  Synthetic
cuuagagaaggggcucagcgagc

SEQ ID NO: 9288 - RNA, 24 nt, Artificial Sequence
  Synthetic
gcuuagagaaggggcucagcgagc

SEQ ID NO: 9289 - RNA, 18 nt, Artificial Sequence
  Synthetic
cccccgaggccgacucgc

SEQ ID NO: 9290 - RNA, 19 nt, Artificial Sequence
  Synthetic
ccccccgaggccgacucgc

SEQ ID NO: 9291 - RNA, 20 nt, Artificial Sequence
  Synthetic
gccccccgaggccgacucgc

SEQ ID NO: 9292 - RNA, 21 nt, Artificial Sequence
  Synthetic
ggccccccgaggccgacucgc

SEQ ID NO: 9293 - RNA, 22 nt, Artificial Sequence
  Synthetic
aggccccccgaggccgacucgc

SEQ ID NO: 9294 - RNA, 23 nt, Artificial Sequence
  Synthetic
caggccccccgaggccgacucgc

SEQ ID NO: 9295 - RNA, 24 nt, Artificial Sequence
  Synthetic
acaggccccccgaggccgacucgc

SEQ ID NO: 9296 - RNA, 18 nt, Artificial Sequence
  Synthetic
agggagggggggcgucgc

SEQ ID NO: 9297 - RNA, 19 nt, Artificial Sequence
  Synthetic
gagggagggggggcgucgc

SEQ ID NO: 9298 - RNA, 20 nt, Artificial Sequence
  Synthetic
ggagggagggggggcgucgc

SEQ ID NO: 9299 - RNA, 21 nt, Artificial Sequence
  Synthetic
aggagggagggggggcgucgc

SEQ ID NO: 9300 - RNA, 22 nt, Artificial Sequence
  Synthetic
gaggagggagggggggcgucgc

SEQ ID NO: 9301 - RNA, 23 nt, Artificial Sequence
  Synthetic
agaggagggagggggggcgucgc

SEQ ID NO: 9302 - RNA, 24 nt, Artificial Sequence
  Synthetic
cagaggagggagggggggcgucgc

SEQ ID NO: 9303 - RNA, 18 nt, Artificial Sequence
  Synthetic
agcgcccuucugccaggc

SEQ ID NO: 9304 - RNA, 19 nt, Artificial Sequence
  Synthetic
aagcgcccuucugccaggc

SEQ ID NO: 9305 - RNA, 20 nt, Artificial Sequence
  Synthetic
aaagcgcccuucugccaggc

SEQ ID NO: 9306 - RNA, 21 nt, Artificial Sequence
  Synthetic
gaaagcgcccuucugccaggc

SEQ ID NO: 9307 - RNA, 22 nt, Artificial Sequence
  Synthetic
ggaaagcgcccuucugccaggc

SEQ ID NO: 9308 - RNA, 23 nt, Artificial Sequence
  Synthetic
uggaaagcgcccuucugccaggc

SEQ ID NO: 9309 - RNA, 24 nt, Artificial Sequence
  Synthetic
guggaaagcgcccuucugccaggc

SEQ ID NO: 9310 - RNA, 18 nt, Artificial Sequence
  Synthetic
gcauagggcugggccggc

SEQ ID NO: 9311 - RNA, 19 nt, Artificial Sequence
  Synthetic
ugcauagggcugggccggc

SEQ ID NO: 9312 - RNA, 20 nt, Artificial Sequence
  Synthetic
uugcauagggcugggccggc

SEQ ID NO: 9313 - RNA, 21 nt, Artificial Sequence
  Synthetic
uuugcauagggcugggccggc

SEQ ID NO: 9314 - RNA, 22 nt, Artificial Sequence
  Synthetic
cuuugcauagggcugggccggc

SEQ ID NO: 9315 - RNA, 23 nt, Artificial Sequence
  Synthetic
ccuuugcauagggcugggccggc

SEQ ID NO: 9316 - RNA, 24 nt, Artificial Sequence
  Synthetic
accuuugcauagggcugggccggc

SEQ ID NO: 9317 - RNA, 18 nt, Artificial Sequence
  Synthetic
cguguugggcaucgcggc

SEQ ID NO: 9318 - RNA, 19 nt, Artificial Sequence
  Synthetic
ccguguugggcaucgcggc

SEQ ID NO: 9319 - RNA, 20 nt, Artificial Sequence
  Synthetic
uccguguugggcaucgcggc

SEQ ID NO: 9320 - RNA, 21 nt, Artificial Sequence
  Synthetic
cuccguguugggcaucgcggc

SEQ ID NO: 9321 - RNA, 22 nt, Artificial Sequence
  Synthetic
ucuccguguugggcaucgcggc

SEQ ID NO: 9322 - RNA, 23 nt, Artificial Sequence
  Synthetic
uucuccguguugggcaucgcggc

SEQ ID NO: 9323 - RNA, 24 nt, Artificial Sequence
  Synthetic
guucuccguguugggcaucgcggc

SEQ ID NO: 9324 - RNA, 18 nt, Artificial Sequence
  Synthetic
agcugggccugcccgggc

SEQ ID NO: 9325 - RNA, 19 nt, Artificial Sequence
  Synthetic
gagcugggccugcccgggc

SEQ ID NO: 9326 - RNA, 20 nt, Artificial Sequence
  Synthetic
ugagcugggccugcccgggc

SEQ ID NO: 9327 - RNA, 21 nt, Artificial Sequence
  Synthetic
uugagcugggccugcccgggc

SEQ ID NO: 9328 - RNA, 22 nt, Artificial Sequence
  Synthetic
uuugagcugggccugcccgggc

SEQ ID NO: 9329 - RNA, 23 nt, Artificial Sequence
  Synthetic
uuuugagcugggccugcccgggc

SEQ ID NO: 9330 - RNA, 24 nt, Artificial Sequence
  Synthetic
cuuuugagcugggccugcccgggc

SEQ ID NO: 9331 - RNA, 18 nt, Artificial Sequence
  Synthetic
uuggacuugaccgggggc

SEQ ID NO: 9332 - RNA, 19 nt, Artificial Sequence
  Synthetic
cuuggacuugaccgggggc

SEQ ID NO: 9333 - RNA, 20 nt, Artificial Sequence
  Synthetic
acuuggacuugaccgggggc

SEQ ID NO: 9334 - RNA, 21 nt, Artificial Sequence
  Synthetic
gacuuggacuugaccgggggc

SEQ ID NO: 9335 - RNA, 22 nt, Artificial Sequence
  Synthetic
ugacuuggacuugaccgggggc

SEQ ID NO: 9336 - RNA, 23 nt, Artificial Sequence
  Synthetic
augacuuggacuugaccgggggc

SEQ ID NO: 9337 - RNA, 24 nt, Artificial Sequence
  Synthetic
caugacuuggacuugaccgggggc

SEQ ID NO: 9338 - RNA, 18 nt, Artificial Sequence
  Synthetic
ccuagagaaauccauggc

SEQ ID NO: 9339 - RNA, 19 nt, Artificial Sequence
  Synthetic
uccuagagaaauccauggc

SEQ ID NO: 9340 - RNA, 20 nt, Artificial Sequence
  Synthetic
cuccuagagaaauccauggc

SEQ ID NO: 9341 - RNA, 21 nt, Artificial Sequence
  Synthetic
ucuccuagagaaauccauggc

SEQ ID NO: 9342 - RNA, 22 nt, Artificial Sequence
  Synthetic
gucuccuagagaaauccauggc

SEQ ID NO: 9343 - RNA, 23 nt, Artificial Sequence
  Synthetic
agucuccuagagaaauccauggc

SEQ ID NO: 9344 - RNA, 24 nt, Artificial Sequence
  Synthetic
aagucuccuagagaaauccauggc

SEQ ID NO: 9345 - RNA, 18 nt, Artificial Sequence
  Synthetic
aucccauggagagguggc

SEQ ID NO: 9346 - RNA, 19 nt, Artificial Sequence
  Synthetic
aaucccauggagagguggc

SEQ ID NO: 9347 - RNA, 20 nt, Artificial Sequence
  Synthetic
gaaucccauggagagguggc

SEQ ID NO: 9348 - RNA, 21 nt, Artificial Sequence
  Synthetic
ugaaucccauggagagguggc

SEQ ID NO: 9349 - RNA, 22 nt, Artificial Sequence
  Synthetic
augaaucccauggagagguggc

SEQ ID NO: 9350 - RNA, 23 nt, Artificial Sequence
  Synthetic
uaugaaucccauggagagguggc

SEQ ID NO: 9351 - RNA, 24 nt, Artificial Sequence
  Synthetic
auaugaaucccauggagagguggc

SEQ ID NO: 9352 - RNA, 18 nt, Artificial Sequence
  Synthetic
acucgggugauggguggc

SEQ ID NO: 9353 - RNA, 19 nt, Artificial Sequence
  Synthetic
cacucgggugauggguggc

SEQ ID NO: 9354 - RNA, 20 nt, Artificial Sequence
  Synthetic
gcacucgggugauggguggc

SEQ ID NO: 9355 - RNA, 21 nt, Artificial Sequence
  Synthetic
ggcacucgggugauggguggc

SEQ ID NO: 9356 - RNA, 22 nt, Artificial Sequence
  Synthetic
aggcacucgggugauggguggc

SEQ ID NO: 9357 - RNA, 23 nt, Artificial Sequence
  Synthetic
aaggcacucgggugauggguggc

SEQ ID NO: 9358 - RNA, 24 nt, Artificial Sequence
  Synthetic
aaaggcacucgggugauggguggc

SEQ ID NO: 9359 - RNA, 18 nt, Artificial Sequence
  Synthetic
cuuuugagcugggccugc

SEQ ID NO: 9360 - RNA, 19 nt, Artificial Sequence
  Synthetic
ucuuuugagcugggccugc

SEQ ID NO: 9361 - RNA, 20 nt, Artificial Sequence
  Synthetic
cucuuuugagcugggccugc

SEQ ID NO: 9362 - RNA, 21 nt, Artificial Sequence
  Synthetic
ccucuuuugagcugggccugc

SEQ ID NO: 9363 - RNA, 22 nt, Artificial Sequence
  Synthetic
cccucuuuugagcugggccugc

SEQ ID NO: 9364 - RNA, 23 nt, Artificial Sequence
  Synthetic
gcccucuuuugagcugggccugc

SEQ ID NO: 9365 - RNA, 24 nt, Artificial Sequence
  Synthetic
ugcccucuuuugagcugggccugc

SEQ ID NO: 9366 - RNA, 18 nt, Artificial Sequence
  Synthetic
aagggaucuuugagcugc

SEQ ID NO: 9367 - RNA, 19 nt, Artificial Sequence
  Synthetic
gaagggaucuuugagcugc

SEQ ID NO: 9368 - RNA, 20 nt, Artificial Sequence
  Synthetic
ggaagggaucuuugagcugc

SEQ ID NO: 9369 - RNA, 21 nt, Artificial Sequence
  Synthetic
aggaagggaucuuugagcugc

SEQ ID NO: 9370 - RNA, 22 nt, Artificial Sequence
  Synthetic
aaggaagggaucuuugagcugc

SEQ ID NO: 9371 - RNA, 23 nt, Artificial Sequence
  Synthetic
uaaggaagggaucuuugagcugc

SEQ ID NO: 9372 - RNA, 24 nt, Artificial Sequence
  Synthetic
cuaaggaagggaucuuugagcugc

SEQ ID NO: 9373 - RNA, 18 nt, Artificial Sequence
  Synthetic
gccucgcugaagugcugc

SEQ ID NO: 9374 - RNA, 19 nt, Artificial Sequence
  Synthetic
ggccucgcugaagugcugc

SEQ ID NO: 9375 - RNA, 20 nt, Artificial Sequence
  Synthetic
aggccucgcugaagugcugc

SEQ ID NO: 9376 - RNA, 21 nt, Artificial Sequence
  Synthetic
aaggccucgcugaagugcugc

SEQ ID NO: 9377 - RNA, 22 nt, Artificial Sequence
  Synthetic
gaaggccucgcugaagugcugc

SEQ ID NO: 9378 - RNA, 23 nt, Artificial Sequence
  Synthetic
ggaaggccucgcugaagugcugc

SEQ ID NO: 9379 - RNA, 24 nt, Artificial Sequence
  Synthetic
uggaaggccucgcugaagugcugc

SEQ ID NO: 9380 - RNA, 18 nt, Artificial Sequence
  Synthetic
guguucugugcguguugc

SEQ ID NO: 9381 - RNA, 19 nt, Artificial Sequence
  Synthetic
aguguucugugcguguugc

SEQ ID NO: 9382 - RNA, 20 nt, Artificial Sequence
  Synthetic
gaguguucugugcguguugc

SEQ ID NO: 9383 - RNA, 21 nt, Artificial Sequence
  Synthetic
ugaguguucugugcguguugc

SEQ ID NO: 9384 - RNA, 22 nt, Artificial Sequence
  Synthetic
augaguguucugugcguguugc

SEQ ID NO: 9385 - RNA, 23 nt, Artificial Sequence
  Synthetic
caugaguguucugugcguguugc

SEQ ID NO: 9386 - RNA, 24 nt, Artificial Sequence
  Synthetic
ccaugaguguucugugcguguugc

SEQ ID NO: 9387 - RNA, 18 nt, Artificial Sequence
  Synthetic
cgaaaacugccacacauc

SEQ ID NO: 9388 - RNA, 19 nt, Artificial Sequence
  Synthetic
ccgaaaacugccacacauc

SEQ ID NO: 9389 - RNA, 20 nt, Artificial Sequence
  Synthetic
uccgaaaacugccacacauc

SEQ ID NO: 9390 - RNA, 21 nt, Artificial Sequence
  Synthetic
auccgaaaacugccacacauc

SEQ ID NO: 9391 - RNA, 22 nt, Artificial Sequence
  Synthetic
cauccgaaaacugccacacauc

SEQ ID NO: 9392 - RNA, 23 nt, Artificial Sequence
  Synthetic
ccauccgaaaacugccacacauc

SEQ ID NO: 9393 - RNA, 24 nt, Artificial Sequence
  Synthetic
uccauccgaaaacugccacacauc

SEQ ID NO: 9394 - RNA, 18 nt, Artificial Sequence
  Synthetic
uuggggucguucucgcuc

SEQ ID NO: 9395 - RNA, 19 nt, Artificial Sequence
  Synthetic
guuggggucguucucgcuc

SEQ ID NO: 9396 - RNA, 20 nt, Artificial Sequence
  Synthetic
gguuggggucguucucgcuc

SEQ ID NO: 9397 - RNA, 21 nt, Artificial Sequence
  Synthetic
agguuggggucguucucgcuc

SEQ ID NO: 9398 - RNA, 22 nt, Artificial Sequence
  Synthetic
cagguuggggucguucucgcuc

SEQ ID NO: 9399 - RNA, 23 nt, Artificial Sequence
  Synthetic
ucagguuggggucguucucgcuc

SEQ ID NO: 9400 - RNA, 24 nt, Artificial Sequence
  Synthetic
aucagguuggggucguucucgcuc

SEQ ID NO: 9401 - RNA, 18 nt, Artificial Sequence
  Synthetic
cucagaacuuaagggcuc

SEQ ID NO: 9402 - RNA, 19 nt, Artificial Sequence
  Synthetic
ucucagaacuuaagggcuc

SEQ ID NO: 9403 - RNA, 20 nt, Artificial Sequence
  Synthetic
uucucagaacuuaagggcuc

SEQ ID NO: 9404 - RNA, 21 nt, Artificial Sequence
  Synthetic
uuucucagaacuuaagggcuc

SEQ ID NO: 9405 - RNA, 22 nt, Artificial Sequence
  Synthetic
uuuucucagaacuuaagggcuc

SEQ ID NO: 9406 - RNA, 23 nt, Artificial Sequence
  Synthetic
auuuucucagaacuuaagggcuc

SEQ ID NO: 9407 - RNA, 24 nt, Artificial Sequence
  Synthetic
aauuuucucagaacuuaagggcuc

SEQ ID NO: 9408 - RNA, 18 nt, Artificial Sequence
  Synthetic
gacauucugcaccuaguc

SEQ ID NO: 9409 - RNA, 19 nt, Artificial Sequence
  Synthetic
ggacauucugcaccuaguc

SEQ ID NO: 9410 - RNA, 20 nt, Artificial Sequence
  Synthetic
aggacauucugcaccuaguc

SEQ ID NO: 9411 - RNA, 21 nt, Artificial Sequence
  Synthetic
aaggacauucugcaccuaguc

SEQ ID NO: 9412 - RNA, 22 nt, Artificial Sequence
  Synthetic
gaaggacauucugcaccuaguc

SEQ ID NO: 9413 - RNA, 23 nt, Artificial Sequence
  Synthetic
ggaaggacauucugcaccuaguc

SEQ ID NO: 9414 - RNA, 24 nt, Artificial Sequence
  Synthetic
gggaaggacauucugcaccuaguc

SEQ ID NO: 9415 - RNA, 18 nt, Artificial Sequence
  Synthetic
ucgucggacuugaccguc

SEQ ID NO: 9416 - RNA, 19 nt, Artificial Sequence
  Synthetic
gucgucggacuugaccguc

SEQ ID NO: 9417 - RNA, 20 nt, Artificial Sequence
  Synthetic
cgucgucggacuugaccguc

SEQ ID NO: 9418 - RNA, 21 nt, Artificial Sequence
  Synthetic
ccgucgucggacuugaccguc

SEQ ID NO: 9419 - RNA, 22 nt, Artificial Sequence
  Synthetic
accgucgucggacuugaccguc

SEQ ID NO: 9420 - RNA, 23 nt, Artificial Sequence
  Synthetic
gaccgucgucggacuugaccguc

SEQ ID NO: 9421 - RNA, 24 nt, Artificial Sequence
  Synthetic
agaccgucgucggacuugaccguc

SEQ ID NO: 9422 - RNA, 18 nt, Artificial Sequence
  Synthetic
auaccaacccgcgggguc

SEQ ID NO: 9423 - RNA, 19 nt, Artificial Sequence
  Synthetic
gauaccaacccgcgggguc

SEQ ID NO: 9424 - RNA, 20 nt, Artificial Sequence
  Synthetic
ggauaccaacccgcgggguc

SEQ ID NO: 9425 - RNA, 21 nt, Artificial Sequence
  Synthetic
gggauaccaacccgcgggguc

SEQ ID NO: 9426 - RNA, 22 nt, Artificial Sequence
  Synthetic
agggauaccaacccgcgggguc

SEQ ID NO: 9427 - RNA, 23 nt, Artificial Sequence
  Synthetic
aagggauaccaacccgcgggguc

SEQ ID NO: 9428 - RNA, 24 nt, Artificial Sequence
  Synthetic
gaagggauaccaacccgcgggguc

SEQ ID NO: 9429 - RNA, 18 nt, Artificial Sequence
  Synthetic
ggcaggucgaacuccuuc

SEQ ID NO: 9430 - RNA, 19 nt, Artificial Sequence
  Synthetic
gggcaggucgaacuccuuc

SEQ ID NO: 9431 - RNA, 20 nt, Artificial Sequence
  Synthetic
ggggcaggucgaacuccuuc

SEQ ID NO: 9432 - RNA, 21 nt, Artificial Sequence
  Synthetic
gggggcaggucgaacuccuuc

SEQ ID NO: 9433 - RNA, 22 nt, Artificial Sequence
  Synthetic
cgggggcaggucgaacuccuuc

SEQ ID NO: 9434 - RNA, 23 nt, Artificial Sequence
  Synthetic
ccgggggcaggucgaacuccuuc

SEQ ID NO: 9435 - RNA, 24 nt, Artificial Sequence
  Synthetic
gccgggggcaggucgaacuccuuc

SEQ ID NO: 9436 - RNA, 18 nt, Artificial Sequence
  Synthetic
gucgcuggugccggguuc

SEQ ID NO: 9437 - RNA, 19 nt, Artificial Sequence
  Synthetic
agucgcuggugccggguuc

SEQ ID NO: 9438 - RNA, 20 nt, Artificial Sequence
  Synthetic
aagucgcuggugccggguuc

SEQ ID NO: 9439 - RNA, 21 nt, Artificial Sequence
  Synthetic
caagucgcuggugccggguuc

SEQ ID NO: 9440 - RNA, 22 nt, Artificial Sequence
  Synthetic
ccaagucgcuggugccggguuc

SEQ ID NO: 9441 - RNA, 23 nt, Artificial Sequence
  Synthetic
accaagucgcuggugccggguuc

SEQ ID NO: 9442 - RNA, 24 nt, Artificial Sequence
  Synthetic
caccaagucgcuggugccggguuc

SEQ ID NO: 9443 - RNA, 18 nt, Artificial Sequence
  Synthetic
cggugguggacuaaacag

SEQ ID NO: 9444 - RNA, 19 nt, Artificial Sequence
  Synthetic
ucggugguggacuaaacag

SEQ ID NO: 9445 - RNA, 20 nt, Artificial Sequence
  Synthetic
cucggugguggacuaaacag

SEQ ID NO: 9446 - RNA, 21 nt, Artificial Sequence
  Synthetic
ucucggugguggacuaaacag

SEQ ID NO: 9447 - RNA, 22 nt, Artificial Sequence
  Synthetic
gucucggugguggacuaaacag

SEQ ID NO: 9448 - RNA, 23 nt, Artificial Sequence
  Synthetic
ugucucggugguggacuaaacag

SEQ ID NO: 9449 - RNA, 24 nt, Artificial Sequence
  Synthetic
augucucggugguggacuaaacag

SEQ ID NO: 9450 - RNA, 18 nt, Artificial Sequence
  Synthetic
gaaagagguuggagacag

SEQ ID NO: 9451 - RNA, 19 nt, Artificial Sequence
  Synthetic
agaaagagguuggagacag

SEQ ID NO: 9452 - RNA, 20 nt, Artificial Sequence
  Synthetic
uagaaagagguuggagacag

SEQ ID NO: 9453 - RNA, 21 nt, Artificial Sequence
  Synthetic
cuagaaagagguuggagacag

SEQ ID NO: 9454 - RNA, 22 nt, Artificial Sequence
  Synthetic
ccuagaaagagguuggagacag

SEQ ID NO: 9455 - RNA, 23 nt, Artificial Sequence
  Synthetic
accuagaaagagguuggagacag

SEQ ID NO: 9456 - RNA, 24 nt, Artificial Sequence
  Synthetic
aaccuagaaagagguuggagacag

SEQ ID NO: 9457 - RNA, 18 nt, Artificial Sequence
  Synthetic
aggaggggcggauugcag

SEQ ID NO: 9458 - RNA, 19 nt, Artificial Sequence
  Synthetic
gaggaggggcggauugcag

SEQ ID NO: 9459 - RNA, 20 nt, Artificial Sequence
  Synthetic
ggaggaggggcggauugcag

SEQ ID NO: 9460 - RNA, 21 nt, Artificial Sequence
  Synthetic
gggaggaggggcggauugcag

SEQ ID NO: 9461 - RNA, 22 nt, Artificial Sequence
  Synthetic
agggaggaggggcggauugcag

SEQ ID NO: 9462 - RNA, 23 nt, Artificial Sequence
  Synthetic
gagggaggaggggcggauugcag

SEQ ID NO: 9463 - RNA, 24 nt, Artificial Sequence
  Synthetic
ggagggaggaggggcggauugcag

SEQ ID NO: 9464 - RNA, 18 nt, Artificial Sequence
  Synthetic
aagagguuggagacagag

SEQ ID NO: 9465 - RNA, 19 nt, Artificial Sequence
  Synthetic
aaagagguuggagacagag

SEQ ID NO: 9466 - RNA, 20 nt, Artificial Sequence
  Synthetic
gaaagagguuggagacagag

SEQ ID NO: 9467 - RNA, 21 nt, Artificial Sequence
  Synthetic
agaaagagguuggagacagag

SEQ ID NO: 9468 - RNA, 22 nt, Artificial Sequence
  Synthetic
uagaaagagguuggagacagag

SEQ ID NO: 9469 - RNA, 23 nt, Artificial Sequence
  Synthetic
cuagaaagagguuggagacagag

SEQ ID NO: 9470 - RNA, 24 nt, Artificial Sequence
  Synthetic
ccuagaaagagguuggagacagag

SEQ ID NO: 9471 - RNA, 18 nt, Artificial Sequence
  Synthetic
gaggggcggauugcagag

SEQ ID NO: 9472 - RNA, 19 nt, Artificial Sequence
  Synthetic
ggaggggcggauugcagag

SEQ ID NO: 9473 - RNA, 20 nt, Artificial Sequence
  Synthetic
aggaggggcggauugcagag

SEQ ID NO: 9474 - RNA, 21 nt, Artificial Sequence
  Synthetic
gaggaggggcggauugcagag

SEQ ID NO: 9475 - RNA, 22 nt, Artificial Sequence
  Synthetic
ggaggaggggcggauugcagag

SEQ ID NO: 9476 - RNA, 23 nt, Artificial Sequence
  Synthetic
gggaggaggggcggauugcagag

SEQ ID NO: 9477 - RNA, 24 nt, Artificial Sequence
  Synthetic
agggaggaggggcggauugcagag

SEQ ID NO: 9478 - RNA, 18 nt, Artificial Sequence
  Synthetic
agcuugaugcgcuuagag

SEQ ID NO: 9479 - RNA, 19 nt, Artificial Sequence
  Synthetic
gagcuugaugcgcuuagag

SEQ ID NO: 9480 - RNA, 20 nt, Artificial Sequence
  Synthetic
cgagcuugaugcgcuuagag

SEQ ID NO: 9481 - RNA, 21 nt, Artificial Sequence
  Synthetic
ucgagcuugaugcgcuuagag

SEQ ID NO: 9482 - RNA, 22 nt, Artificial Sequence
  Synthetic
cucgagcuugaugcgcuuagag

SEQ ID NO: 9483 - RNA, 23 nt, Artificial Sequence
  Synthetic
ucucgagcuugaugcgcuuagag

SEQ ID NO: 9484 - RNA, 24 nt, Artificial Sequence
  Synthetic
uucucgagcuugaugcgcuuagag

SEQ ID NO: 9485 - RNA, 18 nt, Artificial Sequence
  Synthetic
gagaaggggcucagcgag

SEQ ID NO: 9486 - RNA, 19 nt, Artificial Sequence
  Synthetic
agagaaggggcucagcgag

SEQ ID NO: 9487 - RNA, 20 nt, Artificial Sequence
  Synthetic
uagagaaggggcucagcgag

SEQ ID NO: 9488 - RNA, 21 nt, Artificial Sequence
  Synthetic
uuagagaaggggcucagcgag

SEQ ID NO: 9489 - RNA, 22 nt, Artificial Sequence
  Synthetic
cuuagagaaggggcucagcgag

SEQ ID NO: 9490 - RNA, 23 nt, Artificial Sequence
  Synthetic
gcuuagagaaggggcucagcgag

SEQ ID NO: 9491 - RNA, 24 nt, Artificial Sequence
  Synthetic
cgcuuagagaaggggcucagcgag

SEQ ID NO: 9492 - RNA, 18 nt, Artificial Sequence
  Synthetic
ggauugcagaggagggag

SEQ ID NO: 9493 - RNA, 19 nt, Artificial Sequence
  Synthetic
cggauugcagaggagggag

SEQ ID NO: 9494 - RNA, 20 nt, Artificial Sequence
  Synthetic
gcggauugcagaggagggag

SEQ ID NO: 9495 - RNA, 21 nt, Artificial Sequence
  Synthetic
ggcggauugcagaggagggag

SEQ ID NO: 9496 - RNA, 22 nt, Artificial Sequence
  Synthetic
gggcggauugcagaggagggag

SEQ ID NO: 9497 - RNA, 23 nt, Artificial Sequence
  Synthetic
ggggcggauugcagaggagggag

SEQ ID NO: 9498 - RNA, 24 nt, Artificial Sequence
  Synthetic
aggggcggauugcagaggagggag

SEQ ID NO: 9499 - RNA, 18 nt, Artificial Sequence
  Synthetic
ccgggggcugggagggag

SEQ ID NO: 9500 - RNA, 19 nt, Artificial Sequence
  Synthetic
accgggggcugggagggag

SEQ ID NO: 9501 - RNA, 20 nt, Artificial Sequence
  Synthetic
gaccgggggcugggagggag

SEQ ID NO: 9502 - RNA, 21 nt, Artificial Sequence
  Synthetic
ugaccgggggcugggagggag

SEQ ID NO: 9503 - RNA, 22 nt, Artificial Sequence
  Synthetic
uugaccgggggcugggagggag

SEQ ID NO: 9504 - RNA, 23 nt, Artificial Sequence
  Synthetic
cuugaccgggggcugggagggag

SEQ ID NO: 9505 - RNA, 24 nt, Artificial Sequence
  Synthetic
acuugaccgggggcugggagggag

SEQ ID NO: 9506 - RNA, 18 nt, Artificial Sequence
  Synthetic
cugaagugcugcauggag

SEQ ID NO: 9507 - RNA, 19 nt, Artificial Sequence
  Synthetic
gcugaagugcugcauggag

SEQ ID NO: 9508 - RNA, 20 nt, Artificial Sequence
  Synthetic
cgcugaagugcugcauggag

SEQ ID NO: 9509 - RNA, 21 nt, Artificial Sequence
  Synthetic
ucgcugaagugcugcauggag

SEQ ID NO: 9510 - RNA, 22 nt, Artificial Sequence
  Synthetic
cucgcugaagugcugcauggag

SEQ ID NO: 9511 - RNA, 23 nt, Artificial Sequence
  Synthetic
ccucgcugaagugcugcauggag

SEQ ID NO: 9512 - RNA, 24 nt, Artificial Sequence
  Synthetic
gccucgcugaagugcugcauggag

SEQ ID NO: 9513 - RNA, 18 nt, Artificial Sequence
  Synthetic
cgucugcccucuuuugag

SEQ ID NO: 9514 - RNA, 19 nt, Artificial Sequence
  Synthetic
gcgucugcccucuuuugag

SEQ ID NO: 9515 - RNA, 20 nt, Artificial Sequence
  Synthetic
ugcgucugcccucuuuugag

SEQ ID NO: 9516 - RNA, 21 nt, Artificial Sequence
  Synthetic
cugcgucugcccucuuuugag

SEQ ID NO: 9517 - RNA, 22 nt, Artificial Sequence
  Synthetic
gcugcgucugcccucuuuugag

SEQ ID NO: 9518 - RNA, 23 nt, Artificial Sequence
  Synthetic
cgcugcgucugcccucuuuugag

SEQ ID NO: 9519 - RNA, 24 nt, Artificial Sequence
  Synthetic
ucgcugcgucugcccucuuuugag

SEQ ID NO: 9520 - RNA, 18 nt, Artificial Sequence
  Synthetic
ccgaggagugcuccgacg

SEQ ID NO: 9521 - RNA, 19 nt, Artificial Sequence
  Synthetic
uccgaggagugcuccgacg

SEQ ID NO: 9522 - RNA, 20 nt, Artificial Sequence
  Synthetic
cuccgaggagugcuccgacg

SEQ ID NO: 9523 - RNA, 21 nt, Artificial Sequence
  Synthetic
ucuccgaggagugcuccgacg

SEQ ID NO: 9524 - RNA, 22 nt, Artificial Sequence
  Synthetic
uucuccgaggagugcuccgacg

SEQ ID NO: 9525 - RNA, 23 nt, Artificial Sequence
  Synthetic
guucuccgaggagugcuccgacg

SEQ ID NO: 9526 - RNA, 24 nt, Artificial Sequence
  Synthetic
cguucuccgaggagugcuccgacg

SEQ ID NO: 9527 - RNA, 18 nt, Artificial Sequence
  Synthetic
accaugcccugcaugacg

SEQ ID NO: 9528 - RNA, 19 nt, Artificial Sequence
  Synthetic
caccaugcccugcaugacg

SEQ ID NO: 9529 - RNA, 20 nt, Artificial Sequence
  Synthetic
gcaccaugcccugcaugacg

SEQ ID NO: 9530 - RNA, 21 nt, Artificial Sequence
  Synthetic
agcaccaugcccugcaugacg

SEQ ID NO: 9531 - RNA, 22 nt, Artificial Sequence
  Synthetic
gagcaccaugcccugcaugacg

SEQ ID NO: 9532 - RNA, 23 nt, Artificial Sequence
  Synthetic
ugagcaccaugcccugcaugacg

SEQ ID NO: 9533 - RNA, 24 nt, Artificial Sequence
  Synthetic
cugagcaccaugcccugcaugacg

SEQ ID NO: 9534 - RNA, 18 nt, Artificial Sequence
  Synthetic
ccgaggccgacucgcccg

SEQ ID NO: 9535 - RNA, 19 nt, Artificial Sequence
  Synthetic
cccgaggccgacucgcccg

SEQ ID NO: 9536 - RNA, 20 nt, Artificial Sequence
  Synthetic
ccccgaggccgacucgcccg

SEQ ID NO: 9537 - RNA, 21 nt, Artificial Sequence
  Synthetic
cccccgaggccgacucgcccg

SEQ ID NO: 9538 - RNA, 22 nt, Artificial Sequence
  Synthetic
ccccccgaggccgacucgcccg

SEQ ID NO: 9539 - RNA, 23 nt, Artificial Sequence
  Synthetic
gccccccgaggccgacucgcccg

SEQ ID NO: 9540 - RNA, 24 nt, Artificial Sequence
  Synthetic
ggccccccgaggccgacucgcccg

SEQ ID NO: 9541 - RNA, 18 nt, Artificial Sequence
  Synthetic
cuggaggccgcguagccg

SEQ ID NO: 9542 - RNA, 19 nt, Artificial Sequence
  Synthetic
ccuggaggccgcguagccg

SEQ ID NO: 9543 - RNA, 20 nt, Artificial Sequence
  Synthetic
gccuggaggccgcguagccg

SEQ ID NO: 9544 - RNA, 21 nt, Artificial Sequence
  Synthetic
ugccuggaggccgcguagccg

SEQ ID NO: 9545 - RNA, 22 nt, Artificial Sequence
  Synthetic
cugccuggaggccgcguagccg

SEQ ID NO: 9546 - RNA, 23 nt, Artificial Sequence
  Synthetic
gcugccuggaggccgcguagccg

SEQ ID NO: 9547 - RNA, 24 nt, Artificial Sequence
  Synthetic
agcugccuggaggccgcguagccg

SEQ ID NO: 9548 - RNA, 18 nt, Artificial Sequence
  Synthetic
aauuugaacgucuugccg

SEQ ID NO: 9549 - RNA, 19 nt, Artificial Sequence
  Synthetic
aaauuugaacgucuugccg

SEQ ID NO: 9550 - RNA, 20 nt, Artificial Sequence
  Synthetic
gaaauuugaacgucuugccg

SEQ ID NO: 9551 - RNA, 21 nt, Artificial Sequence
  Synthetic
ugaaauuugaacgucuugccg

SEQ ID NO: 9552 - RNA, 22 nt, Artificial Sequence
  Synthetic
cugaaauuugaacgucuugccg

SEQ ID NO: 9553 - RNA, 23 nt, Artificial Sequence
  Synthetic
ucugaaauuugaacgucuugccg

SEQ ID NO: 9554 - RNA, 24 nt, Artificial Sequence
  Synthetic
cucugaaauuugaacgucuugccg

SEQ ID NO: 9555 - RNA, 18 nt, Artificial Sequence
  Synthetic
ucuccgaggagugcuccg

SEQ ID NO: 9556 - RNA, 19 nt, Artificial Sequence
  Synthetic
uucuccgaggagugcuccg

SEQ ID NO: 9557 - RNA, 20 nt, Artificial Sequence
  Synthetic
guucuccgaggagugcuccg

SEQ ID NO: 9558 - RNA, 21 nt, Artificial Sequence
  Synthetic
cguucuccgaggagugcuccg

SEQ ID NO: 9559 - RNA, 22 nt, Artificial Sequence
  Synthetic
ccguucuccgaggagugcuccg

SEQ ID NO: 9560 - RNA, 23 nt, Artificial Sequence
  Synthetic
cccguucuccgaggagugcuccg

SEQ ID NO: 9561 - RNA, 24 nt, Artificial Sequence
  Synthetic
ucccguucuccgaggagugcuccg

SEQ ID NO: 9562 - RNA, 18 nt, Artificial Sequence
  Synthetic
cgcuggugccggguuccg

SEQ ID NO: 9563 - RNA, 19 nt, Artificial Sequence
  Synthetic
ucgcuggugccggguuccg

SEQ ID NO: 9564 - RNA, 20 nt, Artificial Sequence
  Synthetic
gucgcuggugccggguuccg

SEQ ID NO: 9565 - RNA, 21 nt, Artificial Sequence
  Synthetic
agucgcuggugccggguuccg

SEQ ID NO: 9566 - RNA, 22 nt, Artificial Sequence
  Synthetic
aagucgcuggugccggguuccg

SEQ ID NO: 9567 - RNA, 23 nt, Artificial Sequence
  Synthetic
caagucgcuggugccggguuccg

SEQ ID NO: 9568 - RNA, 24 nt, Artificial Sequence
  Synthetic
ccaagucgcuggugccggguuccg

SEQ ID NO: 9569 - RNA, 18 nt, Artificial Sequence
  Synthetic
gccggccuggggacagcg

SEQ ID NO: 9570 - RNA, 19 nt, Artificial Sequence
  Synthetic
ggccggccuggggacagcg

SEQ ID NO: 9571 - RNA, 20 nt, Artificial Sequence
  Synthetic
gggccggccuggggacagcg

SEQ ID NO: 9572 - RNA, 21 nt, Artificial Sequence
  Synthetic
ugggccggccuggggacagcg

SEQ ID NO: 9573 - RNA, 22 nt, Artificial Sequence
  Synthetic
cugggccggccuggggacagcg

SEQ ID NO: 9574 - RNA, 23 nt, Artificial Sequence
  Synthetic
gcugggccggccuggggacagcg

SEQ ID NO: 9575 - RNA, 24 nt, Artificial Sequence
  Synthetic
ggcugggccggccuggggacagcg

SEQ ID NO: 9576 - RNA, 18 nt, Artificial Sequence
  Synthetic
gguuccggggagcuggcg

SEQ ID NO: 9577 - RNA, 19 nt, Artificial Sequence
  Synthetic
ggguuccggggagcuggcg

SEQ ID NO: 9578 - RNA, 20 nt, Artificial Sequence
  Synthetic
cggguuccggggagcuggcg

SEQ ID NO: 9579 - RNA, 21 nt, Artificial Sequence
  Synthetic
ccggguuccggggagcuggcg

SEQ ID NO: 9580 - RNA, 22 nt, Artificial Sequence
  Synthetic
gccggguuccggggagcuggcg

SEQ ID NO: 9581 - RNA, 23 nt, Artificial Sequence
  Synthetic
ugccggguuccggggagcuggcg

SEQ ID NO: 9582 - RNA, 24 nt, Artificial Sequence
  Synthetic
gugccggguuccggggagcuggcg

SEQ ID NO: 9583 - RNA, 18 nt, Artificial Sequence
  Synthetic
ccccaggcgcucuaugcg

SEQ ID NO: 9584 - RNA, 19 nt, Artificial Sequence
  Synthetic
cccccaggcgcucuaugcg

SEQ ID NO: 9585 - RNA, 20 nt, Artificial Sequence
  Synthetic
gcccccaggcgcucuaugcg

SEQ ID NO: 9586 - RNA, 21 nt, Artificial Sequence
  Synthetic
cgcccccaggcgcucuaugcg

SEQ ID NO: 9587 - RNA, 22 nt, Artificial Sequence
  Synthetic
ccgcccccaggcgcucuaugcg

SEQ ID NO: 9588 - RNA, 23 nt, Artificial Sequence
  Synthetic
uccgcccccaggcgcucuaugcg

SEQ ID NO: 9589 - RNA, 24 nt, Artificial Sequence
  Synthetic
uuccgcccccaggcgcucuaugcg

SEQ ID NO: 9590 - RNA, 18 nt, Artificial Sequence
  Synthetic
accugguggaaggccucg

SEQ ID NO: 9591 - RNA, 19 nt, Artificial Sequence
  Synthetic
gaccugguggaaggccucg

SEQ ID NO: 9592 - RNA, 20 nt, Artificial Sequence
  Synthetic
ggaccugguggaaggccucg

SEQ ID NO: 9593 - RNA, 21 nt, Artificial Sequence
  Synthetic
aggaccugguggaaggccucg

SEQ ID NO: 9594 - RNA, 22 nt, Artificial Sequence
  Synthetic
caggaccugguggaaggccucg

SEQ ID NO: 9595 - RNA, 23 nt, Artificial Sequence
  Synthetic
ccaggaccugguggaaggccucg

SEQ ID NO: 9596 - RNA, 24 nt, Artificial Sequence
  Synthetic
cccaggaccugguggaaggccucg

SEQ ID NO: 9597 - RNA, 18 nt, Artificial Sequence
  Synthetic
gcgguggagagaccgucg

SEQ ID NO: 9598 - RNA, 19 nt, Artificial Sequence
  Synthetic
ggcgguggagagaccgucg

SEQ ID NO: 9599 - RNA, 20 nt, Artificial Sequence
  Synthetic
uggcgguggagagaccgucg

SEQ ID NO: 9600 - RNA, 21 nt, Artificial Sequence
  Synthetic
cuggcgguggagagaccgucg

SEQ ID NO: 9601 - RNA, 22 nt, Artificial Sequence
  Synthetic
gcuggcgguggagagaccgucg

SEQ ID NO: 9602 - RNA, 23 nt, Artificial Sequence
  Synthetic
agcuggcgguggagagaccgucg

SEQ ID NO: 9603 - RNA, 24 nt, Artificial Sequence
  Synthetic
gagcuggcgguggagagaccgucg

SEQ ID NO: 9604 - RNA, 18 nt, Artificial Sequence
  Synthetic
gagucuccgaagcuaagg

SEQ ID NO: 9605 - RNA, 19 nt, Artificial Sequence
  Synthetic
ggagucuccgaagcuaagg

SEQ ID NO: 9606 - RNA, 20 nt, Artificial Sequence
  Synthetic
uggagucuccgaagcuaagg

SEQ ID NO: 9607 - RNA, 21 nt, Artificial Sequence
  Synthetic
cuggagucuccgaagcuaagg

SEQ ID NO: 9608 - RNA, 22 nt, Artificial Sequence
  Synthetic
ucuggagucuccgaagcuaagg

SEQ ID NO: 9609 - RNA, 23 nt, Artificial Sequence
  Synthetic
gucuggagucuccgaagcuaagg

SEQ ID NO: 9610 - RNA, 24 nt, Artificial Sequence
  Synthetic
ugucuggagucuccgaagcuaagg

SEQ ID NO: 9611 - RNA, 18 nt, Artificial Sequence
  Synthetic
ggugguggacuaaacagg

SEQ ID NO: 9612 - RNA, 19 nt, Artificial Sequence
  Synthetic
cggugguggacuaaacagg

SEQ ID NO: 9613 - RNA, 20 nt, Artificial Sequence
  Synthetic
ucggugguggacuaaacagg

SEQ ID NO: 9614 - RNA, 21 nt, Artificial Sequence
  Synthetic
cucggugguggacuaaacagg

SEQ ID NO: 9615 - RNA, 22 nt, Artificial Sequence
  Synthetic
ucucggugguggacuaaacagg

SEQ ID NO: 9616 - RNA, 23 nt, Artificial Sequence
  Synthetic
gucucggugguggacuaaacagg

SEQ ID NO: 9617 - RNA, 24 nt, Artificial Sequence
  Synthetic
ugucucggugguggacuaaacagg

SEQ ID NO: 9618 - RNA, 18 nt, Artificial Sequence
  Synthetic
agggggggcgucgccagg

SEQ ID NO: 9619 - RNA, 19 nt, Artificial Sequence
  Synthetic
gagggggggcgucgccagg

SEQ ID NO: 9620 - RNA, 20 nt, Artificial Sequence
  Synthetic
ggagggggggcgucgccagg

SEQ ID NO: 9621 - RNA, 21 nt, Artificial Sequence
  Synthetic
gggagggggggcgucgccagg

SEQ ID NO: 9622 - RNA, 22 nt, Artificial Sequence
  Synthetic
agggagggggggcgucgccagg

SEQ ID NO: 9623 - RNA, 23 nt, Artificial Sequence
  Synthetic
gagggagggggggcgucgccagg

SEQ ID NO: 9624 - RNA, 24 nt, Artificial Sequence
  Synthetic
ggagggagggggggcgucgccagg

SEQ ID NO: 9625 - RNA, 18 nt, Artificial Sequence
  Synthetic
aagcgcccuucugccagg

SEQ ID NO: 9626 - RNA, 19 nt, Artificial Sequence
  Synthetic
aaagcgcccuucugccagg

SEQ ID NO: 9627 - RNA, 20 nt, Artificial Sequence
  Synthetic
gaaagcgcccuucugccagg

SEQ ID NO: 9628 - RNA, 21 nt, Artificial Sequence
  Synthetic
ggaaagcgcccuucugccagg

SEQ ID NO: 9629 - RNA, 22 nt, Artificial Sequence
  Synthetic
uggaaagcgcccuucugccagg

SEQ ID NO: 9630 - RNA, 23 nt, Artificial Sequence
  Synthetic
guggaaagcgcccuucugccagg

SEQ ID NO: 9631 - RNA, 24 nt, Artificial Sequence
  Synthetic
gguggaaagcgcccuucugccagg

SEQ ID NO: 9632 - RNA, 18 nt, Artificial Sequence
  Synthetic
aucgcggccgggggcagg

SEQ ID NO: 9633 - RNA, 19 nt, Artificial Sequence
  Synthetic
caucgcggccgggggcagg

SEQ ID NO: 9634 - RNA, 20 nt, Artificial Sequence
  Synthetic
gcaucgcggccgggggcagg

SEQ ID NO: 9635 - RNA, 21 nt, Artificial Sequence
  Synthetic
ggcaucgcggccgggggcagg

SEQ ID NO: 9636 - RNA, 22 nt, Artificial Sequence
  Synthetic
gggcaucgcggccgggggcagg

SEQ ID NO: 9637 - RNA, 23 nt, Artificial Sequence
  Synthetic
ugggcaucgcggccgggggcagg

SEQ ID NO: 9638 - RNA, 24 nt, Artificial Sequence
  Synthetic
uugggcaucgcggccgggggcagg

SEQ ID NO: 9639 - RNA, 18 nt, Artificial Sequence
  Synthetic
ccguucuccgggaucagg

SEQ ID NO: 9640 - RNA, 19 nt, Artificial Sequence
  Synthetic
cccguucuccgggaucagg

SEQ ID NO: 9641 - RNA, 20 nt, Artificial Sequence
  Synthetic
ccccguucuccgggaucagg

SEQ ID NO: 9642 - RNA, 21 nt, Artificial Sequence
  Synthetic
uccccguucuccgggaucagg

SEQ ID NO: 9643 - RNA, 22 nt, Artificial Sequence
  Synthetic
guccccguucuccgggaucagg

SEQ ID NO: 9644 - RNA, 23 nt, Artificial Sequence
  Synthetic
cguccccguucuccgggaucagg

SEQ ID NO: 9645 - RNA, 24 nt, Artificial Sequence
  Synthetic
ucguccccguucuccgggaucagg

SEQ ID NO: 9646 - RNA, 18 nt, Artificial Sequence
  Synthetic
gaagaaccuagaaagagg

SEQ ID NO: 9647 - RNA, 19 nt, Artificial Sequence
  Synthetic
ugaagaaccuagaaagagg

SEQ ID NO: 9648 - RNA, 20 nt, Artificial Sequence
  Synthetic
gugaagaaccuagaaagagg

SEQ ID NO: 9649 - RNA, 21 nt, Artificial Sequence
  Synthetic
ugugaagaaccuagaaagagg

SEQ ID NO: 9650 - RNA, 22 nt, Artificial Sequence
  Synthetic
gugugaagaaccuagaaagagg

SEQ ID NO: 9651 - RNA, 23 nt, Artificial Sequence
  Synthetic
ugugugaagaaccuagaaagagg

SEQ ID NO: 9652 - RNA, 24 nt, Artificial Sequence
  Synthetic
gugugugaagaaccuagaaagagg

SEQ ID NO: 9653 - RNA, 18 nt, Artificial Sequence
  Synthetic
agagguuggagacagagg

SEQ ID NO: 9654 - RNA, 19 nt, Artificial Sequence
  Synthetic
aagagguuggagacagagg

SEQ ID NO: 9655 - RNA, 20 nt, Artificial Sequence
  Synthetic
aaagagguuggagacagagg

SEQ ID NO: 9656 - RNA, 21 nt, Artificial Sequence
  Synthetic
gaaagagguuggagacagagg

SEQ ID NO: 9657 - RNA, 22 nt, Artificial Sequence
  Synthetic
agaaagagguuggagacagagg

SEQ ID NO: 9658 - RNA, 23 nt, Artificial Sequence
  Synthetic
uagaaagagguuggagacagagg

SEQ ID NO: 9659 - RNA, 24 nt, Artificial Sequence
  Synthetic
cuagaaagagguuggagacagagg

SEQ ID NO: 9660 - RNA, 18 nt, Artificial Sequence
  Synthetic
aggggcggauugcagagg

SEQ ID NO: 9661 - RNA, 19 nt, Artificial Sequence
  Synthetic
gaggggcggauugcagagg

SEQ ID NO: 9662 - RNA, 20 nt, Artificial Sequence
  Synthetic
ggaggggcggauugcagagg

SEQ ID NO: 9663 - RNA, 21 nt, Artificial Sequence
  Synthetic
aggaggggcggauugcagagg

SEQ ID NO: 9664 - RNA, 22 nt, Artificial Sequence
  Synthetic
gaggaggggcggauugcagagg

SEQ ID NO: 9665 - RNA, 23 nt, Artificial Sequence
  Synthetic
ggaggaggggcggauugcagagg

SEQ ID NO: 9666 - RNA, 24 nt, Artificial Sequence
  Synthetic
gggaggaggggcggauugcagagg

SEQ ID NO: 9667 - RNA, 18 nt, Artificial Sequence
  Synthetic
ggcggauugcagaggagg

SEQ ID NO: 9668 - RNA, 19 nt, Artificial Sequence
  Synthetic
gggcggauugcagaggagg

SEQ ID NO: 9669 - RNA, 20 nt, Artificial Sequence
  Synthetic
ggggcggauugcagaggagg

SEQ ID NO: 9670 - RNA, 21 nt, Artificial Sequence
  Synthetic
aggggcggauugcagaggagg

SEQ ID NO: 9671 - RNA, 22 nt, Artificial Sequence
  Synthetic
gaggggcggauugcagaggagg

SEQ ID NO: 9672 - RNA, 23 nt, Artificial Sequence
  Synthetic
ggaggggcggauugcagaggagg

SEQ ID NO: 9673 - RNA, 24 nt, Artificial Sequence
  Synthetic
aggaggggcggauugcagaggagg

SEQ ID NO: 9674 - RNA, 18 nt, Artificial Sequence
  Synthetic
gauugcagaggagggagg

SEQ ID NO: 9675 - RNA, 19 nt, Artificial Sequence
  Synthetic
ggauugcagaggagggagg

SEQ ID NO: 9676 - RNA, 20 nt, Artificial Sequence
  Synthetic
cggauugcagaggagggagg

SEQ ID NO: 9677 - RNA, 21 nt, Artificial Sequence
  Synthetic
gcggauugcagaggagggagg

SEQ ID NO: 9678 - RNA, 22 nt, Artificial Sequence
  Synthetic
ggcggauugcagaggagggagg

SEQ ID NO: 9679 - RNA, 23 nt, Artificial Sequence
  Synthetic
gggcggauugcagaggagggagg

SEQ ID NO: 9680 - RNA, 24 nt, Artificial Sequence
  Synthetic
ggggcggauugcagaggagggagg

SEQ ID NO: 9681 - RNA, 18 nt, Artificial Sequence
  Synthetic
cgggggcugggagggagg

SEQ ID NO: 9682 - RNA, 19 nt, Artificial Sequence
  Synthetic
ccgggggcugggagggagg

SEQ ID NO: 9683 - RNA, 20 nt, Artificial Sequence
  Synthetic
accgggggcugggagggagg

SEQ ID NO: 9684 - RNA, 21 nt, Artificial Sequence
  Synthetic
gaccgggggcugggagggagg

SEQ ID NO: 9685 - RNA, 22 nt, Artificial Sequence
  Synthetic
ugaccgggggcugggagggagg

SEQ ID NO: 9686 - RNA, 23 nt, Artificial Sequence
  Synthetic
uugaccgggggcugggagggagg

SEQ ID NO: 9687 - RNA, 24 nt, Artificial Sequence
  Synthetic
cuugaccgggggcugggagggagg

SEQ ID NO: 9688 - RNA, 18 nt, Artificial Sequence
  Synthetic
ugaccgggggcugggagg

SEQ ID NO: 9689 - RNA, 19 nt, Artificial Sequence
  Synthetic
uugaccgggggcugggagg

SEQ ID NO: 9690 - RNA, 20 nt, Artificial Sequence
  Synthetic
cuugaccgggggcugggagg

SEQ ID NO: 9691 - RNA, 21 nt, Artificial Sequence
  Synthetic
acuugaccgggggcugggagg

SEQ ID NO: 9692 - RNA, 22 nt, Artificial Sequence
  Synthetic
gacuugaccgggggcugggagg

SEQ ID NO: 9693 - RNA, 23 nt, Artificial Sequence
  Synthetic
ggacuugaccgggggcugggagg

SEQ ID NO: 9694 - RNA, 24 nt, Artificial Sequence
  Synthetic
uggacuugaccgggggcugggagg

SEQ ID NO: 9695 - RNA, 18 nt, Artificial Sequence
  Synthetic
ccguguugggcaucgcgg

SEQ ID NO: 9696 - RNA, 19 nt, Artificial Sequence
  Synthetic
uccguguugggcaucgcgg

SEQ ID NO: 9697 - RNA, 20 nt, Artificial Sequence
  Synthetic
cuccguguugggcaucgcgg

SEQ ID NO: 9698 - RNA, 21 nt, Artificial Sequence
  Synthetic
ucuccguguugggcaucgcgg

SEQ ID NO: 9699 - RNA, 22 nt, Artificial Sequence
  Synthetic
uucuccguguugggcaucgcgg

SEQ ID NO: 9700 - RNA, 23 nt, Artificial Sequence
  Synthetic
guucuccguguugggcaucgcgg

SEQ ID NO: 9701 - RNA, 24 nt, Artificial Sequence
  Synthetic
cguucuccguguugggcaucgcgg

SEQ ID NO: 9702 - RNA, 18 nt, Artificial Sequence
  Synthetic
guuccggggagcuggcgg

SEQ ID NO: 9703 - RNA, 19 nt, Artificial Sequence
  Synthetic
gguuccggggagcuggcgg

SEQ ID NO: 9704 - RNA, 20 nt, Artificial Sequence
  Synthetic
ggguuccggggagcuggcgg

SEQ ID NO: 9705 - RNA, 21 nt, Artificial Sequence
  Synthetic
cggguuccggggagcuggcgg

SEQ ID NO: 9706 - RNA, 22 nt, Artificial Sequence
  Synthetic
ccggguuccggggagcuggcgg

SEQ ID NO: 9707 - RNA, 23 nt, Artificial Sequence
  Synthetic
gccggguuccggggagcuggcgg

SEQ ID NO: 9708 - RNA, 24 nt, Artificial Sequence
  Synthetic
ugccggguuccggggagcuggcgg

SEQ ID NO: 9709 - RNA, 18 nt, Artificial Sequence
  Synthetic
cccaggcgcucuaugcgg

SEQ ID NO: 9710 - RNA, 19 nt, Artificial Sequence
  Synthetic
ccccaggcgcucuaugcgg

SEQ ID NO: 9711 - RNA, 20 nt, Artificial Sequence
  Synthetic
cccccaggcgcucuaugcgg

SEQ ID NO: 9712 - RNA, 21 nt, Artificial Sequence
  Synthetic
gcccccaggcgcucuaugcgg

SEQ ID NO: 9713 - RNA, 22 nt, Artificial Sequence
  Synthetic
cgcccccaggcgcucuaugcgg

SEQ ID NO: 9714 - RNA, 23 nt, Artificial Sequence
  Synthetic
ccgcccccaggcgcucuaugcgg

SEQ ID NO: 9715 - RNA, 24 nt, Artificial Sequence
  Synthetic
uccgcccccaggcgcucuaugcgg

SEQ ID NO: 9716 - RNA, 18 nt, Artificial Sequence
  Synthetic
gugguggacuaaacaggg

SEQ ID NO: 9717 - RNA, 19 nt, Artificial Sequence
  Synthetic
ggugguggacuaaacaggg

SEQ ID NO: 9718 - RNA, 20 nt, Artificial Sequence
  Synthetic
cggugguggacuaaacaggg

SEQ ID NO: 9719 - RNA, 21 nt, Artificial Sequence
  Synthetic
ucggugguggacuaaacaggg

SEQ ID NO: 9720 - RNA, 22 nt, Artificial Sequence
  Synthetic
cucggugguggacuaaacaggg

SEQ ID NO: 9721 - RNA, 23 nt, Artificial Sequence
  Synthetic
ucucggugguggacuaaacaggg

SEQ ID NO: 9722 - RNA, 24 nt, Artificial Sequence
  Synthetic
gucucggugguggacuaaacaggg

SEQ ID NO: 9723 - RNA, 18 nt, Artificial Sequence
  Synthetic
gcggauugcagaggaggg

SEQ ID NO: 9724 - RNA, 19 nt, Artificial Sequence
  Synthetic
ggcggauugcagaggaggg

SEQ ID NO: 9725 - RNA, 20 nt, Artificial Sequence
  Synthetic
gggcggauugcagaggaggg

SEQ ID NO: 9726 - RNA, 21 nt, Artificial Sequence
  Synthetic
ggggcggauugcagaggaggg

SEQ ID NO: 9727 - RNA, 22 nt, Artificial Sequence
  Synthetic
aggggcggauugcagaggaggg

SEQ ID NO: 9728 - RNA, 23 nt, Artificial Sequence
  Synthetic
gaggggcggauugcagaggaggg

SEQ ID NO: 9729 - RNA, 24 nt, Artificial Sequence
  Synthetic
ggaggggcggauugcagaggaggg

SEQ ID NO: 9730 - RNA, 18 nt, Artificial Sequence
  Synthetic
gaccgggggcugggaggg

SEQ ID NO: 9731 - RNA, 19 nt, Artificial Sequence
  Synthetic
ugaccgggggcugggaggg

SEQ ID NO: 9732 - RNA, 20 nt, Artificial Sequence
  Synthetic
uugaccgggggcugggaggg

SEQ ID NO: 9733 - RNA, 21 nt, Artificial Sequence
  Synthetic
cuugaccgggggcugggaggg

SEQ ID NO: 9734 - RNA, 22 nt, Artificial Sequence
  Synthetic
acuugaccgggggcugggaggg

SEQ ID NO: 9735 - RNA, 23 nt, Artificial Sequence
  Synthetic
gacuugaccgggggcugggaggg

SEQ ID NO: 9736 - RNA, 24 nt, Artificial Sequence
  Synthetic
ggacuugaccgggggcugggaggg

SEQ ID NO: 9737 - RNA, 18 nt, Artificial Sequence
  Synthetic
aguaaccuuugcauaggg

SEQ ID NO: 9738 - RNA, 19 nt, Artificial Sequence
  Synthetic
caguaaccuuugcauaggg

SEQ ID NO: 9739 - RNA, 20 nt, Artificial Sequence
  Synthetic
gcaguaaccuuugcauaggg

SEQ ID NO: 9740 - RNA, 21 nt, Artificial Sequence
  Synthetic
ugcaguaaccuuugcauaggg

SEQ ID NO: 9741 - RNA, 22 nt, Artificial Sequence
  Synthetic
uugcaguaaccuuugcauaggg

SEQ ID NO: 9742 - RNA, 23 nt, Artificial Sequence
  Synthetic
guugcaguaaccuuugcauaggg

SEQ ID NO: 9743 - RNA, 24 nt, Artificial Sequence
  Synthetic
gguugcaguaaccuuugcauaggg

SEQ ID NO: 9744 - RNA, 18 nt, Artificial Sequence
  Synthetic
gcccugcaugacgucggg

SEQ ID NO: 9745 - RNA, 19 nt, Artificial Sequence
  Synthetic
ugcccugcaugacgucggg

SEQ ID NO: 9746 - RNA, 20 nt, Artificial Sequence
  Synthetic
augcccugcaugacgucggg

SEQ ID NO: 9747 - RNA, 21 nt, Artificial Sequence
  Synthetic
caugcccugcaugacgucggg

SEQ ID NO: 9748 - RNA, 22 nt, Artificial Sequence
  Synthetic
ccaugcccugcaugacgucggg

SEQ ID NO: 9749 - RNA, 23 nt, Artificial Sequence
  Synthetic
accaugcccugcaugacgucggg

SEQ ID NO: 9750 - RNA, 24 nt, Artificial Sequence
  Synthetic
caccaugcccugcaugacgucggg

SEQ ID NO: 9751 - RNA, 18 nt, Artificial Sequence
  Synthetic
cuuggacuugaccggggg

SEQ ID NO: 9752 - RNA, 19 nt, Artificial Sequence
  Synthetic
acuuggacuugaccggggg

SEQ ID NO: 9753 - RNA, 20 nt, Artificial Sequence
  Synthetic
gacuuggacuugaccggggg

SEQ ID NO: 9754 - RNA, 21 nt, Artificial Sequence
  Synthetic
ugacuuggacuugaccggggg

SEQ ID NO: 9755 - RNA, 22 nt, Artificial Sequence
  Synthetic
augacuuggacuugaccggggg

SEQ ID NO: 9756 - RNA, 23 nt, Artificial Sequence
  Synthetic
caugacuuggacuugaccggggg

SEQ ID NO: 9757 - RNA, 24 nt, Artificial Sequence
  Synthetic
gcaugacuuggacuugaccggggg

SEQ ID NO: 9758 - RNA, 18 nt, Artificial Sequence
  Synthetic
acuugaccgggggcuggg

SEQ ID NO: 9759 - RNA, 19 nt, Artificial Sequence
  Synthetic
gacuugaccgggggcuggg

SEQ ID NO: 9760 - RNA, 20 nt, Artificial Sequence
  Synthetic
ggacuugaccgggggcuggg

SEQ ID NO: 9761 - RNA, 21 nt, Artificial Sequence
  Synthetic
uggacuugaccgggggcuggg

SEQ ID NO: 9762 - RNA, 22 nt, Artificial Sequence
  Synthetic
uuggacuugaccgggggcuggg

SEQ ID NO: 9763 - RNA, 23 nt, Artificial Sequence
  Synthetic
cuuggacuugaccgggggcuggg

SEQ ID NO: 9764 - RNA, 24 nt, Artificial Sequence
  Synthetic
acuuggacuugaccgggggcuggg

SEQ ID NO: 9765 - RNA, 18 nt, Artificial Sequence
  Synthetic
cauggagagguggcuggg

SEQ ID NO: 9766 - RNA, 19 nt, Artificial Sequence
  Synthetic
ccauggagagguggcuggg

SEQ ID NO: 9767 - RNA, 20 nt, Artificial Sequence
  Synthetic
cccauggagagguggcuggg

SEQ ID NO: 9768 - RNA, 21 nt, Artificial Sequence
  Synthetic
ucccauggagagguggcuggg

SEQ ID NO: 9769 - RNA, 22 nt, Artificial Sequence
  Synthetic
aucccauggagagguggcuggg

SEQ ID NO: 9770 - RNA, 23 nt, Artificial Sequence
  Synthetic
aaucccauggagagguggcuggg

SEQ ID NO: 9771 - RNA, 24 nt, Artificial Sequence
  Synthetic
gaaucccauggagagguggcuggg

SEQ ID NO: 9772 - RNA, 18 nt, Artificial Sequence
  Synthetic
aaacagggggggaguggg

SEQ ID NO: 9773 - RNA, 19 nt, Artificial Sequence
  Synthetic
uaaacagggggggaguggg

SEQ ID NO: 9774 - RNA, 20 nt, Artificial Sequence
  Synthetic
cuaaacagggggggaguggg

SEQ ID NO: 9775 - RNA, 21 nt, Artificial Sequence
  Synthetic
acuaaacagggggggaguggg

SEQ ID NO: 9776 - RNA, 22 nt, Artificial Sequence
  Synthetic
gacuaaacagggggggaguggg

SEQ ID NO: 9777 - RNA, 23 nt, Artificial Sequence
  Synthetic
ggacuaaacagggggggaguggg

SEQ ID NO: 9778 - RNA, 24 nt, Artificial Sequence
  Synthetic
uggacuaaacagggggggaguggg

SEQ ID NO: 9779 - RNA, 18 nt, Artificial Sequence
  Synthetic
uccuagagaaauccaugg

SEQ ID NO: 9780 - RNA, 19 nt, Artificial Sequence
  Synthetic
cuccuagagaaauccaugg

SEQ ID NO: 9781 - RNA, 20 nt, Artificial Sequence
  Synthetic
ucuccuagagaaauccaugg

SEQ ID NO: 9782 - RNA, 21 nt, Artificial Sequence
  Synthetic
gucuccuagagaaauccaugg

SEQ ID NO: 9783 - RNA, 22 nt, Artificial Sequence
  Synthetic
agucuccuagagaaauccaugg

SEQ ID NO: 9784 - RNA, 23 nt, Artificial Sequence
  Synthetic
aagucuccuagagaaauccaugg

SEQ ID NO: 9785 - RNA, 24 nt, Artificial Sequence
  Synthetic
uaagucuccuagagaaauccaugg

SEQ ID NO: 9786 - RNA, 18 nt, Artificial Sequence
  Synthetic
uucucgcccaggaccugg

SEQ ID NO: 9787 - RNA, 19 nt, Artificial Sequence
  Synthetic
cuucucgcccaggaccugg

SEQ ID NO: 9788 - RNA, 20 nt, Artificial Sequence
  Synthetic
gcuucucgcccaggaccugg

SEQ ID NO: 9789 - RNA, 21 nt, Artificial Sequence
  Synthetic
ugcuucucgcccaggaccugg

SEQ ID NO: 9790 - RNA, 22 nt, Artificial Sequence
  Synthetic
augcuucucgcccaggaccugg

SEQ ID NO: 9791 - RNA, 23 nt, Artificial Sequence
  Synthetic
uaugcuucucgcccaggaccugg

SEQ ID NO: 9792 - RNA, 24 nt, Artificial Sequence
  Synthetic
uuaugcuucucgcccaggaccugg

SEQ ID NO: 9793 - RNA, 18 nt, Artificial Sequence
  Synthetic
gggcggcuugcuaccugg

SEQ ID NO: 9794 - RNA, 19 nt, Artificial Sequence
  Synthetic
agggcggcuugcuaccugg

SEQ ID NO: 9795 - RNA, 20 nt, Artificial Sequence
  Synthetic
aagggcggcuugcuaccugg

SEQ ID NO: 9796 - RNA, 21 nt, Artificial Sequence
  Synthetic
gaagggcggcuugcuaccugg

SEQ ID NO: 9797 - RNA, 22 nt, Artificial Sequence
  Synthetic
ggaagggcggcuugcuaccugg

SEQ ID NO: 9798 - RNA, 23 nt, Artificial Sequence
  Synthetic
aggaagggcggcuugcuaccugg

SEQ ID NO: 9799 - RNA, 24 nt, Artificial Sequence
  Synthetic
caggaagggcggcuugcuaccugg

SEQ ID NO: 9800 - RNA, 18 nt, Artificial Sequence
  Synthetic
gacuugaccgggggcugg

SEQ ID NO: 9801 - RNA, 19 nt, Artificial Sequence
  Synthetic
ggacuugaccgggggcugg

SEQ ID NO: 9802 - RNA, 20 nt, Artificial Sequence
  Synthetic
uggacuugaccgggggcugg

SEQ ID NO: 9803 - RNA, 21 nt, Artificial Sequence
  Synthetic
uuggacuugaccgggggcugg

SEQ ID NO: 9804 - RNA, 22 nt, Artificial Sequence
  Synthetic
cuuggacuugaccgggggcugg

SEQ ID NO: 9805 - RNA, 23 nt, Artificial Sequence
  Synthetic
acuuggacuugaccgggggcugg

SEQ ID NO: 9806 - RNA, 24 nt, Artificial Sequence
  Synthetic
gacuuggacuugaccgggggcugg

SEQ ID NO: 9807 - RNA, 18 nt, Artificial Sequence
  Synthetic
uaaacagggggggagugg

SEQ ID NO: 9808 - RNA, 19 nt, Artificial Sequence
  Synthetic
cuaaacagggggggagugg

SEQ ID NO: 9809 - RNA, 20 nt, Artificial Sequence
  Synthetic
acuaaacagggggggagugg

SEQ ID NO: 9810 - RNA, 21 nt, Artificial Sequence
  Synthetic
gacuaaacagggggggagugg

SEQ ID NO: 9811 - RNA, 22 nt, Artificial Sequence
  Synthetic
ggacuaaacagggggggagugg

SEQ ID NO: 9812 - RNA, 23 nt, Artificial Sequence
  Synthetic
uggacuaaacagggggggagugg

SEQ ID NO: 9813 - RNA, 24 nt, Artificial Sequence
  Synthetic
guggacuaaacagggggggagugg

SEQ ID NO: 9814 - RNA, 18 nt, Artificial Sequence
  Synthetic
aaucccauggagaggugg

SEQ ID NO: 9815 - RNA, 19 nt, Artificial Sequence
  Synthetic
gaaucccauggagaggugg

SEQ ID NO: 9816 - RNA, 20 nt, Artificial Sequence
  Synthetic
ugaaucccauggagaggugg

SEQ ID NO: 9817 - RNA, 21 nt, Artificial Sequence
  Synthetic
augaaucccauggagaggugg

SEQ ID NO: 9818 - RNA, 22 nt, Artificial Sequence
  Synthetic
uaugaaucccauggagaggugg

SEQ ID NO: 9819 - RNA, 23 nt, Artificial Sequence
  Synthetic
auaugaaucccauggagaggugg

SEQ ID NO: 9820 - RNA, 24 nt, Artificial Sequence
  Synthetic
aauaugaaucccauggagaggugg

SEQ ID NO: 9821 - RNA, 18 nt, Artificial Sequence
  Synthetic
ugcaauaugaaucccaug

SEQ ID NO: 9822 - RNA, 19 nt, Artificial Sequence
  Synthetic
cugcaauaugaaucccaug

SEQ ID NO: 9823 - RNA, 20 nt, Artificial Sequence
  Synthetic
ucugcaauaugaaucccaug

SEQ ID NO: 9824 - RNA, 21 nt, Artificial Sequence
  Synthetic
gucugcaauaugaaucccaug

SEQ ID NO: 9825 - RNA, 22 nt, Artificial Sequence
  Synthetic
ugucugcaauaugaaucccaug

SEQ ID NO: 9826 - RNA, 23 nt, Artificial Sequence
  Synthetic
uugucugcaauaugaaucccaug

SEQ ID NO: 9827 - RNA, 24 nt, Artificial Sequence
  Synthetic
auugucugcaauaugaaucccaug

SEQ ID NO: 9828 - RNA, 18 nt, Artificial Sequence
  Synthetic
cuccuagagaaauccaug

SEQ ID NO: 9829 - RNA, 19 nt, Artificial Sequence
  Synthetic
ucuccuagagaaauccaug

SEQ ID NO: 9830 - RNA, 20 nt, Artificial Sequence
  Synthetic
gucuccuagagaaauccaug

SEQ ID NO: 9831 - RNA, 21 nt, Artificial Sequence
  Synthetic
agucuccuagagaaauccaug

SEQ ID NO: 9832 - RNA, 22 nt, Artificial Sequence
  Synthetic
aagucuccuagagaaauccaug

SEQ ID NO: 9833 - RNA, 23 nt, Artificial Sequence
  Synthetic
uaagucuccuagagaaauccaug

SEQ ID NO: 9834 - RNA, 24 nt, Artificial Sequence
  Synthetic
cuaagucuccuagagaaauccaug

SEQ ID NO: 9835 - RNA, 18 nt, Artificial Sequence
  Synthetic
ucggacuugaccgucaug

SEQ ID NO: 9836 - RNA, 19 nt, Artificial Sequence
  Synthetic
gucggacuugaccgucaug

SEQ ID NO: 9837 - RNA, 20 nt, Artificial Sequence
  Synthetic
cgucggacuugaccgucaug

SEQ ID NO: 9838 - RNA, 21 nt, Artificial Sequence
  Synthetic
ucgucggacuugaccgucaug

SEQ ID NO: 9839 - RNA, 22 nt, Artificial Sequence
  Synthetic
gucgucggacuugaccgucaug

SEQ ID NO: 9840 - RNA, 23 nt, Artificial Sequence
  Synthetic
cgucgucggacuugaccgucaug

SEQ ID NO: 9841 - RNA, 24 nt, Artificial Sequence
  Synthetic
ccgucgucggacuugaccgucaug

SEQ ID NO: 9842 - RNA, 18 nt, Artificial Sequence
  Synthetic
cuucucgcccaggaccug

SEQ ID NO: 9843 - RNA, 19 nt, Artificial Sequence
  Synthetic
gcuucucgcccaggaccug

SEQ ID NO: 9844 - RNA, 20 nt, Artificial Sequence
  Synthetic
ugcuucucgcccaggaccug

SEQ ID NO: 9845 - RNA, 21 nt, Artificial Sequence
  Synthetic
augcuucucgcccaggaccug

SEQ ID NO: 9846 - RNA, 22 nt, Artificial Sequence
  Synthetic
uaugcuucucgcccaggaccug

SEQ ID NO: 9847 - RNA, 23 nt, Artificial Sequence
  Synthetic
uuaugcuucucgcccaggaccug

SEQ ID NO: 9848 - RNA, 24 nt, Artificial Sequence
  Synthetic
cuuaugcuucucgcccaggaccug

SEQ ID NO: 9849 - RNA, 18 nt, Artificial Sequence
  Synthetic
auucugcaccuaguccug

SEQ ID NO: 9850 - RNA, 19 nt, Artificial Sequence
  Synthetic
cauucugcaccuaguccug

SEQ ID NO: 9851 - RNA, 20 nt, Artificial Sequence
  Synthetic
acauucugcaccuaguccug

SEQ ID NO: 9852 - RNA, 21 nt, Artificial Sequence
  Synthetic
gacauucugcaccuaguccug

SEQ ID NO: 9853 - RNA, 22 nt, Artificial Sequence
  Synthetic
ggacauucugcaccuaguccug

SEQ ID NO: 9854 - RNA, 23 nt, Artificial Sequence
  Synthetic
aggacauucugcaccuaguccug

SEQ ID NO: 9855 - RNA, 24 nt, Artificial Sequence
  Synthetic
aaggacauucugcaccuaguccug

SEQ ID NO: 9856 - RNA, 18 nt, Artificial Sequence
  Synthetic
guuguacauguguagcug

SEQ ID NO: 9857 - RNA, 19 nt, Artificial Sequence
  Synthetic
aguuguacauguguagcug

SEQ ID NO: 9858 - RNA, 20 nt, Artificial Sequence
  Synthetic
aaguuguacauguguagcug

SEQ ID NO: 9859 - RNA, 21 nt, Artificial Sequence
  Synthetic
caaguuguacauguguagcug

SEQ ID NO: 9860 - RNA, 22 nt, Artificial Sequence
  Synthetic
gcaaguuguacauguguagcug

SEQ ID NO: 9861 - RNA, 23 nt, Artificial Sequence
  Synthetic
ugcaaguuguacauguguagcug

SEQ ID NO: 9862 - RNA, 24 nt, Artificial Sequence
  Synthetic
uugcaaguuguacauguguagcug

SEQ ID NO: 9863 - RNA, 18 nt, Artificial Sequence
  Synthetic
gaguacacguucuccgug

SEQ ID NO: 9864 - RNA, 19 nt, Artificial Sequence
  Synthetic
cgaguacacguucuccgug

SEQ ID NO: 9865 - RNA, 20 nt, Artificial Sequence
  Synthetic
gcgaguacacguucuccgug

SEQ ID NO: 9866 - RNA, 21 nt, Artificial Sequence
  Synthetic
ugcgaguacacguucuccgug

SEQ ID NO: 9867 - RNA, 22 nt, Artificial Sequence
  Synthetic
cugcgaguacacguucuccgug

SEQ ID NO: 9868 - RNA, 23 nt, Artificial Sequence
  Synthetic
acugcgaguacacguucuccgug

SEQ ID NO: 9869 - RNA, 24 nt, Artificial Sequence
  Synthetic
cacugcgaguacacguucuccgug

SEQ ID NO: 9870 - RNA, 18 nt, Artificial Sequence
  Synthetic
ccagcuccccgggcggug

SEQ ID NO: 9871 - RNA, 19 nt, Artificial Sequence
  Synthetic
uccagcuccccgggcggug

SEQ ID NO: 9872 - RNA, 20 nt, Artificial Sequence
  Synthetic
guccagcuccccgggcggug

SEQ ID NO: 9873 - RNA, 21 nt, Artificial Sequence
  Synthetic
cguccagcuccccgggcggug

SEQ ID NO: 9874 - RNA, 22 nt, Artificial Sequence
  Synthetic
ccguccagcuccccgggcggug

SEQ ID NO: 9875 - RNA, 23 nt, Artificial Sequence
  Synthetic
uccguccagcuccccgggcggug

SEQ ID NO: 9876 - RNA, 24 nt, Artificial Sequence
  Synthetic
cuccguccagcuccccgggcggug

SEQ ID NO: 9877 - RNA, 18 nt, Artificial Sequence
  Synthetic
uccggggagcuggcggug

SEQ ID NO: 9878 - RNA, 19 nt, Artificial Sequence
  Synthetic
uuccggggagcuggcggug

SEQ ID NO: 9879 - RNA, 20 nt, Artificial Sequence
  Synthetic
guuccggggagcuggcggug

SEQ ID NO: 9880 - RNA, 21 nt, Artificial Sequence
  Synthetic
gguuccggggagcuggcggug

SEQ ID NO: 9881 - RNA, 22 nt, Artificial Sequence
  Synthetic
ggguuccggggagcuggcggug

SEQ ID NO: 9882 - RNA, 23 nt, Artificial Sequence
  Synthetic
cggguuccggggagcuggcggug

SEQ ID NO: 9883 - RNA, 24 nt, Artificial Sequence
  Synthetic
ccggguuccggggagcuggcggug

SEQ ID NO: 9884 - RNA, 18 nt, Artificial Sequence
  Synthetic
ccaagugaugucucggug

SEQ ID NO: 9885 - RNA, 19 nt, Artificial Sequence
  Synthetic
uccaagugaugucucggug

SEQ ID NO: 9886 - RNA, 20 nt, Artificial Sequence
  Synthetic
guccaagugaugucucggug

SEQ ID NO: 9887 - RNA, 21 nt, Artificial Sequence
  Synthetic
gguccaagugaugucucggug

SEQ ID NO: 9888 - RNA, 22 nt, Artificial Sequence
  Synthetic
ggguccaagugaugucucggug

SEQ ID NO: 9889 - RNA, 23 nt, Artificial Sequence
  Synthetic
gggguccaagugaugucucggug

SEQ ID NO: 9890 - RNA, 24 nt, Artificial Sequence
  Synthetic
ggggguccaagugaugucucggug

SEQ ID NO: 9891 - RNA, 18 nt, Artificial Sequence
  Synthetic
agcuccccgggcggugug

SEQ ID NO: 9892 - RNA, 19 nt, Artificial Sequence
  Synthetic
cagcuccccgggcggugug

SEQ ID NO: 9893 - RNA, 20 nt, Artificial Sequence
  Synthetic
ccagcuccccgggcggugug

SEQ ID NO: 9894 - RNA, 21 nt, Artificial Sequence
  Synthetic
uccagcuccccgggcggugug

SEQ ID NO: 9895 - RNA, 22 nt, Artificial Sequence
  Synthetic
guccagcuccccgggcggugug

SEQ ID NO: 9896 - RNA, 23 nt, Artificial Sequence
  Synthetic
cguccagcuccccgggcggugug

SEQ ID NO: 9897 - RNA, 24 nt, Artificial Sequence
  Synthetic
ccguccagcuccccgggcggugug

SEQ ID NO: 9898 - RNA, 18 nt, Artificial Sequence
  Synthetic
gccgaaugggggugugug

SEQ ID NO: 9899 - RNA, 19 nt, Artificial Sequence
  Synthetic
cgccgaaugggggugugug

SEQ ID NO: 9900 - RNA, 20 nt, Artificial Sequence
  Synthetic
acgccgaaugggggugugug

SEQ ID NO: 9901 - RNA, 21 nt, Artificial Sequence
  Synthetic
uacgccgaaugggggugugug

SEQ ID NO: 9902 - RNA, 22 nt, Artificial Sequence
  Synthetic
cuacgccgaaugggggugugug

SEQ ID NO: 9903 - RNA, 23 nt, Artificial Sequence
  Synthetic
acuacgccgaaugggggugugug

SEQ ID NO: 9904 - RNA, 24 nt, Artificial Sequence
  Synthetic
uacuacgccgaaugggggugugug

SEQ ID NO: 9905 - RNA, 18 nt, Artificial Sequence
  Synthetic
gggaggaggggcggauug

SEQ ID NO: 9906 - RNA, 19 nt, Artificial Sequence
  Synthetic
agggaggaggggcggauug

SEQ ID NO: 9907 - RNA, 20 nt, Artificial Sequence
  Synthetic
gagggaggaggggcggauug

SEQ ID NO: 9908 - RNA, 21 nt, Artificial Sequence
  Synthetic
ggagggaggaggggcggauug

SEQ ID NO: 9909 - RNA, 22 nt, Artificial Sequence
  Synthetic
gggagggaggaggggcggauug

SEQ ID NO: 9910 - RNA, 23 nt, Artificial Sequence
  Synthetic
ugggagggaggaggggcggauug

SEQ ID NO: 9911 - RNA, 24 nt, Artificial Sequence
  Synthetic
cugggagggaggaggggcggauug

SEQ ID NO: 9912 - RNA, 18 nt, Artificial Sequence
  Synthetic
ucgcacagguugcacuug

SEQ ID NO: 9913 - RNA, 19 nt, Artificial Sequence
  Synthetic
gucgcacagguugcacuug

SEQ ID NO: 9914 - RNA, 20 nt, Artificial Sequence
  Synthetic
ggucgcacagguugcacuug

SEQ ID NO: 9915 - RNA, 21 nt, Artificial Sequence
  Synthetic
uggucgcacagguugcacuug

SEQ ID NO: 9916 - RNA, 22 nt, Artificial Sequence
  Synthetic
guggucgcacagguugcacuug

SEQ ID NO: 9917 - RNA, 23 nt, Artificial Sequence
  Synthetic
cguggucgcacagguugcacuug

SEQ ID NO: 9918 - RNA, 24 nt, Artificial Sequence
  Synthetic
gcguggucgcacagguugcacuug

SEQ ID NO: 9919 - RNA, 18 nt, Artificial Sequence
  Synthetic
accagguugcucugaaau

SEQ ID NO: 9920 - RNA, 19 nt, Artificial Sequence
  Synthetic
caccagguugcucugaaau

SEQ ID NO: 9921 - RNA, 20 nt, Artificial Sequence
  Synthetic
ccaccagguugcucugaaau

SEQ ID NO: 9922 - RNA, 21 nt, Artificial Sequence
  Synthetic
accaccagguugcucugaaau

SEQ ID NO: 9923 - RNA, 22 nt, Artificial Sequence
  Synthetic
caccaccagguugcucugaaau

SEQ ID NO: 9924 - RNA, 23 nt, Artificial Sequence
  Synthetic
gcaccaccagguugcucugaaau

SEQ ID NO: 9925 - RNA, 24 nt, Artificial Sequence
  Synthetic
ugcaccaccagguugcucugaaau

SEQ ID NO: 9926 - RNA, 18 nt, Artificial Sequence
  Synthetic
cgggcccggaccacuaau

SEQ ID NO: 9927 - RNA, 19 nt, Artificial Sequence
  Synthetic
ccgggcccggaccacuaau

SEQ ID NO: 9928 - RNA, 20 nt, Artificial Sequence
  Synthetic
cccgggcccggaccacuaau

SEQ ID NO: 9929 - RNA, 21 nt, Artificial Sequence
  Synthetic
gcccgggcccggaccacuaau

SEQ ID NO: 9930 - RNA, 22 nt, Artificial Sequence
  Synthetic
ugcccgggcccggaccacuaau

SEQ ID NO: 9931 - RNA, 23 nt, Artificial Sequence
  Synthetic
cugcccgggcccggaccacuaau

SEQ ID NO: 9932 - RNA, 24 nt, Artificial Sequence
  Synthetic
ccugcccgggcccggaccacuaau

SEQ ID NO: 9933 - RNA, 18 nt, Artificial Sequence
  Synthetic
gggcucucgagcuuccau

SEQ ID NO: 9934 - RNA, 19 nt, Artificial Sequence
  Synthetic
agggcucucgagcuuccau

SEQ ID NO: 9935 - RNA, 20 nt, Artificial Sequence
  Synthetic
aagggcucucgagcuuccau

SEQ ID NO: 9936 - RNA, 21 nt, Artificial Sequence
  Synthetic
uaagggcucucgagcuuccau

SEQ ID NO: 9937 - RNA, 22 nt, Artificial Sequence
  Synthetic
uuaagggcucucgagcuuccau

SEQ ID NO: 9938 - RNA, 23 nt, Artificial Sequence
  Synthetic
cuuaagggcucucgagcuuccau

SEQ ID NO: 9939 - RNA, 24 nt, Artificial Sequence
  Synthetic
acuuaagggcucucgagcuuccau

SEQ ID NO: 9940 - RNA, 18 nt, Artificial Sequence
  Synthetic
gucggacuugaccgucau

SEQ ID NO: 9941 - RNA, 19 nt, Artificial Sequence
  Synthetic
cgucggacuugaccgucau

SEQ ID NO: 9942 - RNA, 20 nt, Artificial Sequence
  Synthetic
ucgucggacuugaccgucau

SEQ ID NO: 9943 - RNA, 21 nt, Artificial Sequence
  Synthetic
gucgucggacuugaccgucau

SEQ ID NO: 9944 - RNA, 22 nt, Artificial Sequence
  Synthetic
cgucgucggacuugaccgucau

SEQ ID NO: 9945 - RNA, 23 nt, Artificial Sequence
  Synthetic
ccgucgucggacuugaccgucau

SEQ ID NO: 9946 - RNA, 24 nt, Artificial Sequence
  Synthetic
accgucgucggacuugaccgucau

SEQ ID NO: 9947 - RNA, 18 nt, Artificial Sequence
  Synthetic
auagggcugggccggccu

SEQ ID NO: 9948 - RNA, 19 nt, Artificial Sequence
  Synthetic
cauagggcugggccggccu

SEQ ID NO: 9949 - RNA, 20 nt, Artificial Sequence
  Synthetic
gcauagggcugggccggccu

SEQ ID NO: 9950 - RNA, 21 nt, Artificial Sequence
  Synthetic
ugcauagggcugggccggccu

SEQ ID NO: 9951 - RNA, 22 nt, Artificial Sequence
  Synthetic
uugcauagggcugggccggccu

SEQ ID NO: 9952 - RNA, 23 nt, Artificial Sequence
  Synthetic
uuugcauagggcugggccggccu

SEQ ID NO: 9953 - RNA, 24 nt, Artificial Sequence
  Synthetic
cuuugcauagggcugggccggccu

SEQ ID NO: 9954 - RNA, 18 nt, Artificial Sequence
  Synthetic
ucuggagucuccgaagcu

SEQ ID NO: 9955 - RNA, 19 nt, Artificial Sequence
  Synthetic
gucuggagucuccgaagcu

SEQ ID NO: 9956 - RNA, 20 nt, Artificial Sequence
  Synthetic
ugucuggagucuccgaagcu

SEQ ID NO: 9957 - RNA, 21 nt, Artificial Sequence
  Synthetic
uugucuggagucuccgaagcu

SEQ ID NO: 9958 - RNA, 22 nt, Artificial Sequence
  Synthetic
auugucuggagucuccgaagcu

SEQ ID NO: 9959 - RNA, 23 nt, Artificial Sequence
  Synthetic
gauugucuggagucuccgaagcu

SEQ ID NO: 9960 - RNA, 24 nt, Artificial Sequence
  Synthetic
cgauugucuggagucuccgaagcu

SEQ ID NO: 9961 - RNA, 18 nt, Artificial Sequence
  Synthetic
ucucgagcuugaugcgcu

SEQ ID NO: 9962 - RNA, 19 nt, Artificial Sequence
  Synthetic
uucucgagcuugaugcgcu

SEQ ID NO: 9963 - RNA, 20 nt, Artificial Sequence
  Synthetic
cuucucgagcuugaugcgcu

SEQ ID NO: 9964 - RNA, 21 nt, Artificial Sequence
  Synthetic
ccuucucgagcuugaugcgcu

SEQ ID NO: 9965 - RNA, 22 nt, Artificial Sequence
  Synthetic
uccuucucgagcuugaugcgcu

SEQ ID NO: 9966 - RNA, 23 nt, Artificial Sequence
  Synthetic
cuccuucucgagcuugaugcgcu

SEQ ID NO: 9967 - RNA, 24 nt, Artificial Sequence
  Synthetic
acuccuucucgagcuugaugcgcu

SEQ ID NO: 9968 - RNA, 18 nt, Artificial Sequence
  Synthetic
uggacuugaccgggggcu

SEQ ID NO: 9969 - RNA, 19 nt, Artificial Sequence
  Synthetic
uuggacuugaccgggggcu

SEQ ID NO: 9970 - RNA, 20 nt, Artificial Sequence
  Synthetic
cuuggacuugaccgggggcu

SEQ ID NO: 9971 - RNA, 21 nt, Artificial Sequence
  Synthetic
acuuggacuugaccgggggcu

SEQ ID NO: 9972 - RNA, 22 nt, Artificial Sequence
  Synthetic
gacuuggacuugaccgggggcu

SEQ ID NO: 9973 - RNA, 23 nt, Artificial Sequence
  Synthetic
ugacuuggacuugaccgggggcu

SEQ ID NO: 9974 - RNA, 24 nt, Artificial Sequence
  Synthetic
augacuuggacuugaccgggggcu

SEQ ID NO: 9975 - RNA, 18 nt, Artificial Sequence
  Synthetic
ucccauggagagguggcu

SEQ ID NO: 9976 - RNA, 19 nt, Artificial Sequence
  Synthetic
aucccauggagagguggcu

SEQ ID NO: 9977 - RNA, 20 nt, Artificial Sequence
  Synthetic
aaucccauggagagguggcu

SEQ ID NO: 9978 - RNA, 21 nt, Artificial Sequence
  Synthetic
gaaucccauggagagguggcu

SEQ ID NO: 9979 - RNA, 22 nt, Artificial Sequence
  Synthetic
ugaaucccauggagagguggcu

SEQ ID NO: 9980 - RNA, 23 nt, Artificial Sequence
  Synthetic
augaaucccauggagagguggcu

SEQ ID NO: 9981 - RNA, 24 nt, Artificial Sequence
  Synthetic
uaugaaucccauggagagguggcu

SEQ ID NO: 9982 - RNA, 18 nt, Artificial Sequence
  Synthetic
gugcaccaccagguugcu

SEQ ID NO: 9983 - RNA, 19 nt, Artificial Sequence
  Synthetic
ggugcaccaccagguugcu

SEQ ID NO: 9984 - RNA, 20 nt, Artificial Sequence
  Synthetic
cggugcaccaccagguugcu

SEQ ID NO: 9985 - RNA, 21 nt, Artificial Sequence
  Synthetic
ccggugcaccaccagguugcu

SEQ ID NO: 9986 - RNA, 22 nt, Artificial Sequence
  Synthetic
gccggugcaccaccagguugcu

SEQ ID NO: 9987 - RNA, 23 nt, Artificial Sequence
  Synthetic
cgccggugcaccaccagguugcu

SEQ ID NO: 9988 - RNA, 24 nt, Artificial Sequence
  Synthetic
gcgccggugcaccaccagguugcu

SEQ ID NO: 9989 - RNA, 18 nt, Artificial Sequence
  Synthetic
aagcuaaggaagggaucu

SEQ ID NO: 9990 - RNA, 19 nt, Artificial Sequence
  Synthetic
gaagcuaaggaagggaucu

SEQ ID NO: 9991 - RNA, 20 nt, Artificial Sequence
  Synthetic
cgaagcuaaggaagggaucu

SEQ ID NO: 9992 - RNA, 21 nt, Artificial Sequence
  Synthetic
ccgaagcuaaggaagggaucu

SEQ ID NO: 9993 - RNA, 22 nt, Artificial Sequence
  Synthetic
uccgaagcuaaggaagggaucu

SEQ ID NO: 9994 - RNA, 23 nt, Artificial Sequence
  Synthetic
cuccgaagcuaaggaagggaucu

SEQ ID NO: 9995 - RNA, 24 nt, Artificial Sequence
  Synthetic
ucuccgaagcuaaggaagggaucu

SEQ ID NO: 9996 - RNA, 18 nt, Artificial Sequence
  Synthetic
ggcgauugucuggagucu

SEQ ID NO: 9997 - RNA, 19 nt, Artificial Sequence
  Synthetic
aggcgauugucuggagucu

SEQ ID NO: 9998 - RNA, 20 nt, Artificial Sequence
  Synthetic
aaggcgauugucuggagucu

SEQ ID NO: 9999 - RNA, 21 nt, Artificial Sequence
  Synthetic
aaaggcgauugucuggagucu

SEQ ID NO: 10000 - RNA, 22 nt, Artificial Sequence
  Synthetic
aaaaggcgauugucuggagucu

SEQ ID NO: 10001 - RNA, 23 nt, Artificial Sequence
  Synthetic
caaaaggcgauugucuggagucu

SEQ ID NO: 10002 - RNA, 24 nt, Artificial Sequence
  Synthetic
gcaaaaggcgauugucuggagucu

SEQ ID NO: 10003 - RNA, 18 nt, Artificial Sequence
  Synthetic
ccuccucguccccguucu

SEQ ID NO: 10004 - RNA, 19 nt, Artificial Sequence
  Synthetic
uccuccucguccccguucu

SEQ ID NO: 10005 - RNA, 20 nt, Artificial Sequence
  Synthetic
uuccuccucguccccguucu

SEQ ID NO: 10006 - RNA, 21 nt, Artificial Sequence
  Synthetic
cuuccuccucguccccguucu

SEQ ID NO: 10007 - RNA, 22 nt, Artificial Sequence
  Synthetic
ucuuccuccucguccccguucu

SEQ ID NO: 10008 - RNA, 23 nt, Artificial Sequence
  Synthetic
cucuuccuccucguccccguucu

SEQ ID NO: 10009 - RNA, 24 nt, Artificial Sequence
  Synthetic
ccucuuccuccucguccccguucu

SEQ ID NO: 10010 - RNA, 18 nt, Artificial Sequence
  Synthetic
agcgcaaacucccguucu

SEQ ID NO: 10011 - RNA, 19 nt, Artificial Sequence
  Synthetic
aagcgcaaacucccguucu

SEQ ID NO: 10012 - RNA, 20 nt, Artificial Sequence
  Synthetic
gaagcgcaaacucccguucu

SEQ ID NO: 10013 - RNA, 21 nt, Artificial Sequence
  Synthetic
agaagcgcaaacucccguucu

SEQ ID NO: 10014 - RNA, 22 nt, Artificial Sequence
  Synthetic
gagaagcgcaaacucccguucu

SEQ ID NO: 10015 - RNA, 23 nt, Artificial Sequence
  Synthetic
ggagaagcgcaaacucccguucu

SEQ ID NO: 10016 - RNA, 24 nt, Artificial Sequence
  Synthetic
uggagaagcgcaaacucccguucu

SEQ ID NO: 10017 - RNA, 18 nt, Artificial Sequence
  Synthetic
gggggcuucaaauuuucu

SEQ ID NO: 10018 - RNA, 19 nt, Artificial Sequence
  Synthetic
ugggggcuucaaauuuucu

SEQ ID NO: 10019 - RNA, 20 nt, Artificial Sequence
  Synthetic
cugggggcuucaaauuuucu

SEQ ID NO: 10020 - RNA, 21 nt, Artificial Sequence
  Synthetic
ccugggggcuucaaauuuucu

SEQ ID NO: 10021 - RNA, 22 nt, Artificial Sequence
  Synthetic
cccugggggcuucaaauuuucu

SEQ ID NO: 10022 - RNA, 23 nt, Artificial Sequence
  Synthetic
ccccugggggcuucaaauuuucu

SEQ ID NO: 10023 - RNA, 24 nt, Artificial Sequence
  Synthetic
accccugggggcuucaaauuuucu

SEQ ID NO: 10024 - RNA, 18 nt, Artificial Sequence
  Synthetic
aagaaccuagaaagaggu

SEQ ID NO: 10025 - RNA, 19 nt, Artificial Sequence
  Synthetic
gaagaaccuagaaagaggu

SEQ ID NO: 10026 - RNA, 20 nt, Artificial Sequence
  Synthetic
ugaagaaccuagaaagaggu

SEQ ID NO: 10027 - RNA, 21 nt, Artificial Sequence
  Synthetic
gugaagaaccuagaaagaggu

SEQ ID NO: 10028 - RNA, 22 nt, Artificial Sequence
  Synthetic
ugugaagaaccuagaaagaggu

SEQ ID NO: 10029 - RNA, 23 nt, Artificial Sequence
  Synthetic
gugugaagaaccuagaaagaggu

SEQ ID NO: 10030 - RNA, 24 nt, Artificial Sequence
  Synthetic
ugugugaagaaccuagaaagaggu

SEQ ID NO: 10031 - RNA, 18 nt, Artificial Sequence
  Synthetic
uccagcuccccgggcggu

SEQ ID NO: 10032 - RNA, 19 nt, Artificial Sequence
  Synthetic
guccagcuccccgggcggu

SEQ ID NO: 10033 - RNA, 20 nt, Artificial Sequence
  Synthetic
cguccagcuccccgggcggu

SEQ ID NO: 10034 - RNA, 21 nt, Artificial Sequence
  Synthetic
ccguccagcuccccgggcggu

SEQ ID NO: 10035 - RNA, 22 nt, Artificial Sequence
  Synthetic
uccguccagcuccccgggcggu

SEQ ID NO: 10036 - RNA, 23 nt, Artificial Sequence
  Synthetic
cuccguccagcuccccgggcggu

SEQ ID NO: 10037 - RNA, 24 nt, Artificial Sequence
  Synthetic
ccuccguccagcuccccgggcggu

SEQ ID NO: 10038 - RNA, 18 nt, Artificial Sequence
  Synthetic
gauaccaacccgcggggu

SEQ ID NO: 10039 - RNA, 19 nt, Artificial Sequence
  Synthetic
ggauaccaacccgcggggu

SEQ ID NO: 10040 - RNA, 20 nt, Artificial Sequence
  Synthetic
gggauaccaacccgcggggu

SEQ ID NO: 10041 - RNA, 21 nt, Artificial Sequence
  Synthetic
agggauaccaacccgcggggu

SEQ ID NO: 10042 - RNA, 22 nt, Artificial Sequence
  Synthetic
aagggauaccaacccgcggggu

SEQ ID NO: 10043 - RNA, 23 nt, Artificial Sequence
  Synthetic
gaagggauaccaacccgcggggu

SEQ ID NO: 10044 - RNA, 24 nt, Artificial Sequence
  Synthetic
ugaagggauaccaacccgcggggu

SEQ ID NO: 10045 - RNA, 18 nt, Artificial Sequence
  Synthetic
uacgccgaaugggggugu

SEQ ID NO: 10046 - RNA, 19 nt, Artificial Sequence
  Synthetic
cuacgccgaaugggggugu

SEQ ID NO: 10047 - RNA, 20 nt, Artificial Sequence
  Synthetic
acuacgccgaaugggggugu

SEQ ID NO: 10048 - RNA, 21 nt, Artificial Sequence
  Synthetic
uacuacgccgaaugggggugu

SEQ ID NO: 10049 - RNA, 22 nt, Artificial Sequence
  Synthetic
guacuacgccgaaugggggugu

SEQ ID NO: 10050 - RNA, 23 nt, Artificial Sequence
  Synthetic
gguacuacgccgaaugggggugu

SEQ ID NO: 10051 - RNA, 24 nt, Artificial Sequence
  Synthetic
ggguacuacgccgaaugggggugu

SEQ ID NO: 10052 - RNA, 18 nt, Artificial Sequence
  Synthetic
gaggcaaaaggcgauugu

SEQ ID NO: 10053 - RNA, 19 nt, Artificial Sequence
  Synthetic
ggaggcaaaaggcgauugu

SEQ ID NO: 10054 - RNA, 20 nt, Artificial Sequence
  Synthetic
aggaggcaaaaggcgauugu

SEQ ID NO: 10055 - RNA, 21 nt, Artificial Sequence
  Synthetic
gaggaggcaaaaggcgauugu

SEQ ID NO: 10056 - RNA, 22 nt, Artificial Sequence
  Synthetic
cgaggaggcaaaaggcgauugu

SEQ ID NO: 10057 - RNA, 23 nt, Artificial Sequence
  Synthetic
acgaggaggcaaaaggcgauugu

SEQ ID NO: 10058 - RNA, 24 nt, Artificial Sequence
  Synthetic
gacgaggaggcaaaaggcgauugu

SEQ ID NO: 10059 - RNA, 18 nt, Artificial Sequence
  Synthetic
caaauuuucucagaacuu

SEQ ID NO: 10060 - RNA, 19 nt, Artificial Sequence
  Synthetic
ucaaauuuucucagaacuu

SEQ ID NO: 10061 - RNA, 20 nt, Artificial Sequence
  Synthetic
uucaaauuuucucagaacuu

SEQ ID NO: 10062 - RNA, 21 nt, Artificial Sequence
  Synthetic
cuucaaauuuucucagaacuu

SEQ ID NO: 10063 - RNA, 22 nt, Artificial Sequence
  Synthetic
gcuucaaauuuucucagaacuu

SEQ ID NO: 10064 - RNA, 23 nt, Artificial Sequence
  Synthetic
ggcuucaaauuuucucagaacuu

SEQ ID NO: 10065 - RNA, 24 nt, Artificial Sequence
  Synthetic
gggcuucaaauuuucucagaacuu

SEQ ID NO: 10066 - RNA, 18 nt, Artificial Sequence
  Synthetic
cgcugcgucugcccucuu

SEQ ID NO: 10067 - RNA, 19 nt, Artificial Sequence
  Synthetic
ucgcugcgucugcccucuu

SEQ ID NO: 10068 - RNA, 20 nt, Artificial Sequence
  Synthetic
gucgcugcgucugcccucuu

SEQ ID NO: 10069 - RNA, 21 nt, Artificial Sequence
  Synthetic
ugucgcugcgucugcccucuu

SEQ ID NO: 10070 - RNA, 22 nt, Artificial Sequence
  Synthetic
gugucgcugcgucugcccucuu

SEQ ID NO: 10071 - RNA, 23 nt, Artificial Sequence
  Synthetic
agugucgcugcgucugcccucuu

SEQ ID NO: 10072 - RNA, 24 nt, Artificial Sequence
  Synthetic
aagugucgcugcgucugcccucuu

SEQ ID NO: 10073 - RNA, 18 nt, Artificial Sequence
  Synthetic
agucgcuggugccggguu

SEQ ID NO: 10074 - RNA, 19 nt, Artificial Sequence
  Synthetic
aagucgcuggugccggguu

SEQ ID NO: 10075 - RNA, 20 nt, Artificial Sequence
  Synthetic
caagucgcuggugccggguu

SEQ ID NO: 10076 - RNA, 21 nt, Artificial Sequence
  Synthetic
ccaagucgcuggugccggguu

SEQ ID NO: 10077 - RNA, 22 nt, Artificial Sequence
  Synthetic
accaagucgcuggugccggguu

SEQ ID NO: 10078 - RNA, 23 nt, Artificial Sequence
  Synthetic
caccaagucgcuggugccggguu

SEQ ID NO: 10079 - RNA, 24 nt, Artificial Sequence
  Synthetic
ccaccaagucgcuggugccggguu

SEQ ID NO: 10080 - RNA, 18 nt, Artificial Sequence
  Synthetic
cugcccagcagcagcuuu

SEQ ID NO: 10081 - RNA, 19 nt, Artificial Sequence
  Synthetic
gcugcccagcagcagcuuu

SEQ ID NO: 10082 - RNA, 20 nt, Artificial Sequence
  Synthetic
ggcugcccagcagcagcuuu

SEQ ID NO: 10083 - RNA, 21 nt, Artificial Sequence
  Synthetic
gggcugcccagcagcagcuuu

SEQ ID NO: 10084 - RNA, 22 nt, Artificial Sequence
  Synthetic
ggggcugcccagcagcagcuuu

SEQ ID NO: 10085 - RNA, 23 nt, Artificial Sequence
  Synthetic
uggggcugcccagcagcagcuuu

SEQ ID NO: 10086 - RNA, 24 nt, Artificial Sequence
  Synthetic
cuggggcugcccagcagcagcuuu

SEQ ID NO: 10087 - RNA, 18 nt, Artificial Sequence
  Synthetic
ggcaggcccagcucaaaa

SEQ ID NO: 10088 - RNA, 19 nt, Artificial Sequence
  Synthetic
gggcaggcccagcucaaaa

SEQ ID NO: 10089 - RNA, 20 nt, Artificial Sequence
  Synthetic
cgggcaggcccagcucaaaa

SEQ ID NO: 10090 - RNA, 21 nt, Artificial Sequence
  Synthetic
ccgggcaggcccagcucaaaa

SEQ ID NO: 10091 - RNA, 22 nt, Artificial Sequence
  Synthetic
cccgggcaggcccagcucaaaa

SEQ ID NO: 10092 - RNA, 23 nt, Artificial Sequence
  Synthetic
gcccgggcaggcccagcucaaaa

SEQ ID NO: 10093 - RNA, 24 nt, Artificial Sequence
  Synthetic
ggcccgggcaggcccagcucaaaa

SEQ ID NO: 10094 - RNA, 18 nt, Artificial Sequence
  Synthetic
uaagaaucuacuuagaaa

SEQ ID NO: 10095 - RNA, 19 nt, Artificial Sequence
  Synthetic
uuaagaaucuacuuagaaa

SEQ ID NO: 10096 - RNA, 20 nt, Artificial Sequence
  Synthetic
auuaagaaucuacuuagaaa

SEQ ID NO: 10097 - RNA, 21 nt, Artificial Sequence
  Synthetic
gauuaagaaucuacuuagaaa

SEQ ID NO: 10098 - RNA, 22 nt, Artificial Sequence
  Synthetic
ggauuaagaaucuacuuagaaa

SEQ ID NO: 10099 - RNA, 23 nt, Artificial Sequence
  Synthetic
uggauuaagaaucuacuuagaaa

SEQ ID NO: 10100 - RNA, 24 nt, Artificial Sequence
  Synthetic
auggauuaagaaucuacuuagaaa

SEQ ID NO: 10101 - RNA, 18 nt, Artificial Sequence
  Synthetic
cgggcaggcccagcucaa

SEQ ID NO: 10102 - RNA, 19 nt, Artificial Sequence
  Synthetic
ccgggcaggcccagcucaa

SEQ ID NO: 10103 - RNA, 20 nt, Artificial Sequence
  Synthetic
cccgggcaggcccagcucaa

SEQ ID NO: 10104 - RNA, 21 nt, Artificial Sequence
  Synthetic
gcccgggcaggcccagcucaa

SEQ ID NO: 10105 - RNA, 22 nt, Artificial Sequence
  Synthetic
ggcccgggcaggcccagcucaa

SEQ ID NO: 10106 - RNA, 23 nt, Artificial Sequence
  Synthetic
gggcccgggcaggcccagcucaa

SEQ ID NO: 10107 - RNA, 24 nt, Artificial Sequence
  Synthetic
cgggcccgggcaggcccagcucaa

SEQ ID NO: 10108 - RNA, 18 nt, Artificial Sequence
  Synthetic
gacgaggaagaggaagaa

SEQ ID NO: 10109 - RNA, 19 nt, Artificial Sequence
  Synthetic
cgacgaggaagaggaagaa

SEQ ID NO: 10110 - RNA, 20 nt, Artificial Sequence
  Synthetic
acgacgaggaagaggaagaa

SEQ ID NO: 10111 - RNA, 21 nt, Artificial Sequence
  Synthetic
gacgacgaggaagaggaagaa

SEQ ID NO: 10112 - RNA, 22 nt, Artificial Sequence
  Synthetic
ggacgacgaggaagaggaagaa

SEQ ID NO: 10113 - RNA, 23 nt, Artificial Sequence
  Synthetic
aggacgacgaggaagaggaagaa

SEQ ID NO: 10114 - RNA, 24 nt, Artificial Sequence
  Synthetic
gaggacgacgaggaagaggaagaa

SEQ ID NO: 10115 - RNA, 18 nt, Artificial Sequence
  Synthetic
caaccugaucccggagaa

SEQ ID NO: 10116 - RNA, 19 nt, Artificial Sequence
  Synthetic
ccaaccugaucccggagaa

SEQ ID NO: 10117 - RNA, 20 nt, Artificial Sequence
  Synthetic
cccaaccugaucccggagaa

SEQ ID NO: 10118 - RNA, 21 nt, Artificial Sequence
  Synthetic
ccccaaccugaucccggagaa

SEQ ID NO: 10119 - RNA, 22 nt, Artificial Sequence
  Synthetic
accccaaccugaucccggagaa

SEQ ID NO: 10120 - RNA, 23 nt, Artificial Sequence
  Synthetic
gaccccaaccugaucccggagaa

SEQ ID NO: 10121 - RNA, 24 nt, Artificial Sequence
  Synthetic
cgaccccaaccugaucccggagaa

SEQ ID NO: 10122 - RNA, 18 nt, Artificial Sequence
  Synthetic
ggagcacuccucggagaa

SEQ ID NO: 10123 - RNA, 19 nt, Artificial Sequence
  Synthetic
cggagcacuccucggagaa

SEQ ID NO: 10124 - RNA, 20 nt, Artificial Sequence
  Synthetic
ucggagcacuccucggagaa

SEQ ID NO: 10125 - RNA, 21 nt, Artificial Sequence
  Synthetic
gucggagcacuccucggagaa

SEQ ID NO: 10126 - RNA, 22 nt, Artificial Sequence
  Synthetic
cgucggagcacuccucggagaa

SEQ ID NO: 10127 - RNA, 23 nt, Artificial Sequence
  Synthetic
ucgucggagcacuccucggagaa

SEQ ID NO: 10128 - RNA, 24 nt, Artificial Sequence
  Synthetic
cucgucggagcacuccucggagaa

SEQ ID NO: 10129 - RNA, 18 nt, Artificial Sequence
  Synthetic
gaggaggacgacgaggaa

SEQ ID NO: 10130 - RNA, 19 nt, Artificial Sequence
  Synthetic
agaggaggacgacgaggaa

SEQ ID NO: 10131 - RNA, 20 nt, Artificial Sequence
  Synthetic
aagaggaggacgacgaggaa

SEQ ID NO: 10132 - RNA, 21 nt, Artificial Sequence
  Synthetic
gaagaggaggacgacgaggaa

SEQ ID NO: 10133 - RNA, 22 nt, Artificial Sequence
  Synthetic
ggaagaggaggacgacgaggaa

SEQ ID NO: 10134 - RNA, 23 nt, Artificial Sequence
  Synthetic
aggaagaggaggacgacgaggaa

SEQ ID NO: 10135 - RNA, 24 nt, Artificial Sequence
  Synthetic
gaggaagaggaggacgacgaggaa

SEQ ID NO: 10136 - RNA, 18 nt, Artificial Sequence
  Synthetic
gaggaagaagaggaggaa

SEQ ID NO: 10137 - RNA, 19 nt, Artificial Sequence
  Synthetic
agaggaagaagaggaggaa

SEQ ID NO: 10138 - RNA, 20 nt, Artificial Sequence
  Synthetic
aagaggaagaagaggaggaa

SEQ ID NO: 10139 - RNA, 21 nt, Artificial Sequence
  Synthetic
gaagaggaagaagaggaggaa

SEQ ID NO: 10140 - RNA, 22 nt, Artificial Sequence
  Synthetic
ggaagaggaagaagaggaggaa

SEQ ID NO: 10141 - RNA, 23 nt, Artificial Sequence
  Synthetic
aggaagaggaagaagaggaggaa

SEQ ID NO: 10142 - RNA, 24 nt, Artificial Sequence
  Synthetic
gaggaagaggaagaagaggaggaa

SEQ ID NO: 10143 - RNA, 18 nt, Artificial Sequence
  Synthetic
aacggggacgaggaggaa

SEQ ID NO: 10144 - RNA, 19 nt, Artificial Sequence
  Synthetic
gaacggggacgaggaggaa

SEQ ID NO: 10145 - RNA, 20 nt, Artificial Sequence
  Synthetic
agaacggggacgaggaggaa

SEQ ID NO: 10146 - RNA, 21 nt, Artificial Sequence
  Synthetic
gagaacggggacgaggaggaa

SEQ ID NO: 10147 - RNA, 22 nt, Artificial Sequence
  Synthetic
ggagaacggggacgaggaggaa

SEQ ID NO: 10148 - RNA, 23 nt, Artificial Sequence
  Synthetic
cggagaacggggacgaggaggaa

SEQ ID NO: 10149 - RNA, 24 nt, Artificial Sequence
  Synthetic
ccggagaacggggacgaggaggaa

SEQ ID NO: 10150 - RNA, 18 nt, Artificial Sequence
  Synthetic
ggcgcagcggcacgggaa

SEQ ID NO: 10151 - RNA, 19 nt, Artificial Sequence
  Synthetic
gggcgcagcggcacgggaa

SEQ ID NO: 10152 - RNA, 20 nt, Artificial Sequence
  Synthetic
ggggcgcagcggcacgggaa

SEQ ID NO: 10153 - RNA, 21 nt, Artificial Sequence
  Synthetic
cggggcgcagcggcacgggaa

SEQ ID NO: 10154 - RNA, 22 nt, Artificial Sequence
  Synthetic
ucggggcgcagcggcacgggaa

SEQ ID NO: 10155 - RNA, 23 nt, Artificial Sequence
  Synthetic
cucggggcgcagcggcacgggaa

SEQ ID NO: 10156 - RNA, 24 nt, Artificial Sequence
  Synthetic
ucucggggcgcagcggcacgggaa

SEQ ID NO: 10157 - RNA, 18 nt, Artificial Sequence
  Synthetic
cggccgcgaugcccaaca

SEQ ID NO: 10158 - RNA, 19 nt, Artificial Sequence
  Synthetic
ccggccgcgaugcccaaca

SEQ ID NO: 10159 - RNA, 20 nt, Artificial Sequence
  Synthetic
cccggccgcgaugcccaaca

SEQ ID NO: 10160 - RNA, 21 nt, Artificial Sequence
  Synthetic
ccccggccgcgaugcccaaca

SEQ ID NO: 10161 - RNA, 22 nt, Artificial Sequence
  Synthetic
cccccggccgcgaugcccaaca

SEQ ID NO: 10162 - RNA, 23 nt, Artificial Sequence
  Synthetic
gcccccggccgcgaugcccaaca

SEQ ID NO: 10163 - RNA, 24 nt, Artificial Sequence
  Synthetic
ugcccccggccgcgaugcccaaca

SEQ ID NO: 10164 - RNA, 18 nt, Artificial Sequence
  Synthetic
cuacuuagaaagcgaaca

SEQ ID NO: 10165 - RNA, 19 nt, Artificial Sequence
  Synthetic
ucuacuuagaaagcgaaca

SEQ ID NO: 10166 - RNA, 20 nt, Artificial Sequence
  Synthetic
aucuacuuagaaagcgaaca

SEQ ID NO: 10167 - RNA, 21 nt, Artificial Sequence
  Synthetic
aaucuacuuagaaagcgaaca

SEQ ID NO: 10168 - RNA, 22 nt, Artificial Sequence
  Synthetic
gaaucuacuuagaaagcgaaca

SEQ ID NO: 10169 - RNA, 23 nt, Artificial Sequence
  Synthetic
agaaucuacuuagaaagcgaaca

SEQ ID NO: 10170 - RNA, 24 nt, Artificial Sequence
  Synthetic
aagaaucuacuuagaaagcgaaca

SEQ ID NO: 10171 - RNA, 18 nt, Artificial Sequence
  Synthetic
ccccuguuuaguccacca

SEQ ID NO: 10172 - RNA, 19 nt, Artificial Sequence
  Synthetic
cccccuguuuaguccacca

SEQ ID NO: 10173 - RNA, 20 nt, Artificial Sequence
  Synthetic
ccccccuguuuaguccacca

SEQ ID NO: 10174 - RNA, 21 nt, Artificial Sequence
  Synthetic
cccccccuguuuaguccacca

SEQ ID NO: 10175 - RNA, 22 nt, Artificial Sequence
  Synthetic
ucccccccuguuuaguccacca

SEQ ID NO: 10176 - RNA, 23 nt, Artificial Sequence
  Synthetic
cucccccccuguuuaguccacca

SEQ ID NO: 10177 - RNA, 24 nt, Artificial Sequence
  Synthetic
acucccccccuguuuaguccacca

SEQ ID NO: 10178 - RNA, 18 nt, Artificial Sequence
  Synthetic
cauucggcguaguaccca

SEQ ID NO: 10179 - RNA, 19 nt, Artificial Sequence
  Synthetic
ccauucggcguaguaccca

SEQ ID NO: 10180 - RNA, 20 nt, Artificial Sequence
  Synthetic
cccauucggcguaguaccca

SEQ ID NO: 10181 - RNA, 21 nt, Artificial Sequence
  Synthetic
ccccauucggcguaguaccca

SEQ ID NO: 10182 - RNA, 22 nt, Artificial Sequence
  Synthetic
cccccauucggcguaguaccca

SEQ ID NO: 10183 - RNA, 23 nt, Artificial Sequence
  Synthetic
acccccauucggcguaguaccca

SEQ ID NO: 10184 - RNA, 24 nt, Artificial Sequence
  Synthetic
cacccccauucggcguaguaccca

SEQ ID NO: 10185 - RNA, 18 nt, Artificial Sequence
  Synthetic
ggccgaggccgagggcca

SEQ ID NO: 10186 - RNA, 19 nt, Artificial Sequence
  Synthetic
uggccgaggccgagggcca

SEQ ID NO: 10187 - RNA, 20 nt, Artificial Sequence
  Synthetic
cuggccgaggccgagggcca

SEQ ID NO: 10188 - RNA, 21 nt, Artificial Sequence
  Synthetic
ccuggccgaggccgagggcca

SEQ ID NO: 10189 - RNA, 22 nt, Artificial Sequence
  Synthetic
accuggccgaggccgagggcca

SEQ ID NO: 10190 - RNA, 23 nt, Artificial Sequence
  Synthetic
caccuggccgaggccgagggcca

SEQ ID NO: 10191 - RNA, 24 nt, Artificial Sequence
  Synthetic
ccaccuggccgaggccgagggcca

SEQ ID NO: 10192 - RNA, 18 nt, Artificial Sequence
  Synthetic
uuucucuugcaacacgca

SEQ ID NO: 10193 - RNA, 19 nt, Artificial Sequence
  Synthetic
guuucucuugcaacacgca

SEQ ID NO: 10194 - RNA, 20 nt, Artificial Sequence
  Synthetic
gguuucucuugcaacacgca

SEQ ID NO: 10195 - RNA, 21 nt, Artificial Sequence
  Synthetic
ugguuucucuugcaacacgca

SEQ ID NO: 10196 - RNA, 22 nt, Artificial Sequence
  Synthetic
augguuucucuugcaacacgca

SEQ ID NO: 10197 - RNA, 23 nt, Artificial Sequence
  Synthetic
caugguuucucuugcaacacgca

SEQ ID NO: 10198 - RNA, 24 nt, Artificial Sequence
  Synthetic
gcaugguuucucuugcaacacgca

SEQ ID NO: 10199 - RNA, 18 nt, Artificial Sequence
  Synthetic
acuuggacccccaccgca

SEQ ID NO: 10200 - RNA, 19 nt, Artificial Sequence
  Synthetic
cacuuggacccccaccgca

SEQ ID NO: 10201 - RNA, 20 nt, Artificial Sequence
  Synthetic
ucacuuggacccccaccgca

SEQ ID NO: 10202 - RNA, 21 nt, Artificial Sequence
  Synthetic
aucacuuggacccccaccgca

SEQ ID NO: 10203 - RNA, 22 nt, Artificial Sequence
  Synthetic
caucacuuggacccccaccgca

SEQ ID NO: 10204 - RNA, 23 nt, Artificial Sequence
  Synthetic
acaucacuuggacccccaccgca

SEQ ID NO: 10205 - RNA, 24 nt, Artificial Sequence
  Synthetic
gacaucacuuggacccccaccgca

SEQ ID NO: 10206 - RNA, 18 nt, Artificial Sequence
  Synthetic
ucucggggcgcagcggca

SEQ ID NO: 10207 - RNA, 19 nt, Artificial Sequence
  Synthetic
aucucggggcgcagcggca

SEQ ID NO: 10208 - RNA, 20 nt, Artificial Sequence
  Synthetic
gaucucggggcgcagcggca

SEQ ID NO: 10209 - RNA, 21 nt, Artificial Sequence
  Synthetic
ggaucucggggcgcagcggca

SEQ ID NO: 10210 - RNA, 22 nt, Artificial Sequence
  Synthetic
gggaucucggggcgcagcggca

SEQ ID NO: 10211 - RNA, 23 nt, Artificial Sequence
  Synthetic
agggaucucggggcgcagcggca

SEQ ID NO: 10212 - RNA, 24 nt, Artificial Sequence
  Synthetic
gagggaucucggggcgcagcggca

SEQ ID NO: 10213 - RNA, 18 nt, Artificial Sequence
  Synthetic
agacuuagagagcuggca

SEQ ID NO: 10214 - RNA, 19 nt, Artificial Sequence
  Synthetic
gagacuuagagagcuggca

SEQ ID NO: 10215 - RNA, 20 nt, Artificial Sequence
  Synthetic
ggagacuuagagagcuggca

SEQ ID NO: 10216 - RNA, 21 nt, Artificial Sequence
  Synthetic
aggagacuuagagagcuggca

SEQ ID NO: 10217 - RNA, 22 nt, Artificial Sequence
  Synthetic
uaggagacuuagagagcuggca

SEQ ID NO: 10218 - RNA, 23 nt, Artificial Sequence
  Synthetic
cuaggagacuuagagagcuggca

SEQ ID NO: 10219 - RNA, 24 nt, Artificial Sequence
  Synthetic
ucuaggagacuuagagagcuggca

SEQ ID NO: 10220 - RNA, 18 nt, Artificial Sequence
  Synthetic
gcuccaugcagcacuuca

SEQ ID NO: 10221 - RNA, 19 nt, Artificial Sequence
  Synthetic
agcuccaugcagcacuuca

SEQ ID NO: 10222 - RNA, 20 nt, Artificial Sequence
  Synthetic
cagcuccaugcagcacuuca

SEQ ID NO: 10223 - RNA, 21 nt, Artificial Sequence
  Synthetic
ucagcuccaugcagcacuuca

SEQ ID NO: 10224 - RNA, 22 nt, Artificial Sequence
  Synthetic
cucagcuccaugcagcacuuca

SEQ ID NO: 10225 - RNA, 23 nt, Artificial Sequence
  Synthetic
gcucagcuccaugcagcacuuca

SEQ ID NO: 10226 - RNA, 24 nt, Artificial Sequence
  Synthetic
ugcucagcuccaugcagcacuuca

SEQ ID NO: 10227 - RNA, 18 nt, Artificial Sequence
  Synthetic
ugguggccaaguucaaga

SEQ ID NO: 10228 - RNA, 19 nt, Artificial Sequence
  Synthetic
gugguggccaaguucaaga

SEQ ID NO: 10229 - RNA, 20 nt, Artificial Sequence
  Synthetic
cgugguggccaaguucaaga

SEQ ID NO: 10230 - RNA, 21 nt, Artificial Sequence
  Synthetic
ccgugguggccaaguucaaga

SEQ ID NO: 10231 - RNA, 22 nt, Artificial Sequence
  Synthetic
uccgugguggccaaguucaaga

SEQ ID NO: 10232 - RNA, 23 nt, Artificial Sequence
  Synthetic
guccgugguggccaaguucaaga

SEQ ID NO: 10233 - RNA, 24 nt, Artificial Sequence
  Synthetic
aguccgugguggccaaguucaaga

SEQ ID NO: 10234 - RNA, 18 nt, Artificial Sequence
  Synthetic
aggaggagcugacggaga

SEQ ID NO: 10235 - RNA, 19 nt, Artificial Sequence
  Synthetic
gaggaggagcugacggaga

SEQ ID NO: 10236 - RNA, 20 nt, Artificial Sequence
  Synthetic
ggaggaggagcugacggaga

SEQ ID NO: 10237 - RNA, 21 nt, Artificial Sequence
  Synthetic
aggaggaggagcugacggaga

SEQ ID NO: 10238 - RNA, 22 nt, Artificial Sequence
  Synthetic
gaggaggaggagcugacggaga

SEQ ID NO: 10239 - RNA, 23 nt, Artificial Sequence
  Synthetic
ggaggaggaggagcugacggaga

SEQ ID NO: 10240 - RNA, 24 nt, Artificial Sequence
  Synthetic
aggaggaggaggagcugacggaga

SEQ ID NO: 10241 - RNA, 18 nt, Artificial Sequence
  Synthetic
ccaaccugaucccggaga

SEQ ID NO: 10242 - RNA, 19 nt, Artificial Sequence
  Synthetic
cccaaccugaucccggaga

SEQ ID NO: 10243 - RNA, 20 nt, Artificial Sequence
  Synthetic
ccccaaccugaucccggaga

SEQ ID NO: 10244 - RNA, 21 nt, Artificial Sequence
  Synthetic
accccaaccugaucccggaga

SEQ ID NO: 10245 - RNA, 22 nt, Artificial Sequence
  Synthetic
gaccccaaccugaucccggaga

SEQ ID NO: 10246 - RNA, 23 nt, Artificial Sequence
  Synthetic
cgaccccaaccugaucccggaga

SEQ ID NO: 10247 - RNA, 24 nt, Artificial Sequence
  Synthetic
acgaccccaaccugaucccggaga

SEQ ID NO: 10248 - RNA, 18 nt, Artificial Sequence
  Synthetic
cggagcacuccucggaga

SEQ ID NO: 10249 - RNA, 19 nt, Artificial Sequence
  Synthetic
ucggagcacuccucggaga

SEQ ID NO: 10250 - RNA, 20 nt, Artificial Sequence
  Synthetic
gucggagcacuccucggaga

SEQ ID NO: 10251 - RNA, 21 nt, Artificial Sequence
  Synthetic
cgucggagcacuccucggaga

SEQ ID NO: 10252 - RNA, 22 nt, Artificial Sequence
  Synthetic
ucgucggagcacuccucggaga

SEQ ID NO: 10253 - RNA, 23 nt, Artificial Sequence
  Synthetic
cucgucggagcacuccucggaga

SEQ ID NO: 10254 - RNA, 24 nt, Artificial Sequence
  Synthetic
ccucgucggagcacuccucggaga

SEQ ID NO: 10255 - RNA, 18 nt, Artificial Sequence
  Synthetic
uaccaggaucaguaucga

SEQ ID NO: 10256 - RNA, 19 nt, Artificial Sequence
  Synthetic
auaccaggaucaguaucga

SEQ ID NO: 10257 - RNA, 20 nt, Artificial Sequence
  Synthetic
aauaccaggaucaguaucga

SEQ ID NO: 10258 - RNA, 21 nt, Artificial Sequence
  Synthetic
gaauaccaggaucaguaucga

SEQ ID NO: 10259 - RNA, 22 nt, Artificial Sequence
  Synthetic
agaauaccaggaucaguaucga

SEQ ID NO: 10260 - RNA, 23 nt, Artificial Sequence
  Synthetic
aagaauaccaggaucaguaucga

SEQ ID NO: 10261 - RNA, 24 nt, Artificial Sequence
  Synthetic
uaagaauaccaggaucaguaucga

SEQ ID NO: 10262 - RNA, 18 nt, Artificial Sequence
  Synthetic
uguguggcaguuuucgga

SEQ ID NO: 10263 - RNA, 19 nt, Artificial Sequence
  Synthetic
auguguggcaguuuucgga

SEQ ID NO: 10264 - RNA, 20 nt, Artificial Sequence
  Synthetic
gauguguggcaguuuucgga

SEQ ID NO: 10265 - RNA, 21 nt, Artificial Sequence
  Synthetic
agauguguggcaguuuucgga

SEQ ID NO: 10266 - RNA, 22 nt, Artificial Sequence
  Synthetic
aagauguguggcaguuuucgga

SEQ ID NO: 10267 - RNA, 23 nt, Artificial Sequence
  Synthetic
caagauguguggcaguuuucgga

SEQ ID NO: 10268 - RNA, 24 nt, Artificial Sequence
  Synthetic
ucaagauguguggcaguuuucgga

SEQ ID NO: 10269 - RNA, 18 nt, Artificial Sequence
  Synthetic
accgcccggggagcugga

SEQ ID NO: 10270 - RNA, 19 nt, Artificial Sequence
  Synthetic
caccgcccggggagcugga

SEQ ID NO: 10271 - RNA, 20 nt, Artificial Sequence
  Synthetic
acaccgcccggggagcugga

SEQ ID NO: 10272 - RNA, 21 nt, Artificial Sequence
  Synthetic
cacaccgcccggggagcugga

SEQ ID NO: 10273 - RNA, 22 nt, Artificial Sequence
  Synthetic
ccacaccgcccggggagcugga

SEQ ID NO: 10274 - RNA, 23 nt, Artificial Sequence
  Synthetic
uccacaccgcccggggagcugga

SEQ ID NO: 10275 - RNA, 24 nt, Artificial Sequence
  Synthetic
cuccacaccgcccggggagcugga

SEQ ID NO: 10276 - RNA, 18 nt, Artificial Sequence
  Synthetic
agcggcacgggaagugga

SEQ ID NO: 10277 - RNA, 19 nt, Artificial Sequence
  Synthetic
cagcggcacgggaagugga

SEQ ID NO: 10278 - RNA, 20 nt, Artificial Sequence
  Synthetic
gcagcggcacgggaagugga

SEQ ID NO: 10279 - RNA, 21 nt, Artificial Sequence
  Synthetic
cgcagcggcacgggaagugga

SEQ ID NO: 10280 - RNA, 22 nt, Artificial Sequence
  Synthetic
gcgcagcggcacgggaagugga

SEQ ID NO: 10281 - RNA, 23 nt, Artificial Sequence
  Synthetic
ggcgcagcggcacgggaagugga

SEQ ID NO: 10282 - RNA, 24 nt, Artificial Sequence
  Synthetic
gggcgcagcggcacgggaagugga

SEQ ID NO: 10283 - RNA, 18 nt, Artificial Sequence
  Synthetic
aggaggaggaggagcuga

SEQ ID NO: 10284 - RNA, 19 nt, Artificial Sequence
  Synthetic
gaggaggaggaggagcuga

SEQ ID NO: 10285 - RNA, 20 nt, Artificial Sequence
  Synthetic
agaggaggaggaggagcuga

SEQ ID NO: 10286 - RNA, 21 nt, Artificial Sequence
  Synthetic
aagaggaggaggaggagcuga

SEQ ID NO: 10287 - RNA, 22 nt, Artificial Sequence
  Synthetic
gaagaggaggaggaggagcuga

SEQ ID NO: 10288 - RNA, 23 nt, Artificial Sequence
  Synthetic
ggaagaggaggaggaggagcuga

SEQ ID NO: 10289 - RNA, 24 nt, Artificial Sequence
  Synthetic
aggaagaggaggaggaggagcuga

SEQ ID NO: 10290 - RNA, 18 nt, Artificial Sequence
  Synthetic
gguugaauccaauggcua

SEQ ID NO: 10291 - RNA, 19 nt, Artificial Sequence
  Synthetic
cgguugaauccaauggcua

SEQ ID NO: 10292 - RNA, 20 nt, Artificial Sequence
  Synthetic
gcgguugaauccaauggcua

SEQ ID NO: 10293 - RNA, 21 nt, Artificial Sequence
  Synthetic
ugcgguugaauccaauggcua

SEQ ID NO: 10294 - RNA, 22 nt, Artificial Sequence
  Synthetic
cugcgguugaauccaauggcua

SEQ ID NO: 10295 - RNA, 23 nt, Artificial Sequence
  Synthetic
gcugcgguugaauccaauggcua

SEQ ID NO: 10296 - RNA, 24 nt, Artificial Sequence
  Synthetic
ugcugcgguugaauccaauggcua

SEQ ID NO: 10297 - RNA, 18 nt, Artificial Sequence
  Synthetic
agaauaccaggaucagua

SEQ ID NO: 10298 - RNA, 19 nt, Artificial Sequence
  Synthetic
aagaauaccaggaucagua

SEQ ID NO: 10299 - RNA, 20 nt, Artificial Sequence
  Synthetic
uaagaauaccaggaucagua

SEQ ID NO: 10300 - RNA, 21 nt, Artificial Sequence
  Synthetic
cuaagaauaccaggaucagua

SEQ ID NO: 10301 - RNA, 22 nt, Artificial Sequence
  Synthetic
gcuaagaauaccaggaucagua

SEQ ID NO: 10302 - RNA, 23 nt, Artificial Sequence
  Synthetic
ugcuaagaauaccaggaucagua

SEQ ID NO: 10303 - RNA, 24 nt, Artificial Sequence
  Synthetic
cugcuaagaauaccaggaucagua

SEQ ID NO: 10304 - RNA, 18 nt, Artificial Sequence
  Synthetic
auuucucuaggagacuua

SEQ ID NO: 10305 - RNA, 19 nt, Artificial Sequence
  Synthetic
gauuucucuaggagacuua

SEQ ID NO: 10306 - RNA, 20 nt, Artificial Sequence
  Synthetic
ggauuucucuaggagacuua

SEQ ID NO: 10307 - RNA, 21 nt, Artificial Sequence
  Synthetic
uggauuucucuaggagacuua

SEQ ID NO: 10308 - RNA, 22 nt, Artificial Sequence
  Synthetic
auggauuucucuaggagacuua

SEQ ID NO: 10309 - RNA, 23 nt, Artificial Sequence
  Synthetic
cauggauuucucuaggagacuua

SEQ ID NO: 10310 - RNA, 24 nt, Artificial Sequence
  Synthetic
ccauggauuucucuaggagacuua

SEQ ID NO: 10311 - RNA, 18 nt, Artificial Sequence
  Synthetic
ccggccgcgaugcccaac

SEQ ID NO: 10312 - RNA, 19 nt, Artificial Sequence
  Synthetic
cccggccgcgaugcccaac

SEQ ID NO: 10313 - RNA, 20 nt, Artificial Sequence
  Synthetic
ccccggccgcgaugcccaac

SEQ ID NO: 10314 - RNA, 21 nt, Artificial Sequence
  Synthetic
cccccggccgcgaugcccaac

SEQ ID NO: 10315 - RNA, 22 nt, Artificial Sequence
  Synthetic
gcccccggccgcgaugcccaac

SEQ ID NO: 10316 - RNA, 23 nt, Artificial Sequence
  Synthetic
ugcccccggccgcgaugcccaac

SEQ ID NO: 10317 - RNA, 24 nt, Artificial Sequence
  Synthetic
cugcccccggccgcgaugcccaac

SEQ ID NO: 10318 - RNA, 18 nt, Artificial Sequence
  Synthetic
aaccugaucccggagaac

SEQ ID NO: 10319 - RNA, 19 nt, Artificial Sequence
  Synthetic
caaccugaucccggagaac

SEQ ID NO: 10320 - RNA, 20 nt, Artificial Sequence
  Synthetic
ccaaccugaucccggagaac

SEQ ID NO: 10321 - RNA, 21 nt, Artificial Sequence
  Synthetic
cccaaccugaucccggagaac

SEQ ID NO: 10322 - RNA, 22 nt, Artificial Sequence
  Synthetic
ccccaaccugaucccggagaac

SEQ ID NO: 10323 - RNA, 23 nt, Artificial Sequence
  Synthetic
accccaaccugaucccggagaac

SEQ ID NO: 10324 - RNA, 24 nt, Artificial Sequence
  Synthetic
gaccccaaccugaucccggagaac

SEQ ID NO: 10325 - RNA, 18 nt, Artificial Sequence
  Synthetic
ucuacuuagaaagcgaac

SEQ ID NO: 10326 - RNA, 19 nt, Artificial Sequence
  Synthetic
aucuacuuagaaagcgaac

SEQ ID NO: 10327 - RNA, 20 nt, Artificial Sequence
  Synthetic
aaucuacuuagaaagcgaac

SEQ ID NO: 10328 - RNA, 21 nt, Artificial Sequence
  Synthetic
gaaucuacuuagaaagcgaac

SEQ ID NO: 10329 - RNA, 22 nt, Artificial Sequence
  Synthetic
agaaucuacuuagaaagcgaac

SEQ ID NO: 10330 - RNA, 23 nt, Artificial Sequence
  Synthetic
aagaaucuacuuagaaagcgaac

SEQ ID NO: 10331 - RNA, 24 nt, Artificial Sequence
  Synthetic
uaagaaucuacuuagaaagcgaac

SEQ ID NO: 10332 - RNA, 18 nt, Artificial Sequence
  Synthetic
gaggcggcgcgccaccac

SEQ ID NO: 10333 - RNA, 19 nt, Artificial Sequence
  Synthetic
ggaggcggcgcgccaccac

SEQ ID NO: 10334 - RNA, 20 nt, Artificial Sequence
  Synthetic
uggaggcggcgcgccaccac

SEQ ID NO: 10335 - RNA, 21 nt, Artificial Sequence
  Synthetic
cuggaggcggcgcgccaccac

SEQ ID NO: 10336 - RNA, 22 nt, Artificial Sequence
  Synthetic
ccuggaggcggcgcgccaccac

SEQ ID NO: 10337 - RNA, 23 nt, Artificial Sequence
  Synthetic
gccuggaggcggcgcgccaccac

SEQ ID NO: 10338 - RNA, 24 nt, Artificial Sequence
  Synthetic
agccuggaggcggcgcgccaccac

SEQ ID NO: 10339 - RNA, 18 nt, Artificial Sequence
  Synthetic
gugcaccggcgcagccac

SEQ ID NO: 10340 - RNA, 19 nt, Artificial Sequence
  Synthetic
ggugcaccggcgcagccac

SEQ ID NO: 10341 - RNA, 20 nt, Artificial Sequence
  Synthetic
uggugcaccggcgcagccac

SEQ ID NO: 10342 - RNA, 21 nt, Artificial Sequence
  Synthetic
guggugcaccggcgcagccac

SEQ ID NO: 10343 - RNA, 22 nt, Artificial Sequence
  Synthetic
gguggugcaccggcgcagccac

SEQ ID NO: 10344 - RNA, 23 nt, Artificial Sequence
  Synthetic
ugguggugcaccggcgcagccac

SEQ ID NO: 10345 - RNA, 24 nt, Artificial Sequence
  Synthetic
cugguggugcaccggcgcagccac

SEQ ID NO: 10346 - RNA, 18 nt, Artificial Sequence
  Synthetic
agcaagcugaagcgccac

SEQ ID NO: 10347 - RNA, 19 nt, Artificial Sequence
  Synthetic
cagcaagcugaagcgccac

SEQ ID NO: 10348 - RNA, 20 nt, Artificial Sequence
  Synthetic
ccagcaagcugaagcgccac

SEQ ID NO: 10349 - RNA, 21 nt, Artificial Sequence
  Synthetic
gccagcaagcugaagcgccac

SEQ ID NO: 10350 - RNA, 22 nt, Artificial Sequence
  Synthetic
ggccagcaagcugaagcgccac

SEQ ID NO: 10351 - RNA, 23 nt, Artificial Sequence
  Synthetic
aggccagcaagcugaagcgccac

SEQ ID NO: 10352 - RNA, 24 nt, Artificial Sequence
  Synthetic
caggccagcaagcugaagcgccac

SEQ ID NO: 10353 - RNA, 18 nt, Artificial Sequence
  Synthetic
gccgaggccgagggccac

SEQ ID NO: 10354 - RNA, 19 nt, Artificial Sequence
  Synthetic
ggccgaggccgagggccac

SEQ ID NO: 10355 - RNA, 20 nt, Artificial Sequence
  Synthetic
uggccgaggccgagggccac

SEQ ID NO: 10356 - RNA, 21 nt, Artificial Sequence
  Synthetic
cuggccgaggccgagggccac

SEQ ID NO: 10357 - RNA, 22 nt, Artificial Sequence
  Synthetic
ccuggccgaggccgagggccac

SEQ ID NO: 10358 - RNA, 23 nt, Artificial Sequence
  Synthetic
accuggccgaggccgagggccac

SEQ ID NO: 10359 - RNA, 24 nt, Artificial Sequence
  Synthetic
caccuggccgaggccgagggccac

SEQ ID NO: 10360 - RNA, 18 nt, Artificial Sequence
  Synthetic
cucggggcgcagcggcac

SEQ ID NO: 10361 - RNA, 19 nt, Artificial Sequence
  Synthetic
ucucggggcgcagcggcac

SEQ ID NO: 10362 - RNA, 20 nt, Artificial Sequence
  Synthetic
aucucggggcgcagcggcac

SEQ ID NO: 10363 - RNA, 21 nt, Artificial Sequence
  Synthetic
gaucucggggcgcagcggcac

SEQ ID NO: 10364 - RNA, 22 nt, Artificial Sequence
  Synthetic
ggaucucggggcgcagcggcac

SEQ ID NO: 10365 - RNA, 23 nt, Artificial Sequence
  Synthetic
gggaucucggggcgcagcggcac

SEQ ID NO: 10366 - RNA, 24 nt, Artificial Sequence
  Synthetic
agggaucucggggcgcagcggcac

SEQ ID NO: 10367 - RNA, 18 nt, Artificial Sequence
  Synthetic
ccaccaccgagacaucac

SEQ ID NO: 10368 - RNA, 19 nt, Artificial Sequence
  Synthetic
uccaccaccgagacaucac

SEQ ID NO: 10369 - RNA, 20 nt, Artificial Sequence
  Synthetic
guccaccaccgagacaucac

SEQ ID NO: 10370 - RNA, 21 nt, Artificial Sequence
  Synthetic
aguccaccaccgagacaucac

SEQ ID NO: 10371 - RNA, 22 nt, Artificial Sequence
  Synthetic
uaguccaccaccgagacaucac

SEQ ID NO: 10372 - RNA, 23 nt, Artificial Sequence
  Synthetic
uuaguccaccaccgagacaucac

SEQ ID NO: 10373 - RNA, 24 nt, Artificial Sequence
  Synthetic
uuuaguccaccaccgagacaucac

SEQ ID NO: 10374 - RNA, 18 nt, Artificial Sequence
  Synthetic
gaggaagaggaggacgac

SEQ ID NO: 10375 - RNA, 19 nt, Artificial Sequence
  Synthetic
ggaggaagaggaggacgac

SEQ ID NO: 10376 - RNA, 20 nt, Artificial Sequence
  Synthetic
aggaggaagaggaggacgac

SEQ ID NO: 10377 - RNA, 21 nt, Artificial Sequence
  Synthetic
gaggaggaagaggaggacgac

SEQ ID NO: 10378 - RNA, 22 nt, Artificial Sequence
  Synthetic
cgaggaggaagaggaggacgac

SEQ ID NO: 10379 - RNA, 23 nt, Artificial Sequence
  Synthetic
acgaggaggaagaggaggacgac

SEQ ID NO: 10380 - RNA, 24 nt, Artificial Sequence
  Synthetic
gacgaggaggaagaggaggacgac

SEQ ID NO: 10381 - RNA, 18 nt, Artificial Sequence
  Synthetic
gucgugggcgugggcgac

SEQ ID NO: 10382 - RNA, 19 nt, Artificial Sequence
  Synthetic
ggucgugggcgugggcgac

SEQ ID NO: 10383 - RNA, 20 nt, Artificial Sequence
  Synthetic
cggucgugggcgugggcgac

SEQ ID NO: 10384 - RNA, 21 nt, Artificial Sequence
  Synthetic
gcggucgugggcgugggcgac

SEQ ID NO: 10385 - RNA, 22 nt, Artificial Sequence
  Synthetic
cgcggucgugggcgugggcgac

SEQ ID NO: 10386 - RNA, 23 nt, Artificial Sequence
  Synthetic
gcgcggucgugggcgugggcgac

SEQ ID NO: 10387 - RNA, 24 nt, Artificial Sequence
  Synthetic
ggcgcggucgugggcgugggcgac

SEQ ID NO: 10388 - RNA, 18 nt, Artificial Sequence
  Synthetic
aucccggagaacggggac

SEQ ID NO: 10389 - RNA, 19 nt, Artificial Sequence
  Synthetic
gaucccggagaacggggac

SEQ ID NO: 10390 - RNA, 20 nt, Artificial Sequence
  Synthetic
ugaucccggagaacggggac

SEQ ID NO: 10391 - RNA, 21 nt, Artificial Sequence
  Synthetic
cugaucccggagaacggggac

SEQ ID NO: 10392 - RNA, 22 nt, Artificial Sequence
  Synthetic
ccugaucccggagaacggggac

SEQ ID NO: 10393 - RNA, 23 nt, Artificial Sequence
  Synthetic
accugaucccggagaacggggac

SEQ ID NO: 10394 - RNA, 24 nt, Artificial Sequence
  Synthetic
aaccugaucccggagaacggggac

SEQ ID NO: 10395 - RNA, 18 nt, Artificial Sequence
  Synthetic
uggaggcggcgcgccacc

SEQ ID NO: 10396 - RNA, 19 nt, Artificial Sequence
  Synthetic
cuggaggcggcgcgccacc

SEQ ID NO: 10397 - RNA, 20 nt, Artificial Sequence
  Synthetic
ccuggaggcggcgcgccacc

SEQ ID NO: 10398 - RNA, 21 nt, Artificial Sequence
  Synthetic
gccuggaggcggcgcgccacc

SEQ ID NO: 10399 - RNA, 22 nt, Artificial Sequence
  Synthetic
agccuggaggcggcgcgccacc

SEQ ID NO: 10400 - RNA, 23 nt, Artificial Sequence
  Synthetic
gagccuggaggcggcgcgccacc

SEQ ID NO: 10401 - RNA, 24 nt, Artificial Sequence
  Synthetic
ugagccuggaggcggcgcgccacc

SEQ ID NO: 10402 - RNA, 18 nt, Artificial Sequence
  Synthetic
cccauucggcguaguacc

SEQ ID NO: 10403 - RNA, 19 nt, Artificial Sequence
  Synthetic
ccccauucggcguaguacc

SEQ ID NO: 10404 - RNA, 20 nt, Artificial Sequence
  Synthetic
cccccauucggcguaguacc

SEQ ID NO: 10405 - RNA, 21 nt, Artificial Sequence
  Synthetic
acccccauucggcguaguacc

SEQ ID NO: 10406 - RNA, 22 nt, Artificial Sequence
  Synthetic
cacccccauucggcguaguacc

SEQ ID NO: 10407 - RNA, 23 nt, Artificial Sequence
  Synthetic
acacccccauucggcguaguacc

SEQ ID NO: 10408 - RNA, 24 nt, Artificial Sequence
  Synthetic
cacacccccauucggcguaguacc

SEQ ID NO: 10409 - RNA, 18 nt, Artificial Sequence
  Synthetic
gagaaaauuugaagcccc

SEQ ID NO: 10410 - RNA, 19 nt, Artificial Sequence
  Synthetic
ugagaaaauuugaagcccc

SEQ ID NO: 10411 - RNA, 20 nt, Artificial Sequence
  Synthetic
cugagaaaauuugaagcccc

SEQ ID NO: 10412 - RNA, 21 nt, Artificial Sequence
  Synthetic
ucugagaaaauuugaagcccc

SEQ ID NO: 10413 - RNA, 22 nt, Artificial Sequence
  Synthetic
uucugagaaaauuugaagcccc

SEQ ID NO: 10414 - RNA, 23 nt, Artificial Sequence
  Synthetic
guucugagaaaauuugaagcccc

SEQ ID NO: 10415 - RNA, 24 nt, Artificial Sequence
  Synthetic
aguucugagaaaauuugaagcccc

SEQ ID NO: 10416 - RNA, 18 nt, Artificial Sequence
  Synthetic
cgcuucuccacaccgccc

SEQ ID NO: 10417 - RNA, 19 nt, Artificial Sequence
  Synthetic
gcgcuucuccacaccgccc

SEQ ID NO: 10418 - RNA, 20 nt, Artificial Sequence
  Synthetic
ugcgcuucuccacaccgccc

SEQ ID NO: 10419 - RNA, 21 nt, Artificial Sequence
  Synthetic
uugcgcuucuccacaccgccc

SEQ ID NO: 10420 - RNA, 22 nt, Artificial Sequence
  Synthetic
uuugcgcuucuccacaccgccc

SEQ ID NO: 10421 - RNA, 23 nt, Artificial Sequence
  Synthetic
guuugcgcuucuccacaccgccc

SEQ ID NO: 10422 - RNA, 24 nt, Artificial Sequence
  Synthetic
aguuugcgcuucuccacaccgccc

SEQ ID NO: 10423 - RNA, 18 nt, Artificial Sequence
  Synthetic
ucuccaccgccagcuccc

SEQ ID NO: 10424 - RNA, 19 nt, Artificial Sequence
  Synthetic
cucuccaccgccagcuccc

SEQ ID NO: 10425 - RNA, 20 nt, Artificial Sequence
  Synthetic
ucucuccaccgccagcuccc

SEQ ID NO: 10426 - RNA, 21 nt, Artificial Sequence
  Synthetic
gucucuccaccgccagcuccc

SEQ ID NO: 10427 - RNA, 22 nt, Artificial Sequence
  Synthetic
ggucucuccaccgccagcuccc

SEQ ID NO: 10428 - RNA, 23 nt, Artificial Sequence
  Synthetic
cggucucuccaccgccagcuccc

SEQ ID NO: 10429 - RNA, 24 nt, Artificial Sequence
  Synthetic
acggucucuccaccgccagcuccc

SEQ ID NO: 10430 - RNA, 18 nt, Artificial Sequence
  Synthetic
acggcuucgggcugagcc

SEQ ID NO: 10431 - RNA, 19 nt, Artificial Sequence
  Synthetic
uacggcuucgggcugagcc

SEQ ID NO: 10432 - RNA, 20 nt, Artificial Sequence
  Synthetic
cuacggcuucgggcugagcc

SEQ ID NO: 10433 - RNA, 21 nt, Artificial Sequence
  Synthetic
acuacggcuucgggcugagcc

SEQ ID NO: 10434 - RNA, 22 nt, Artificial Sequence
  Synthetic
gacuacggcuucgggcugagcc

SEQ ID NO: 10435 - RNA, 23 nt, Artificial Sequence
  Synthetic
ggacuacggcuucgggcugagcc

SEQ ID NO: 10436 - RNA, 24 nt, Artificial Sequence
  Synthetic
uggacuacggcuucgggcugagcc

SEQ ID NO: 10437 - RNA, 18 nt, Artificial Sequence
  Synthetic
gcgcuucuccacaccgcc

SEQ ID NO: 10438 - RNA, 19 nt, Artificial Sequence
  Synthetic
ugcgcuucuccacaccgcc

SEQ ID NO: 10439 - RNA, 20 nt, Artificial Sequence
  Synthetic
uugcgcuucuccacaccgcc

SEQ ID NO: 10440 - RNA, 21 nt, Artificial Sequence
  Synthetic
uuugcgcuucuccacaccgcc

SEQ ID NO: 10441 - RNA, 22 nt, Artificial Sequence
  Synthetic
guuugcgcuucuccacaccgcc

SEQ ID NO: 10442 - RNA, 23 nt, Artificial Sequence
  Synthetic
aguuugcgcuucuccacaccgcc

SEQ ID NO: 10443 - RNA, 24 nt, Artificial Sequence
  Synthetic
gaguuugcgcuucuccacaccgcc

SEQ ID NO: 10444 - RNA, 18 nt, Artificial Sequence
  Synthetic
cccaccgcauagagcgcc

SEQ ID NO: 10445 - RNA, 19 nt, Artificial Sequence
  Synthetic
ccccaccgcauagagcgcc

SEQ ID NO: 10446 - RNA, 20 nt, Artificial Sequence
  Synthetic
cccccaccgcauagagcgcc

SEQ ID NO: 10447 - RNA, 21 nt, Artificial Sequence
  Synthetic
acccccaccgcauagagcgcc

SEQ ID NO: 10448 - RNA, 22 nt, Artificial Sequence
  Synthetic
gacccccaccgcauagagcgcc

SEQ ID NO: 10449 - RNA, 23 nt, Artificial Sequence
  Synthetic
ggacccccaccgcauagagcgcc

SEQ ID NO: 10450 - RNA, 24 nt, Artificial Sequence
  Synthetic
uggacccccaccgcauagagcgcc

SEQ ID NO: 10451 - RNA, 18 nt, Artificial Sequence
  Synthetic
ggccaccuggccgaggcc

SEQ ID NO: 10452 - RNA, 19 nt, Artificial Sequence
  Synthetic
cggccaccuggccgaggcc

SEQ ID NO: 10453 - RNA, 20 nt, Artificial Sequence
  Synthetic
gcggccaccuggccgaggcc

SEQ ID NO: 10454 - RNA, 21 nt, Artificial Sequence
  Synthetic
cgcggccaccuggccgaggcc

SEQ ID NO: 10455 - RNA, 22 nt, Artificial Sequence
  Synthetic
gcgcggccaccuggccgaggcc

SEQ ID NO: 10456 - RNA, 23 nt, Artificial Sequence
  Synthetic
agcgcggccaccuggccgaggcc

SEQ ID NO: 10457 - RNA, 24 nt, Artificial Sequence
  Synthetic
aagcgcggccaccuggccgaggcc

SEQ ID NO: 10458 - RNA, 18 nt, Artificial Sequence
  Synthetic
uccccgggcgagucggcc

SEQ ID NO: 10459 - RNA, 19 nt, Artificial Sequence
  Synthetic
cuccccgggcgagucggcc

SEQ ID NO: 10460 - RNA, 20 nt, Artificial Sequence
  Synthetic
gcuccccgggcgagucggcc

SEQ ID NO: 10461 - RNA, 21 nt, Artificial Sequence
  Synthetic
ugcuccccgggcgagucggcc

SEQ ID NO: 10462 - RNA, 22 nt, Artificial Sequence
  Synthetic
cugcuccccgggcgagucggcc

SEQ ID NO: 10463 - RNA, 23 nt, Artificial Sequence
  Synthetic
gcugcuccccgggcgagucggcc

SEQ ID NO: 10464 - RNA, 24 nt, Artificial Sequence
  Synthetic
ggcugcuccccgggcgagucggcc

SEQ ID NO: 10465 - RNA, 18 nt, Artificial Sequence
  Synthetic
acgaccccaaccugaucc

SEQ ID NO: 10466 - RNA, 19 nt, Artificial Sequence
  Synthetic
aacgaccccaaccugaucc

SEQ ID NO: 10467 - RNA, 20 nt, Artificial Sequence
  Synthetic
gaacgaccccaaccugaucc

SEQ ID NO: 10468 - RNA, 21 nt, Artificial Sequence
  Synthetic
agaacgaccccaaccugaucc

SEQ ID NO: 10469 - RNA, 22 nt, Artificial Sequence
  Synthetic
gagaacgaccccaaccugaucc

SEQ ID NO: 10470 - RNA, 23 nt, Artificial Sequence
  Synthetic
cgagaacgaccccaaccugaucc

SEQ ID NO: 10471 - RNA, 24 nt, Artificial Sequence
  Synthetic
gcgagaacgaccccaaccugaucc

SEQ ID NO: 10472 - RNA, 18 nt, Artificial Sequence
  Synthetic
uccucgucggagcacucc

SEQ ID NO: 10473 - RNA, 19 nt, Artificial Sequence
  Synthetic
cuccucgucggagcacucc

SEQ ID NO: 10474 - RNA, 20 nt, Artificial Sequence
  Synthetic
ccuccucgucggagcacucc

SEQ ID NO: 10475 - RNA, 21 nt, Artificial Sequence
  Synthetic
gccuccucgucggagcacucc

SEQ ID NO: 10476 - RNA, 22 nt, Artificial Sequence
  Synthetic
ugccuccucgucggagcacucc

SEQ ID NO: 10477 - RNA, 23 nt, Artificial Sequence
  Synthetic
uugccuccucgucggagcacucc

SEQ ID NO: 10478 - RNA, 24 nt, Artificial Sequence
  Synthetic
uuugccuccucgucggagcacucc

SEQ ID NO: 10479 - RNA, 18 nt, Artificial Sequence
  Synthetic
cucuccaccgccagcucc

SEQ ID NO: 10480 - RNA, 19 nt, Artificial Sequence
  Synthetic
ucucuccaccgccagcucc

SEQ ID NO: 10481 - RNA, 20 nt, Artificial Sequence
  Synthetic
gucucuccaccgccagcucc

SEQ ID NO: 10482 - RNA, 21 nt, Artificial Sequence
  Synthetic
ggucucuccaccgccagcucc

SEQ ID NO: 10483 - RNA, 22 nt, Artificial Sequence
  Synthetic
cggucucuccaccgccagcucc

SEQ ID NO: 10484 - RNA, 23 nt, Artificial Sequence
  Synthetic
acggucucuccaccgccagcucc

SEQ ID NO: 10485 - RNA, 24 nt, Artificial Sequence
  Synthetic
gacggucucuccaccgccagcucc

SEQ ID NO: 10486 - RNA, 18 nt, Artificial Sequence
  Synthetic
aauggccgcggcugcucc

SEQ ID NO: 10487 - RNA, 19 nt, Artificial Sequence
  Synthetic
uaauggccgcggcugcucc

SEQ ID NO: 10488 - RNA, 20 nt, Artificial Sequence
  Synthetic
uuaauggccgcggcugcucc

SEQ ID NO: 10489 - RNA, 21 nt, Artificial Sequence
  Synthetic
guuaauggccgcggcugcucc

SEQ ID NO: 10490 - RNA, 22 nt, Artificial Sequence
  Synthetic
uguuaauggccgcggcugcucc

SEQ ID NO: 10491 - RNA, 23 nt, Artificial Sequence
  Synthetic
cuguuaauggccgcggcugcucc

SEQ ID NO: 10492 - RNA, 24 nt, Artificial Sequence
  Synthetic
acuguuaauggccgcggcugcucc

SEQ ID NO: 10493 - RNA, 18 nt, Artificial Sequence
  Synthetic
cuucccagccaccucucc

SEQ ID NO: 10494 - RNA, 19 nt, Artificial Sequence
  Synthetic
ccuucccagccaccucucc

SEQ ID NO: 10495 - RNA, 20 nt, Artificial Sequence
  Synthetic
uccuucccagccaccucucc

SEQ ID NO: 10496 - RNA, 21 nt, Artificial Sequence
  Synthetic
guccuucccagccaccucucc

SEQ ID NO: 10497 - RNA, 22 nt, Artificial Sequence
  Synthetic
uguccuucccagccaccucucc

SEQ ID NO: 10498 - RNA, 23 nt, Artificial Sequence
  Synthetic
auguccuucccagccaccucucc

SEQ ID NO: 10499 - RNA, 24 nt, Artificial Sequence
  Synthetic
aauguccuucccagccaccucucc

SEQ ID NO: 10500 - RNA, 18 nt, Artificial Sequence
  Synthetic
ucucuaagcgcaucaagc

SEQ ID NO: 10501 - RNA, 19 nt, Artificial Sequence
  Synthetic
uucucuaagcgcaucaagc

SEQ ID NO: 10502 - RNA, 20 nt, Artificial Sequence
  Synthetic
cuucucuaagcgcaucaagc

SEQ ID NO: 10503 - RNA, 21 nt, Artificial Sequence
  Synthetic
ccuucucuaagcgcaucaagc

SEQ ID NO: 10504 - RNA, 22 nt, Artificial Sequence
  Synthetic
cccuucucuaagcgcaucaagc

SEQ ID NO: 10505 - RNA, 23 nt, Artificial Sequence
  Synthetic
ccccuucucuaagcgcaucaagc

SEQ ID NO: 10506 - RNA, 24 nt, Artificial Sequence
  Synthetic
gccccuucucuaagcgcaucaagc

SEQ ID NO: 10507 - RNA, 18 nt, Artificial Sequence
  Synthetic
caguuuucggauggaagc

SEQ ID NO: 10508 - RNA, 19 nt, Artificial Sequence
  Synthetic
gcaguuuucggauggaagc

SEQ ID NO: 10509 - RNA, 20 nt, Artificial Sequence
  Synthetic
ggcaguuuucggauggaagc

SEQ ID NO: 10510 - RNA, 21 nt, Artificial Sequence
  Synthetic
uggcaguuuucggauggaagc

SEQ ID NO: 10511 - RNA, 22 nt, Artificial Sequence
  Synthetic
guggcaguuuucggauggaagc

SEQ ID NO: 10512 - RNA, 23 nt, Artificial Sequence
  Synthetic
uguggcaguuuucggauggaagc

SEQ ID NO: 10513 - RNA, 24 nt, Artificial Sequence
  Synthetic
guguggcaguuuucggauggaagc

SEQ ID NO: 10514 - RNA, 18 nt, Artificial Sequence
  Synthetic
guggccaaguucaagagc

SEQ ID NO: 10515 - RNA, 19 nt, Artificial Sequence
  Synthetic
gguggccaaguucaagagc

SEQ ID NO: 10516 - RNA, 20 nt, Artificial Sequence
  Synthetic
ugguggccaaguucaagagc

SEQ ID NO: 10517 - RNA, 21 nt, Artificial Sequence
  Synthetic
gugguggccaaguucaagagc

SEQ ID NO: 10518 - RNA, 22 nt, Artificial Sequence
  Synthetic
cgugguggccaaguucaagagc

SEQ ID NO: 10519 - RNA, 23 nt, Artificial Sequence
  Synthetic
ccgugguggccaaguucaagagc

SEQ ID NO: 10520 - RNA, 24 nt, Artificial Sequence
  Synthetic
uccgugguggccaaguucaagagc

SEQ ID NO: 10521 - RNA, 18 nt, Artificial Sequence
  Synthetic
gaggagcugacggagagc

SEQ ID NO: 10522 - RNA, 19 nt, Artificial Sequence
  Synthetic
ggaggagcugacggagagc

SEQ ID NO: 10523 - RNA, 20 nt, Artificial Sequence
  Synthetic
aggaggagcugacggagagc

SEQ ID NO: 10524 - RNA, 21 nt, Artificial Sequence
  Synthetic
gaggaggagcugacggagagc

SEQ ID NO: 10525 - RNA, 22 nt, Artificial Sequence
  Synthetic
ggaggaggagcugacggagagc

SEQ ID NO: 10526 - RNA, 23 nt, Artificial Sequence
  Synthetic
aggaggaggagcugacggagagc

SEQ ID NO: 10527 - RNA, 24 nt, Artificial Sequence
  Synthetic
gaggaggaggagcugacggagagc

SEQ ID NO: 10528 - RNA, 18 nt, Artificial Sequence
  Synthetic
uacggcuucgggcugagc

SEQ ID NO: 10529 - RNA, 19 nt, Artificial Sequence
  Synthetic
cuacggcuucgggcugagc

SEQ ID NO: 10530 - RNA, 20 nt, Artificial Sequence
  Synthetic
acuacggcuucgggcugagc

SEQ ID NO: 10531 - RNA, 21 nt, Artificial Sequence
  Synthetic
gacuacggcuucgggcugagc

SEQ ID NO: 10532 - RNA, 22 nt, Artificial Sequence
  Synthetic
ggacuacggcuucgggcugagc

SEQ ID NO: 10533 - RNA, 23 nt, Artificial Sequence
  Synthetic
uggacuacggcuucgggcugagc

SEQ ID NO: 10534 - RNA, 24 nt, Artificial Sequence
  Synthetic
guggacuacggcuucgggcugagc

SEQ ID NO: 10535 - RNA, 18 nt, Artificial Sequence
  Synthetic
ugcgcuucuccacaccgc

SEQ ID NO: 10536 - RNA, 19 nt, Artificial Sequence
  Synthetic
uugcgcuucuccacaccgc

SEQ ID NO: 10537 - RNA, 20 nt, Artificial Sequence
  Synthetic
uuugcgcuucuccacaccgc

SEQ ID NO: 10538 - RNA, 21 nt, Artificial Sequence
  Synthetic
guuugcgcuucuccacaccgc

SEQ ID NO: 10539 - RNA, 22 nt, Artificial Sequence
  Synthetic
aguuugcgcuucuccacaccgc

SEQ ID NO: 10540 - RNA, 23 nt, Artificial Sequence
  Synthetic
gaguuugcgcuucuccacaccgc

SEQ ID NO: 10541 - RNA, 24 nt, Artificial Sequence
  Synthetic
ggaguuugcgcuucuccacaccgc

SEQ ID NO: 10542 - RNA, 18 nt, Artificial Sequence
  Synthetic
ccccaccgcauagagcgc

SEQ ID NO: 10543 - RNA, 19 nt, Artificial Sequence
  Synthetic
cccccaccgcauagagcgc

SEQ ID NO: 10544 - RNA, 20 nt, Artificial Sequence
  Synthetic
acccccaccgcauagagcgc

SEQ ID NO: 10545 - RNA, 21 nt, Artificial Sequence
  Synthetic
gacccccaccgcauagagcgc

SEQ ID NO: 10546 - RNA, 22 nt, Artificial Sequence
  Synthetic
ggacccccaccgcauagagcgc

SEQ ID NO: 10547 - RNA, 23 nt, Artificial Sequence
  Synthetic
uggacccccaccgcauagagcgc

SEQ ID NO: 10548 - RNA, 24 nt, Artificial Sequence
  Synthetic
uuggacccccaccgcauagagcgc

SEQ ID NO: 10549 - RNA, 18 nt, Artificial Sequence
  Synthetic
aucucggggcgcagcggc

SEQ ID NO: 10550 - RNA, 19 nt, Artificial Sequence
  Synthetic
gaucucggggcgcagcggc

SEQ ID NO: 10551 - RNA, 20 nt, Artificial Sequence
  Synthetic
ggaucucggggcgcagcggc

SEQ ID NO: 10552 - RNA, 21 nt, Artificial Sequence
  Synthetic
gggaucucggggcgcagcggc

SEQ ID NO: 10553 - RNA, 22 nt, Artificial Sequence
  Synthetic
agggaucucggggcgcagcggc

SEQ ID NO: 10554 - RNA, 23 nt, Artificial Sequence
  Synthetic
gagggaucucggggcgcagcggc

SEQ ID NO: 10555 - RNA, 24 nt, Artificial Sequence
  Synthetic
ggagggaucucggggcgcagcggc

SEQ ID NO: 10556 - RNA, 18 nt, Artificial Sequence
  Synthetic
cggcgcagccacacgggc

SEQ ID NO: 10557 - RNA, 19 nt, Artificial Sequence
  Synthetic
ccggcgcagccacacgggc

SEQ ID NO: 10558 - RNA, 20 nt, Artificial Sequence
  Synthetic
accggcgcagccacacgggc

SEQ ID NO: 10559 - RNA, 21 nt, Artificial Sequence
  Synthetic
caccggcgcagccacacgggc

SEQ ID NO: 10560 - RNA, 22 nt, Artificial Sequence
  Synthetic
gcaccggcgcagccacacgggc

SEQ ID NO: 10561 - RNA, 23 nt, Artificial Sequence
  Synthetic
ugcaccggcgcagccacacgggc

SEQ ID NO: 10562 - RNA, 24 nt, Artificial Sequence
  Synthetic
gugcaccggcgcagccacacgggc

SEQ ID NO: 10563 - RNA, 18 nt, Artificial Sequence
  Synthetic
cauauuagugguccgggc

SEQ ID NO: 10564 - RNA, 19 nt, Artificial Sequence
  Synthetic
ccauauuagugguccgggc

SEQ ID NO: 10565 - RNA, 20 nt, Artificial Sequence
  Synthetic
cccauauuagugguccgggc

SEQ ID NO: 10566 - RNA, 21 nt, Artificial Sequence
  Synthetic
ccccauauuagugguccgggc

SEQ ID NO: 10567 - RNA, 22 nt, Artificial Sequence
  Synthetic
gccccauauuagugguccgggc

SEQ ID NO: 10568 - RNA, 23 nt, Artificial Sequence
  Synthetic
cgccccauauuagugguccgggc

SEQ ID NO: 10569 - RNA, 24 nt, Artificial Sequence
  Synthetic
acgccccauauuagugguccgggc

SEQ ID NO: 10570 - RNA, 18 nt, Artificial Sequence
  Synthetic
uuccaccagguccugggc

SEQ ID NO: 10571 - RNA, 19 nt, Artificial Sequence
  Synthetic
cuuccaccagguccugggc

SEQ ID NO: 10572 - RNA, 20 nt, Artificial Sequence
  Synthetic
ccuuccaccagguccugggc

SEQ ID NO: 10573 - RNA, 21 nt, Artificial Sequence
  Synthetic
gccuuccaccagguccugggc

SEQ ID NO: 10574 - RNA, 22 nt, Artificial Sequence
  Synthetic
ggccuuccaccagguccugggc

SEQ ID NO: 10575 - RNA, 23 nt, Artificial Sequence
  Synthetic
aggccuuccaccagguccugggc

SEQ ID NO: 10576 - RNA, 24 nt, Artificial Sequence
  Synthetic
gaggccuuccaccagguccugggc

SEQ ID NO: 10577 - RNA, 18 nt, Artificial Sequence
  Synthetic
cggggcgcggucgugggc

SEQ ID NO: 10578 - RNA, 19 nt, Artificial Sequence
  Synthetic
gcggggcgcggucgugggc

SEQ ID NO: 10579 - RNA, 20 nt, Artificial Sequence
  Synthetic
cgcggggcgcggucgugggc

SEQ ID NO: 10580 - RNA, 21 nt, Artificial Sequence
  Synthetic
ucgcggggcgcggucgugggc

SEQ ID NO: 10581 - RNA, 22 nt, Artificial Sequence
  Synthetic
cucgcggggcgcggucgugggc

SEQ ID NO: 10582 - RNA, 23 nt, Artificial Sequence
  Synthetic
gcucgcggggcgcggucgugggc

SEQ ID NO: 10583 - RNA, 24 nt, Artificial Sequence
  Synthetic
agcucgcggggcgcggucgugggc

SEQ ID NO: 10584 - RNA, 18 nt, Artificial Sequence
  Synthetic
gagacuuagagagcuggc

SEQ ID NO: 10585 - RNA, 19 nt, Artificial Sequence
  Synthetic
ggagacuuagagagcuggc

SEQ ID NO: 10586 - RNA, 20 nt, Artificial Sequence
  Synthetic
aggagacuuagagagcuggc

SEQ ID NO: 10587 - RNA, 21 nt, Artificial Sequence
  Synthetic
uaggagacuuagagagcuggc

SEQ ID NO: 10588 - RNA, 22 nt, Artificial Sequence
  Synthetic
cuaggagacuuagagagcuggc

SEQ ID NO: 10589 - RNA, 23 nt, Artificial Sequence
  Synthetic
ucuaggagacuuagagagcuggc

SEQ ID NO: 10590 - RNA, 24 nt, Artificial Sequence
  Synthetic
cucuaggagacuuagagagcuggc

SEQ ID NO: 10591 - RNA, 18 nt, Artificial Sequence
  Synthetic
gagcuggacggagggauc

SEQ ID NO: 10592 - RNA, 19 nt, Artificial Sequence
  Synthetic
ggagcuggacggagggauc

SEQ ID NO: 10593 - RNA, 20 nt, Artificial Sequence
  Synthetic
gggagcuggacggagggauc

SEQ ID NO: 10594 - RNA, 21 nt, Artificial Sequence
  Synthetic
ggggagcuggacggagggauc

SEQ ID NO: 10595 - RNA, 22 nt, Artificial Sequence
  Synthetic
cggggagcuggacggagggauc

SEQ ID NO: 10596 - RNA, 23 nt, Artificial Sequence
  Synthetic
ccggggagcuggacggagggauc

SEQ ID NO: 10597 - RNA, 24 nt, Artificial Sequence
  Synthetic
cccggggagcuggacggagggauc

SEQ ID NO: 10598 - RNA, 18 nt, Artificial Sequence
  Synthetic
aacgaccccaaccugauc

SEQ ID NO: 10599 - RNA, 19 nt, Artificial Sequence
  Synthetic
gaacgaccccaaccugauc

SEQ ID NO: 10600 - RNA, 20 nt, Artificial Sequence
  Synthetic
agaacgaccccaaccugauc

SEQ ID NO: 10601 - RNA, 21 nt, Artificial Sequence
  Synthetic
gagaacgaccccaaccugauc

SEQ ID NO: 10602 - RNA, 22 nt, Artificial Sequence
  Synthetic
cgagaacgaccccaaccugauc

SEQ ID NO: 10603 - RNA, 23 nt, Artificial Sequence
  Synthetic
gcgagaacgaccccaaccugauc

SEQ ID NO: 10604 - RNA, 24 nt, Artificial Sequence
  Synthetic
agcgagaacgaccccaaccugauc

SEQ ID NO: 10605 - RNA, 18 nt, Artificial Sequence
  Synthetic
aauaccaggaucaguauc

SEQ ID NO: 10606 - RNA, 19 nt, Artificial Sequence
  Synthetic
gaauaccaggaucaguauc

SEQ ID NO: 10607 - RNA, 20 nt, Artificial Sequence
  Synthetic
agaauaccaggaucaguauc

SEQ ID NO: 10608 - RNA, 21 nt, Artificial Sequence
  Synthetic
aagaauaccaggaucaguauc

SEQ ID NO: 10609 - RNA, 22 nt, Artificial Sequence
  Synthetic
uaagaauaccaggaucaguauc

SEQ ID NO: 10610 - RNA, 23 nt, Artificial Sequence
  Synthetic
cuaagaauaccaggaucaguauc

SEQ ID NO: 10611 - RNA, 24 nt, Artificial Sequence
  Synthetic
gcuaagaauaccaggaucaguauc

SEQ ID NO: 10612 - RNA, 18 nt, Artificial Sequence
  Synthetic
cccgggcgagucggccuc

SEQ ID NO: 10613 - RNA, 19 nt, Artificial Sequence
  Synthetic
ccccgggcgagucggccuc

SEQ ID NO: 10614 - RNA, 20 nt, Artificial Sequence
  Synthetic
uccccgggcgagucggccuc

SEQ ID NO: 10615 - RNA, 21 nt, Artificial Sequence
  Synthetic
cuccccgggcgagucggccuc

SEQ ID NO: 10616 - RNA, 22 nt, Artificial Sequence
  Synthetic
gcuccccgggcgagucggccuc

SEQ ID NO: 10617 - RNA, 23 nt, Artificial Sequence
  Synthetic
ugcuccccgggcgagucggccuc

SEQ ID NO: 10618 - RNA, 24 nt, Artificial Sequence
  Synthetic
cugcuccccgggcgagucggccuc

SEQ ID NO: 10619 - RNA, 18 nt, Artificial Sequence
  Synthetic
ucuaagcgcaucaagcuc

SEQ ID NO: 10620 - RNA, 19 nt, Artificial Sequence
  Synthetic
cucuaagcgcaucaagcuc

SEQ ID NO: 10621 - RNA, 20 nt, Artificial Sequence
  Synthetic
ucucuaagcgcaucaagcuc

SEQ ID NO: 10622 - RNA, 21 nt, Artificial Sequence
  Synthetic
uucucuaagcgcaucaagcuc

SEQ ID NO: 10623 - RNA, 22 nt, Artificial Sequence
  Synthetic
cuucucuaagcgcaucaagcuc

SEQ ID NO: 10624 - RNA, 23 nt, Artificial Sequence
  Synthetic
ccuucucuaagcgcaucaagcuc

SEQ ID NO: 10625 - RNA, 24 nt, Artificial Sequence
  Synthetic
cccuucucuaagcgcaucaagcuc

SEQ ID NO: 10626 - RNA, 18 nt, Artificial Sequence
  Synthetic
guuuucggauggaagcuc

SEQ ID NO: 10627 - RNA, 19 nt, Artificial Sequence
  Synthetic
aguuuucggauggaagcuc

SEQ ID NO: 10628 - RNA, 20 nt, Artificial Sequence
  Synthetic
caguuuucggauggaagcuc

SEQ ID NO: 10629 - RNA, 21 nt, Artificial Sequence
  Synthetic
gcaguuuucggauggaagcuc

SEQ ID NO: 10630 - RNA, 22 nt, Artificial Sequence
  Synthetic
ggcaguuuucggauggaagcuc

SEQ ID NO: 10631 - RNA, 23 nt, Artificial Sequence
  Synthetic
uggcaguuuucggauggaagcuc

SEQ ID NO: 10632 - RNA, 24 nt, Artificial Sequence
  Synthetic
guggcaguuuucggauggaagcuc

SEQ ID NO: 10633 - RNA, 18 nt, Artificial Sequence
  Synthetic
ccaccacgagaacagcuc

SEQ ID NO: 10634 - RNA, 19 nt, Artificial Sequence
  Synthetic
gccaccacgagaacagcuc

SEQ ID NO: 10635 - RNA, 20 nt, Artificial Sequence
  Synthetic
cgccaccacgagaacagcuc

SEQ ID NO: 10636 - RNA, 21 nt, Artificial Sequence
  Synthetic
gcgccaccacgagaacagcuc

SEQ ID NO: 10637 - RNA, 22 nt, Artificial Sequence
  Synthetic
cgcgccaccacgagaacagcuc

SEQ ID NO: 10638 - RNA, 23 nt, Artificial Sequence
  Synthetic
gcgcgccaccacgagaacagcuc

SEQ ID NO: 10639 - RNA, 24 nt, Artificial Sequence
  Synthetic
ggcgcgccaccacgagaacagcuc

SEQ ID NO: 10640 - RNA, 18 nt, Artificial Sequence
  Synthetic
ucccgccauggauuucuc

SEQ ID NO: 10641 - RNA, 19 nt, Artificial Sequence
  Synthetic
cucccgccauggauuucuc

SEQ ID NO: 10642 - RNA, 20 nt, Artificial Sequence
  Synthetic
ccucccgccauggauuucuc

SEQ ID NO: 10643 - RNA, 21 nt, Artificial Sequence
  Synthetic
gccucccgccauggauuucuc

SEQ ID NO: 10644 - RNA, 22 nt, Artificial Sequence
  Synthetic
agccucccgccauggauuucuc

SEQ ID NO: 10645 - RNA, 23 nt, Artificial Sequence
  Synthetic
gagccucccgccauggauuucuc

SEQ ID NO: 10646 - RNA, 24 nt, Artificial Sequence
  Synthetic
ggagccucccgccauggauuucuc

SEQ ID NO: 10647 - RNA, 18 nt, Artificial Sequence
  Synthetic
gaggccuuccaccagguc

SEQ ID NO: 10648 - RNA, 19 nt, Artificial Sequence
  Synthetic
cgaggccuuccaccagguc

SEQ ID NO: 10649 - RNA, 20 nt, Artificial Sequence
  Synthetic
gcgaggccuuccaccagguc

SEQ ID NO: 10650 - RNA, 21 nt, Artificial Sequence
  Synthetic
agcgaggccuuccaccagguc

SEQ ID NO: 10651 - RNA, 22 nt, Artificial Sequence
  Synthetic
cagcgaggccuuccaccagguc

SEQ ID NO: 10652 - RNA, 23 nt, Artificial Sequence
  Synthetic
ucagcgaggccuuccaccagguc

SEQ ID NO: 10653 - RNA, 24 nt, Artificial Sequence
  Synthetic
uucagcgaggccuuccaccagguc

SEQ ID NO: 10654 - RNA, 18 nt, Artificial Sequence
  Synthetic
agcucgcggggcgcgguc

SEQ ID NO: 10655 - RNA, 19 nt, Artificial Sequence
  Synthetic
cagcucgcggggcgcgguc

SEQ ID NO: 10656 - RNA, 20 nt, Artificial Sequence
  Synthetic
acagcucgcggggcgcgguc

SEQ ID NO: 10657 - RNA, 21 nt, Artificial Sequence
  Synthetic
aacagcucgcggggcgcgguc

SEQ ID NO: 10658 - RNA, 22 nt, Artificial Sequence
  Synthetic
gaacagcucgcggggcgcgguc

SEQ ID NO: 10659 - RNA, 23 nt, Artificial Sequence
  Synthetic
agaacagcucgcggggcgcgguc

SEQ ID NO: 10660 - RNA, 24 nt, Artificial Sequence
  Synthetic
gagaacagcucgcggggcgcgguc

SEQ ID NO: 10661 - RNA, 18 nt, Artificial Sequence
  Synthetic
uacugugggaaagucuuc

SEQ ID NO: 10662 - RNA, 19 nt, Artificial Sequence
  Synthetic
guacugugggaaagucuuc

SEQ ID NO: 10663 - RNA, 20 nt, Artificial Sequence
  Synthetic
aguacugugggaaagucuuc

SEQ ID NO: 10664 - RNA, 21 nt, Artificial Sequence
  Synthetic
gaguacugugggaaagucuuc

SEQ ID NO: 10665 - RNA, 22 nt, Artificial Sequence
  Synthetic
ugaguacugugggaaagucuuc

SEQ ID NO: 10666 - RNA, 23 nt, Artificial Sequence
  Synthetic
gugaguacugugggaaagucuuc

SEQ ID NO: 10667 - RNA, 24 nt, Artificial Sequence
  Synthetic
ugugaguacugugggaaagucuuc

SEQ ID NO: 10668 - RNA, 18 nt, Artificial Sequence
  Synthetic
uccgugguggccaaguuc

SEQ ID NO: 10669 - RNA, 19 nt, Artificial Sequence
  Synthetic
guccgugguggccaaguuc

SEQ ID NO: 10670 - RNA, 20 nt, Artificial Sequence
  Synthetic
aguccgugguggccaaguuc

SEQ ID NO: 10671 - RNA, 21 nt, Artificial Sequence
  Synthetic
aaguccgugguggccaaguuc

SEQ ID NO: 10672 - RNA, 22 nt, Artificial Sequence
  Synthetic
caaguccgugguggccaaguuc

SEQ ID NO: 10673 - RNA, 23 nt, Artificial Sequence
  Synthetic
ucaaguccgugguggccaaguuc

SEQ ID NO: 10674 - RNA, 24 nt, Artificial Sequence
  Synthetic
cucaaguccgugguggccaaguuc

SEQ ID NO: 10675 - RNA, 18 nt, Artificial Sequence
  Synthetic
auuauuuugcagguaaag

SEQ ID NO: 10676 - RNA, 19 nt, Artificial Sequence
  Synthetic
uauuauuuugcagguaaag

SEQ ID NO: 10677 - RNA, 20 nt, Artificial Sequence
  Synthetic
guauuauuuugcagguaaag

SEQ ID NO: 10678 - RNA, 18 nt, Artificial Sequence
  Synthetic
ugcacccaggccagcaag

SEQ ID NO: 10679 - RNA, 19 nt, Artificial Sequence
  Synthetic
gugcacccaggccagcaag

SEQ ID NO: 10680 - RNA, 20 nt, Artificial Sequence
  Synthetic
cgugcacccaggccagcaag

SEQ ID NO: 10681 - RNA, 21 nt, Artificial Sequence
  Synthetic
gcgugcacccaggccagcaag

SEQ ID NO: 10682 - RNA, 22 nt, Artificial Sequence
  Synthetic
cgcgugcacccaggccagcaag

SEQ ID NO: 10683 - RNA, 23 nt, Artificial Sequence
  Synthetic
acgcgugcacccaggccagcaag

SEQ ID NO: 10684 - RNA, 24 nt, Artificial Sequence
  Synthetic
cacgcgugcacccaggccagcaag

SEQ ID NO: 10685 - RNA, 18 nt, Artificial Sequence
  Synthetic
acgaggaagaggaagaag

SEQ ID NO: 10686 - RNA, 19 nt, Artificial Sequence
  Synthetic
gacgaggaagaggaagaag

SEQ ID NO: 10687 - RNA, 20 nt, Artificial Sequence
  Synthetic
cgacgaggaagaggaagaag

SEQ ID NO: 10688 - RNA, 21 nt, Artificial Sequence
  Synthetic
acgacgaggaagaggaagaag

SEQ ID NO: 10689 - RNA, 22 nt, Artificial Sequence
  Synthetic
gacgacgaggaagaggaagaag

SEQ ID NO: 10690 - RNA, 23 nt, Artificial Sequence
  Synthetic
ggacgacgaggaagaggaagaag

SEQ ID NO: 10691 - RNA, 24 nt, Artificial Sequence
  Synthetic
aggacgacgaggaagaggaagaag

SEQ ID NO: 10692 - RNA, 18 nt, Artificial Sequence
  Synthetic
acgacgaggaagaggaag

SEQ ID NO: 10693 - RNA, 19 nt, Artificial Sequence
  Synthetic
gacgacgaggaagaggaag

SEQ ID NO: 10694 - RNA, 20 nt, Artificial Sequence
  Synthetic
ggacgacgaggaagaggaag

SEQ ID NO: 10695 - RNA, 21 nt, Artificial Sequence
  Synthetic
aggacgacgaggaagaggaag

SEQ ID NO: 10696 - RNA, 22 nt, Artificial Sequence
  Synthetic
gaggacgacgaggaagaggaag

SEQ ID NO: 10697 - RNA, 23 nt, Artificial Sequence
  Synthetic
ggaggacgacgaggaagaggaag

SEQ ID NO: 10698 - RNA, 24 nt, Artificial Sequence
  Synthetic
aggaggacgacgaggaagaggaag

SEQ ID NO: 10699 - RNA, 18 nt, Artificial Sequence
  Synthetic
aggaggacgacgaggaag

SEQ ID NO: 10700 - RNA, 19 nt, Artificial Sequence
  Synthetic
gaggaggacgacgaggaag

SEQ ID NO: 10701 - RNA, 20 nt, Artificial Sequence
  Synthetic
agaggaggacgacgaggaag

SEQ ID NO: 10702 - RNA, 21 nt, Artificial Sequence
  Synthetic
aagaggaggacgacgaggaag

SEQ ID NO: 10703 - RNA, 22 nt, Artificial Sequence
  Synthetic
gaagaggaggacgacgaggaag

SEQ ID NO: 10704 - RNA, 23 nt, Artificial Sequence
  Synthetic
ggaagaggaggacgacgaggaag

SEQ ID NO: 10705 - RNA, 24 nt, Artificial Sequence
  Synthetic
aggaagaggaggacgacgaggaag

SEQ ID NO: 10706 - RNA, 18 nt, Artificial Sequence
  Synthetic
aggaagaagaggaggaag

SEQ ID NO: 10707 - RNA, 19 nt, Artificial Sequence
  Synthetic
gaggaagaagaggaggaag

SEQ ID NO: 10708 - RNA, 20 nt, Artificial Sequence
  Synthetic
agaggaagaagaggaggaag

SEQ ID NO: 10709 - RNA, 21 nt, Artificial Sequence
  Synthetic
aagaggaagaagaggaggaag

SEQ ID NO: 10710 - RNA, 22 nt, Artificial Sequence
  Synthetic
gaagaggaagaagaggaggaag

SEQ ID NO: 10711 - RNA, 23 nt, Artificial Sequence
  Synthetic
ggaagaggaagaagaggaggaag

SEQ ID NO: 10712 - RNA, 24 nt, Artificial Sequence
  Synthetic
aggaagaggaagaagaggaggaag

SEQ ID NO: 10713 - RNA, 18 nt, Artificial Sequence
  Synthetic
acggggacgaggaggaag

SEQ ID NO: 10714 - RNA, 19 nt, Artificial Sequence
  Synthetic
aacggggacgaggaggaag

SEQ ID NO: 10715 - RNA, 20 nt, Artificial Sequence
  Synthetic
gaacggggacgaggaggaag

SEQ ID NO: 10716 - RNA, 21 nt, Artificial Sequence
  Synthetic
agaacggggacgaggaggaag

SEQ ID NO: 10717 - RNA, 22 nt, Artificial Sequence
  Synthetic
gagaacggggacgaggaggaag

SEQ ID NO: 10718 - RNA, 23 nt, Artificial Sequence
  Synthetic
ggagaacggggacgaggaggaag

SEQ ID NO: 10719 - RNA, 24 nt, Artificial Sequence
  Synthetic
cggagaacggggacgaggaggaag

SEQ ID NO: 10720 - RNA, 18 nt, Artificial Sequence
  Synthetic
gcgcagcggcacgggaag

SEQ ID NO: 10721 - RNA, 19 nt, Artificial Sequence
  Synthetic
ggcgcagcggcacgggaag

SEQ ID NO: 10722 - RNA, 20 nt, Artificial Sequence
  Synthetic
gggcgcagcggcacgggaag

SEQ ID NO: 10723 - RNA, 21 nt, Artificial Sequence
  Synthetic
ggggcgcagcggcacgggaag

SEQ ID NO: 10724 - RNA, 22 nt, Artificial Sequence
  Synthetic
cggggcgcagcggcacgggaag

SEQ ID NO: 10725 - RNA, 23 nt, Artificial Sequence
  Synthetic
ucggggcgcagcggcacgggaag

SEQ ID NO: 10726 - RNA, 24 nt, Artificial Sequence
  Synthetic
cucggggcgcagcggcacgggaag

SEQ ID NO: 10727 - RNA, 18 nt, Artificial Sequence
  Synthetic
aggcuuccggccuggcag

SEQ ID NO: 10728 - RNA, 19 nt, Artificial Sequence
  Synthetic
gaggcuuccggccuggcag

SEQ ID NO: 10729 - RNA, 20 nt, Artificial Sequence
  Synthetic
agaggcuuccggccuggcag

SEQ ID NO: 10730 - RNA, 21 nt, Artificial Sequence
  Synthetic
gagaggcuuccggccuggcag

SEQ ID NO: 10731 - RNA, 22 nt, Artificial Sequence
  Synthetic
agagaggcuuccggccuggcag

SEQ ID NO: 10732 - RNA, 23 nt, Artificial Sequence
  Synthetic
gagagaggcuuccggccuggcag

SEQ ID NO: 10733 - RNA, 24 nt, Artificial Sequence
  Synthetic
cgagagaggcuuccggccuggcag

SEQ ID NO: 10734 - RNA, 18 nt, Artificial Sequence
  Synthetic
gaggaagaggaagaagag

SEQ ID NO: 10735 - RNA, 19 nt, Artificial Sequence
  Synthetic
cgaggaagaggaagaagag

SEQ ID NO: 10736 - RNA, 20 nt, Artificial Sequence
  Synthetic
acgaggaagaggaagaagag

SEQ ID NO: 10737 - RNA, 21 nt, Artificial Sequence
  Synthetic
gacgaggaagaggaagaagag

SEQ ID NO: 10738 - RNA, 22 nt, Artificial Sequence
  Synthetic
cgacgaggaagaggaagaagag

SEQ ID NO: 10739 - RNA, 23 nt, Artificial Sequence
  Synthetic
acgacgaggaagaggaagaagag

SEQ ID NO: 10740 - RNA, 24 nt, Artificial Sequence
  Synthetic
gacgacgaggaagaggaagaagag

SEQ ID NO: 10741 - RNA, 18 nt, Artificial Sequence
  Synthetic
gaagaagaggaggaagag

SEQ ID NO: 10742 - RNA, 19 nt, Artificial Sequence
  Synthetic
ggaagaagaggaggaagag

SEQ ID NO: 10743 - RNA, 20 nt, Artificial Sequence
  Synthetic
aggaagaagaggaggaagag

SEQ ID NO: 10744 - RNA, 21 nt, Artificial Sequence
  Synthetic
gaggaagaagaggaggaagag

SEQ ID NO: 10745 - RNA, 22 nt, Artificial Sequence
  Synthetic
agaggaagaagaggaggaagag

SEQ ID NO: 10746 - RNA, 23 nt, Artificial Sequence
  Synthetic
aagaggaagaagaggaggaagag

SEQ ID NO: 10747 - RNA, 24 nt, Artificial Sequence
  Synthetic
gaagaggaagaagaggaggaagag

SEQ ID NO: 10748 - RNA, 18 nt, Artificial Sequence
  Synthetic
ggggacgaggaggaagag

SEQ ID NO: 10749 - RNA, 19 nt, Artificial Sequence
  Synthetic
cggggacgaggaggaagag

SEQ ID NO: 10750 - RNA, 20 nt, Artificial Sequence
  Synthetic
acggggacgaggaggaagag

SEQ ID NO: 10751 - RNA, 21 nt, Artificial Sequence
  Synthetic
aacggggacgaggaggaagag

SEQ ID NO: 10752 - RNA, 22 nt, Artificial Sequence
  Synthetic
gaacggggacgaggaggaagag

SEQ ID NO: 10753 - RNA, 23 nt, Artificial Sequence
  Synthetic
agaacggggacgaggaggaagag

SEQ ID NO: 10754 - RNA, 24 nt, Artificial Sequence
  Synthetic
gagaacggggacgaggaggaagag

SEQ ID NO: 10755 - RNA, 18 nt, Artificial Sequence
  Synthetic
ccggagaacggggacgag

SEQ ID NO: 10756 - RNA, 19 nt, Artificial Sequence
  Synthetic
cccggagaacggggacgag

SEQ ID NO: 10757 - RNA, 20 nt, Artificial Sequence
  Synthetic
ucccggagaacggggacgag

SEQ ID NO: 10758 - RNA, 21 nt, Artificial Sequence
  Synthetic
aucccggagaacggggacgag

SEQ ID NO: 10759 - RNA, 22 nt, Artificial Sequence
  Synthetic
gaucccggagaacggggacgag

SEQ ID NO: 10760 - RNA, 23 nt, Artificial Sequence
  Synthetic
ugaucccggagaacggggacgag

SEQ ID NO: 10761 - RNA, 24 nt, Artificial Sequence
  Synthetic
cugaucccggagaacggggacgag

SEQ ID NO: 10762 - RNA, 18 nt, Artificial Sequence
  Synthetic
gacucgguggccggcgag

SEQ ID NO: 10763 - RNA, 19 nt, Artificial Sequence
  Synthetic
agacucgguggccggcgag

SEQ ID NO: 10764 - RNA, 20 nt, Artificial Sequence
  Synthetic
aagacucgguggccggcgag

SEQ ID NO: 10765 - RNA, 21 nt, Artificial Sequence
  Synthetic
gaagacucgguggccggcgag

SEQ ID NO: 10766 - RNA, 22 nt, Artificial Sequence
  Synthetic
cgaagacucgguggccggcgag

SEQ ID NO: 10767 - RNA, 23 nt, Artificial Sequence
  Synthetic
acgaagacucgguggccggcgag

SEQ ID NO: 10768 - RNA, 24 nt, Artificial Sequence
  Synthetic
gacgaagacucgguggccggcgag

SEQ ID NO: 10769 - RNA, 18 nt, Artificial Sequence
  Synthetic
aagcgcaucaagcucgag

SEQ ID NO: 10770 - RNA, 19 nt, Artificial Sequence
  Synthetic
uaagcgcaucaagcucgag

SEQ ID NO: 10771 - RNA, 20 nt, Artificial Sequence
  Synthetic
cuaagcgcaucaagcucgag

SEQ ID NO: 10772 - RNA, 21 nt, Artificial Sequence
  Synthetic
ucuaagcgcaucaagcucgag

SEQ ID NO: 10773 - RNA, 22 nt, Artificial Sequence
  Synthetic
cucuaagcgcaucaagcucgag

SEQ ID NO: 10774 - RNA, 23 nt, Artificial Sequence
  Synthetic
ucucuaagcgcaucaagcucgag

SEQ ID NO: 10775 - RNA, 24 nt, Artificial Sequence
  Synthetic
uucucuaagcgcaucaagcucgag

SEQ ID NO: 10776 - RNA, 18 nt, Artificial Sequence
  Synthetic
gaagaggaggaagaggag

SEQ ID NO: 10777 - RNA, 19 nt, Artificial Sequence
  Synthetic
agaagaggaggaagaggag

SEQ ID NO: 10778 - RNA, 20 nt, Artificial Sequence
  Synthetic
aagaagaggaggaagaggag

SEQ ID NO: 10779 - RNA, 21 nt, Artificial Sequence
  Synthetic
gaagaagaggaggaagaggag

SEQ ID NO: 10780 - RNA, 22 nt, Artificial Sequence
  Synthetic
ggaagaagaggaggaagaggag

SEQ ID NO: 10781 - RNA, 23 nt, Artificial Sequence
  Synthetic
aggaagaagaggaggaagaggag

SEQ ID NO: 10782 - RNA, 24 nt, Artificial Sequence
  Synthetic
gaggaagaagaggaggaagaggag

SEQ ID NO: 10783 - RNA, 18 nt, Artificial Sequence
  Synthetic
gaggaggaagaggaggag

SEQ ID NO: 10784 - RNA, 19 nt, Artificial Sequence
  Synthetic
agaggaggaagaggaggag

SEQ ID NO: 10785 - RNA, 20 nt, Artificial Sequence
  Synthetic
aagaggaggaagaggaggag

SEQ ID NO: 10786 - RNA, 21 nt, Artificial Sequence
  Synthetic
gaagaggaggaagaggaggag

SEQ ID NO: 10787 - RNA, 22 nt, Artificial Sequence
  Synthetic
agaagaggaggaagaggaggag

SEQ ID NO: 10788 - RNA, 23 nt, Artificial Sequence
  Synthetic
aagaagaggaggaagaggaggag

SEQ ID NO: 10789 - RNA, 24 nt, Artificial Sequence
  Synthetic
gaagaagaggaggaagaggaggag

SEQ ID NO: 10790 - RNA, 18 nt, Artificial Sequence
  Synthetic
uccacaccgcccggggag

SEQ ID NO: 10791 - RNA, 19 nt, Artificial Sequence
  Synthetic
cuccacaccgcccggggag

SEQ ID NO: 10792 - RNA, 20 nt, Artificial Sequence
  Synthetic
ucuccacaccgcccggggag

SEQ ID NO: 10793 - RNA, 21 nt, Artificial Sequence
  Synthetic
uucuccacaccgcccggggag

SEQ ID NO: 10794 - RNA, 22 nt, Artificial Sequence
  Synthetic
cuucuccacaccgcccggggag

SEQ ID NO: 10795 - RNA, 23 nt, Artificial Sequence
  Synthetic
gcuucuccacaccgcccggggag

SEQ ID NO: 10796 - RNA, 24 nt, Artificial Sequence
  Synthetic
cgcuucuccacaccgcccggggag

SEQ ID NO: 10797 - RNA, 18 nt, Artificial Sequence
  Synthetic
gccgcgaugcccaacacg

SEQ ID NO: 10798 - RNA, 19 nt, Artificial Sequence
  Synthetic
ggccgcgaugcccaacacg

SEQ ID NO: 10799 - RNA, 20 nt, Artificial Sequence
  Synthetic
cggccgcgaugcccaacacg

SEQ ID NO: 10800 - RNA, 21 nt, Artificial Sequence
  Synthetic
ccggccgcgaugcccaacacg

SEQ ID NO: 10801 - RNA, 22 nt, Artificial Sequence
  Synthetic
cccggccgcgaugcccaacacg

SEQ ID NO: 10802 - RNA, 23 nt, Artificial Sequence
  Synthetic
ccccggccgcgaugcccaacacg

SEQ ID NO: 10803 - RNA, 24 nt, Artificial Sequence
  Synthetic
cccccggccgcgaugcccaacacg

SEQ ID NO: 10804 - RNA, 18 nt, Artificial Sequence
  Synthetic
aggaagaggaggacgacg

SEQ ID NO: 10805 - RNA, 19 nt, Artificial Sequence
  Synthetic
gaggaagaggaggacgacg

SEQ ID NO: 10806 - RNA, 20 nt, Artificial Sequence
  Synthetic
ggaggaagaggaggacgacg

SEQ ID NO: 10807 - RNA, 21 nt, Artificial Sequence
  Synthetic
aggaggaagaggaggacgacg

SEQ ID NO: 10808 - RNA, 22 nt, Artificial Sequence
  Synthetic
gaggaggaagaggaggacgacg

SEQ ID NO: 10809 - RNA, 23 nt, Artificial Sequence
  Synthetic
cgaggaggaagaggaggacgacg

SEQ ID NO: 10810 - RNA, 24 nt, Artificial Sequence
  Synthetic
acgaggaggaagaggaggacgacg

SEQ ID NO: 10811 - RNA, 18 nt, Artificial Sequence
  Synthetic
aggaggaagaggaggacg

SEQ ID NO: 10812 - RNA, 19 nt, Artificial Sequence
  Synthetic
gaggaggaagaggaggacg

SEQ ID NO: 10813 - RNA, 20 nt, Artificial Sequence
  Synthetic
cgaggaggaagaggaggacg

SEQ ID NO: 10814 - RNA, 21 nt, Artificial Sequence
  Synthetic
acgaggaggaagaggaggacg

SEQ ID NO: 10815 - RNA, 22 nt, Artificial Sequence
  Synthetic
gacgaggaggaagaggaggacg

SEQ ID NO: 10816 - RNA, 23 nt, Artificial Sequence
  Synthetic
ggacgaggaggaagaggaggacg

SEQ ID NO: 10817 - RNA, 24 nt, Artificial Sequence
  Synthetic
gggacgaggaggaagaggaggacg

SEQ ID NO: 10818 - RNA, 18 nt, Artificial Sequence
  Synthetic
ucccggagaacggggacg

SEQ ID NO: 10819 - RNA, 19 nt, Artificial Sequence
  Synthetic
aucccggagaacggggacg

SEQ ID NO: 10820 - RNA, 20 nt, Artificial Sequence
  Synthetic
gaucccggagaacggggacg

SEQ ID NO: 10821 - RNA, 21 nt, Artificial Sequence
  Synthetic
ugaucccggagaacggggacg

SEQ ID NO: 10822 - RNA, 22 nt, Artificial Sequence
  Synthetic
cugaucccggagaacggggacg

SEQ ID NO: 10823 - RNA, 23 nt, Artificial Sequence
  Synthetic
ccugaucccggagaacggggacg

SEQ ID NO: 10824 - RNA, 24 nt, Artificial Sequence
  Synthetic
accugaucccggagaacggggacg

SEQ ID NO: 10825 - RNA, 18 nt, Artificial Sequence
  Synthetic
cgcccggggagcuggacg

SEQ ID NO: 10826 - RNA, 19 nt, Artificial Sequence
  Synthetic
ccgcccggggagcuggacg

SEQ ID NO: 10827 - RNA, 20 nt, Artificial Sequence
  Synthetic
accgcccggggagcuggacg

SEQ ID NO: 10828 - RNA, 21 nt, Artificial Sequence
  Synthetic
caccgcccggggagcuggacg

SEQ ID NO: 10829 - RNA, 22 nt, Artificial Sequence
  Synthetic
acaccgcccggggagcuggacg

SEQ ID NO: 10830 - RNA, 23 nt, Artificial Sequence
  Synthetic
cacaccgcccggggagcuggacg

SEQ ID NO: 10831 - RNA, 24 nt, Artificial Sequence
  Synthetic
ccacaccgcccggggagcuggacg

SEQ ID NO: 10832 - RNA, 18 nt, Artificial Sequence
  Synthetic
gaggaggaggagcugacg

SEQ ID NO: 10833 - RNA, 19 nt, Artificial Sequence
  Synthetic
ggaggaggaggagcugacg

SEQ ID NO: 10834 - RNA, 20 nt, Artificial Sequence
  Synthetic
aggaggaggaggagcugacg

SEQ ID NO: 10835 - RNA, 21 nt, Artificial Sequence
  Synthetic
gaggaggaggaggagcugacg

SEQ ID NO: 10836 - RNA, 22 nt, Artificial Sequence
  Synthetic
agaggaggaggaggagcugacg

SEQ ID NO: 10837 - RNA, 23 nt, Artificial Sequence
  Synthetic
aagaggaggaggaggagcugacg

SEQ ID NO: 10838 - RNA, 24 nt, Artificial Sequence
  Synthetic
gaagaggaggaggaggagcugacg

SEQ ID NO: 10839 - RNA, 18 nt, Artificial Sequence
  Synthetic
gcuucuccacaccgcccg

SEQ ID NO: 10840 - RNA, 19 nt, Artificial Sequence
  Synthetic
cgcuucuccacaccgcccg

SEQ ID NO: 10841 - RNA, 20 nt, Artificial Sequence
  Synthetic
gcgcuucuccacaccgcccg

SEQ ID NO: 10842 - RNA, 21 nt, Artificial Sequence
  Synthetic
ugcgcuucuccacaccgcccg

SEQ ID NO: 10843 - RNA, 22 nt, Artificial Sequence
  Synthetic
uugcgcuucuccacaccgcccg

SEQ ID NO: 10844 - RNA, 23 nt, Artificial Sequence
  Synthetic
uuugcgcuucuccacaccgcccg

SEQ ID NO: 10845 - RNA, 24 nt, Artificial Sequence
  Synthetic
guuugcgcuucuccacaccgcccg

SEQ ID NO: 10846 - RNA, 18 nt, Artificial Sequence
  Synthetic
gaccccaaccugaucccg

SEQ ID NO: 10847 - RNA, 19 nt, Artificial Sequence
  Synthetic
cgaccccaaccugaucccg

SEQ ID NO: 10848 - RNA, 20 nt, Artificial Sequence
  Synthetic
acgaccccaaccugaucccg

SEQ ID NO: 10849 - RNA, 21 nt, Artificial Sequence
  Synthetic
aacgaccccaaccugaucccg

SEQ ID NO: 10850 - RNA, 22 nt, Artificial Sequence
  Synthetic
gaacgaccccaaccugaucccg

SEQ ID NO: 10851 - RNA, 23 nt, Artificial Sequence
  Synthetic
agaacgaccccaaccugaucccg

SEQ ID NO: 10852 - RNA, 24 nt, Artificial Sequence
  Synthetic
gagaacgaccccaaccugaucccg

SEQ ID NO: 10853 - RNA, 18 nt, Artificial Sequence
  Synthetic
cggucgugggcgugggcg

SEQ ID NO: 10854 - RNA, 19 nt, Artificial Sequence
  Synthetic
gcggucgugggcgugggcg

SEQ ID NO: 10855 - RNA, 20 nt, Artificial Sequence
  Synthetic
cgcggucgugggcgugggcg

SEQ ID NO: 10856 - RNA, 21 nt, Artificial Sequence
  Synthetic
gcgcggucgugggcgugggcg

SEQ ID NO: 10857 - RNA, 22 nt, Artificial Sequence
  Synthetic
ggcgcggucgugggcgugggcg

SEQ ID NO: 10858 - RNA, 23 nt, Artificial Sequence
  Synthetic
gggcgcggucgugggcgugggcg

SEQ ID NO: 10859 - RNA, 24 nt, Artificial Sequence
  Synthetic
ggggcgcggucgugggcgugggcg

SEQ ID NO: 10860 - RNA, 18 nt, Artificial Sequence
  Synthetic
gccacagggacacuugcg

SEQ ID NO: 10861 - RNA, 19 nt, Artificial Sequence
  Synthetic
ggccacagggacacuugcg

SEQ ID NO: 10862 - RNA, 20 nt, Artificial Sequence
  Synthetic
gggccacagggacacuugcg

SEQ ID NO: 10863 - RNA, 21 nt, Artificial Sequence
  Synthetic
agggccacagggacacuugcg

SEQ ID NO: 10864 - RNA, 22 nt, Artificial Sequence
  Synthetic
gagggccacagggacacuugcg

SEQ ID NO: 10865 - RNA, 23 nt, Artificial Sequence
  Synthetic
cgagggccacagggacacuugcg

SEQ ID NO: 10866 - RNA, 24 nt, Artificial Sequence
  Synthetic
ccgagggccacagggacacuugcg

SEQ ID NO: 10867 - RNA, 18 nt, Artificial Sequence
  Synthetic
ccgggcgagucggccucg

SEQ ID NO: 10868 - RNA, 19 nt, Artificial Sequence
  Synthetic
cccgggcgagucggccucg

SEQ ID NO: 10869 - RNA, 20 nt, Artificial Sequence
  Synthetic
ccccgggcgagucggccucg

SEQ ID NO: 10870 - RNA, 21 nt, Artificial Sequence
  Synthetic
uccccgggcgagucggccucg

SEQ ID NO: 10871 - RNA, 22 nt, Artificial Sequence
  Synthetic
cuccccgggcgagucggccucg

SEQ ID NO: 10872 - RNA, 23 nt, Artificial Sequence
  Synthetic
gcuccccgggcgagucggccucg

SEQ ID NO: 10873 - RNA, 24 nt, Artificial Sequence
  Synthetic
ugcuccccgggcgagucggccucg

SEQ ID NO: 10874 - RNA, 18 nt, Artificial Sequence
  Synthetic
ucgucggagcacuccucg

SEQ ID NO: 10875 - RNA, 19 nt, Artificial Sequence
  Synthetic
cucgucggagcacuccucg

SEQ ID NO: 10876 - RNA, 20 nt, Artificial Sequence
  Synthetic
ccucgucggagcacuccucg

SEQ ID NO: 10877 - RNA, 21 nt, Artificial Sequence
  Synthetic
uccucgucggagcacuccucg

SEQ ID NO: 10878 - RNA, 22 nt, Artificial Sequence
  Synthetic
cuccucgucggagcacuccucg

SEQ ID NO: 10879 - RNA, 23 nt, Artificial Sequence
  Synthetic
ccuccucgucggagcacuccucg

SEQ ID NO: 10880 - RNA, 24 nt, Artificial Sequence
  Synthetic
gccuccucgucggagcacuccucg

SEQ ID NO: 10881 - RNA, 18 nt, Artificial Sequence
  Synthetic
ucgccuuuugccuccucg

SEQ ID NO: 10882 - RNA, 19 nt, Artificial Sequence
  Synthetic
aucgccuuuugccuccucg

SEQ ID NO: 10883 - RNA, 20 nt, Artificial Sequence
  Synthetic
aaucgccuuuugccuccucg

SEQ ID NO: 10884 - RNA, 21 nt, Artificial Sequence
  Synthetic
caaucgccuuuugccuccucg

SEQ ID NO: 10885 - RNA, 22 nt, Artificial Sequence
  Synthetic
acaaucgccuuuugccuccucg

SEQ ID NO: 10886 - RNA, 23 nt, Artificial Sequence
  Synthetic
gacaaucgccuuuugccuccucg

SEQ ID NO: 10887 - RNA, 24 nt, Artificial Sequence
  Synthetic
agacaaucgccuuuugccuccucg

SEQ ID NO: 10888 - RNA, 18 nt, Artificial Sequence
  Synthetic
caccacgagaacagcucg

SEQ ID NO: 10889 - RNA, 19 nt, Artificial Sequence
  Synthetic
ccaccacgagaacagcucg

SEQ ID NO: 10890 - RNA, 20 nt, Artificial Sequence
  Synthetic
gccaccacgagaacagcucg

SEQ ID NO: 10891 - RNA, 21 nt, Artificial Sequence
  Synthetic
cgccaccacgagaacagcucg

SEQ ID NO: 10892 - RNA, 22 nt, Artificial Sequence
  Synthetic
gcgccaccacgagaacagcucg

SEQ ID NO: 10893 - RNA, 23 nt, Artificial Sequence
  Synthetic
cgcgccaccacgagaacagcucg

SEQ ID NO: 10894 - RNA, 24 nt, Artificial Sequence
  Synthetic
gcgcgccaccacgagaacagcucg

SEQ ID NO: 10895 - RNA, 18 nt, Artificial Sequence
  Synthetic
cugggcagccccagcucg

SEQ ID NO: 10896 - RNA, 19 nt, Artificial Sequence
  Synthetic
gcugggcagccccagcucg

SEQ ID NO: 10897 - RNA, 20 nt, Artificial Sequence
  Synthetic
ugcugggcagccccagcucg

SEQ ID NO: 10898 - RNA, 21 nt, Artificial Sequence
  Synthetic
cugcugggcagccccagcucg

SEQ ID NO: 10899 - RNA, 22 nt, Artificial Sequence
  Synthetic
gcugcugggcagccccagcucg

SEQ ID NO: 10900 - RNA, 23 nt, Artificial Sequence
  Synthetic
ugcugcugggcagccccagcucg

SEQ ID NO: 10901 - RNA, 24 nt, Artificial Sequence
  Synthetic
cugcugcugggcagccccagcucg

SEQ ID NO: 10902 - RNA, 18 nt, Artificial Sequence
  Synthetic
aggaagaggaagaagagg

SEQ ID NO: 10903 - RNA, 19 nt, Artificial Sequence
  Synthetic
gaggaagaggaagaagagg

SEQ ID NO: 10904 - RNA, 20 nt, Artificial Sequence
  Synthetic
cgaggaagaggaagaagagg

SEQ ID NO: 10905 - RNA, 21 nt, Artificial Sequence
  Synthetic
acgaggaagaggaagaagagg

SEQ ID NO: 10906 - RNA, 22 nt, Artificial Sequence
  Synthetic
gacgaggaagaggaagaagagg

SEQ ID NO: 10907 - RNA, 23 nt, Artificial Sequence
  Synthetic
cgacgaggaagaggaagaagagg

SEQ ID NO: 10908 - RNA, 24 nt, Artificial Sequence
  Synthetic
acgacgaggaagaggaagaagagg

SEQ ID NO: 10909 - RNA, 18 nt, Artificial Sequence
  Synthetic
aggacgacgaggaagagg

SEQ ID NO: 10910 - RNA, 19 nt, Artificial Sequence
  Synthetic
gaggacgacgaggaagagg

SEQ ID NO: 10911 - RNA, 20 nt, Artificial Sequence
  Synthetic
ggaggacgacgaggaagagg

SEQ ID NO: 10912 - RNA, 21 nt, Artificial Sequence
  Synthetic
aggaggacgacgaggaagagg

SEQ ID NO: 10913 - RNA, 22 nt, Artificial Sequence
  Synthetic
gaggaggacgacgaggaagagg

SEQ ID NO: 10914 - RNA, 23 nt, Artificial Sequence
  Synthetic
agaggaggacgacgaggaagagg

SEQ ID NO: 10915 - RNA, 24 nt, Artificial Sequence
  Synthetic
aagaggaggacgacgaggaagagg

SEQ ID NO: 10916 - RNA, 18 nt, Artificial Sequence
  Synthetic
aagaagaggaggaagagg

SEQ ID NO: 10917 - RNA, 19 nt, Artificial Sequence
  Synthetic
gaagaagaggaggaagagg

SEQ ID NO: 10918 - RNA, 20 nt, Artificial Sequence
  Synthetic
ggaagaagaggaggaagagg

SEQ ID NO: 10919 - RNA, 21 nt, Artificial Sequence
  Synthetic
aggaagaagaggaggaagagg

SEQ ID NO: 10920 - RNA, 22 nt, Artificial Sequence
  Synthetic
gaggaagaagaggaggaagagg

SEQ ID NO: 10921 - RNA, 23 nt, Artificial Sequence
  Synthetic
agaggaagaagaggaggaagagg

SEQ ID NO: 10922 - RNA, 24 nt, Artificial Sequence
  Synthetic
aagaggaagaagaggaggaagagg

SEQ ID NO: 10923 - RNA, 18 nt, Artificial Sequence
  Synthetic
cugacggagagcgagagg

SEQ ID NO: 10924 - RNA, 19 nt, Artificial Sequence
  Synthetic
gcugacggagagcgagagg

SEQ ID NO: 10925 - RNA, 20 nt, Artificial Sequence
  Synthetic
agcugacggagagcgagagg

SEQ ID NO: 10926 - RNA, 21 nt, Artificial Sequence
  Synthetic
gagcugacggagagcgagagg

SEQ ID NO: 10927 - RNA, 22 nt, Artificial Sequence
  Synthetic
ggagcugacggagagcgagagg

SEQ ID NO: 10928 - RNA, 23 nt, Artificial Sequence
  Synthetic
aggagcugacggagagcgagagg

SEQ ID NO: 10929 - RNA, 24 nt, Artificial Sequence
  Synthetic
gaggagcugacggagagcgagagg

SEQ ID NO: 10930 - RNA, 18 nt, Artificial Sequence
  Synthetic
aagaggaggacgacgagg

SEQ ID NO: 10931 - RNA, 19 nt, Artificial Sequence
  Synthetic
gaagaggaggacgacgagg

SEQ ID NO: 10932 - RNA, 20 nt, Artificial Sequence
  Synthetic
ggaagaggaggacgacgagg

SEQ ID NO: 10933 - RNA, 21 nt, Artificial Sequence
  Synthetic
aggaagaggaggacgacgagg

SEQ ID NO: 10934 - RNA, 22 nt, Artificial Sequence
  Synthetic
gaggaagaggaggacgacgagg

SEQ ID NO: 10935 - RNA, 23 nt, Artificial Sequence
  Synthetic
ggaggaagaggaggacgacgagg

SEQ ID NO: 10936 - RNA, 24 nt, Artificial Sequence
  Synthetic
aggaggaagaggaggacgacgagg

SEQ ID NO: 10937 - RNA, 18 nt, Artificial Sequence
  Synthetic
cggagaacggggacgagg

SEQ ID NO: 10938 - RNA, 19 nt, Artificial Sequence
  Synthetic
ccggagaacggggacgagg

SEQ ID NO: 10939 - RNA, 20 nt, Artificial Sequence
  Synthetic
cccggagaacggggacgagg

SEQ ID NO: 10940 - RNA, 21 nt, Artificial Sequence
  Synthetic
ucccggagaacggggacgagg

SEQ ID NO: 10941 - RNA, 22 nt, Artificial Sequence
  Synthetic
aucccggagaacggggacgagg

SEQ ID NO: 10942 - RNA, 23 nt, Artificial Sequence
  Synthetic
gaucccggagaacggggacgagg

SEQ ID NO: 10943 - RNA, 24 nt, Artificial Sequence
  Synthetic
ugaucccggagaacggggacgagg

SEQ ID NO: 10944 - RNA, 18 nt, Artificial Sequence
  Synthetic
gcggccaccuggccgagg

SEQ ID NO: 10945 - RNA, 19 nt, Artificial Sequence
  Synthetic
cgcggccaccuggccgagg

SEQ ID NO: 10946 - RNA, 20 nt, Artificial Sequence
  Synthetic
gcgcggccaccuggccgagg

SEQ ID NO: 10947 - RNA, 21 nt, Artificial Sequence
  Synthetic
agcgcggccaccuggccgagg

SEQ ID NO: 10948 - RNA, 22 nt, Artificial Sequence
  Synthetic
aagcgcggccaccuggccgagg

SEQ ID NO: 10949 - RNA, 23 nt, Artificial Sequence
  Synthetic
uaagcgcggccaccuggccgagg

SEQ ID NO: 10950 - RNA, 24 nt, Artificial Sequence
  Synthetic
auaagcgcggccaccuggccgagg

SEQ ID NO: 10951 - RNA, 18 nt, Artificial Sequence
  Synthetic
aagaggaagaagaggagg

SEQ ID NO: 10952 - RNA, 19 nt, Artificial Sequence
  Synthetic
gaagaggaagaagaggagg

SEQ ID NO: 10953 - RNA, 20 nt, Artificial Sequence
  Synthetic
ggaagaggaagaagaggagg

SEQ ID NO: 10954 - RNA, 21 nt, Artificial Sequence
  Synthetic
aggaagaggaagaagaggagg

SEQ ID NO: 10955 - RNA, 22 nt, Artificial Sequence
  Synthetic
gaggaagaggaagaagaggagg

SEQ ID NO: 10956 - RNA, 23 nt, Artificial Sequence
  Synthetic
cgaggaagaggaagaagaggagg

SEQ ID NO: 10957 - RNA, 24 nt, Artificial Sequence
  Synthetic
acgaggaagaggaagaagaggagg

SEQ ID NO: 10958 - RNA, 18 nt, Artificial Sequence
  Synthetic
aagaggaggaagaggagg

SEQ ID NO: 10959 - RNA, 19 nt, Artificial Sequence
  Synthetic
gaagaggaggaagaggagg

SEQ ID NO: 10960 - RNA, 20 nt, Artificial Sequence
  Synthetic
agaagaggaggaagaggagg

SEQ ID NO: 10961 - RNA, 21 nt, Artificial Sequence
  Synthetic
aagaagaggaggaagaggagg

SEQ ID NO: 10962 - RNA, 22 nt, Artificial Sequence
  Synthetic
gaagaagaggaggaagaggagg

SEQ ID NO: 10963 - RNA, 23 nt, Artificial Sequence
  Synthetic
ggaagaagaggaggaagaggagg

SEQ ID NO: 10964 - RNA, 24 nt, Artificial Sequence
  Synthetic
aggaagaagaggaggaagaggagg

SEQ ID NO: 10965 - RNA, 18 nt, Artificial Sequence
  Synthetic
agaacggggacgaggagg

SEQ ID NO: 10966 - RNA, 19 nt, Artificial Sequence
  Synthetic
gagaacggggacgaggagg

SEQ ID NO: 10967 - RNA, 20 nt, Artificial Sequence
  Synthetic
ggagaacggggacgaggagg

SEQ ID NO: 10968 - RNA, 21 nt, Artificial Sequence
  Synthetic
cggagaacggggacgaggagg

SEQ ID NO: 10969 - RNA, 22 nt, Artificial Sequence
  Synthetic
ccggagaacggggacgaggagg

SEQ ID NO: 10970 - RNA, 23 nt, Artificial Sequence
  Synthetic
cccggagaacggggacgaggagg

SEQ ID NO: 10971 - RNA, 24 nt, Artificial Sequence
  Synthetic
ucccggagaacggggacgaggagg

SEQ ID NO: 10972 - RNA, 18 nt, Artificial Sequence
  Synthetic
aggaggaagaggaggagg

SEQ ID NO: 10973 - RNA, 19 nt, Artificial Sequence
  Synthetic
gaggaggaagaggaggagg

SEQ ID NO: 10974 - RNA, 20 nt, Artificial Sequence
  Synthetic
agaggaggaagaggaggagg

SEQ ID NO: 10975 - RNA, 21 nt, Artificial Sequence
  Synthetic
aagaggaggaagaggaggagg

SEQ ID NO: 10976 - RNA, 22 nt, Artificial Sequence
  Synthetic
gaagaggaggaagaggaggagg

SEQ ID NO: 10977 - RNA, 23 nt, Artificial Sequence
  Synthetic
agaagaggaggaagaggaggagg

SEQ ID NO: 10978 - RNA, 24 nt, Artificial Sequence
  Synthetic
aagaagaggaggaagaggaggagg

SEQ ID NO: 10979 - RNA, 18 nt, Artificial Sequence
  Synthetic
accggcgcagccacacgg

SEQ ID NO: 10980 - RNA, 19 nt, Artificial Sequence
  Synthetic
caccggcgcagccacacgg

SEQ ID NO: 10981 - RNA, 20 nt, Artificial Sequence
  Synthetic
gcaccggcgcagccacacgg

SEQ ID NO: 10982 - RNA, 21 nt, Artificial Sequence
  Synthetic
ugcaccggcgcagccacacgg

SEQ ID NO: 10983 - RNA, 22 nt, Artificial Sequence
  Synthetic
gugcaccggcgcagccacacgg

SEQ ID NO: 10984 - RNA, 23 nt, Artificial Sequence
  Synthetic
ggugcaccggcgcagccacacgg

SEQ ID NO: 10985 - RNA, 24 nt, Artificial Sequence
  Synthetic
uggugcaccggcgcagccacacgg

SEQ ID NO: 10986 - RNA, 18 nt, Artificial Sequence
  Synthetic
uagagcgccugggggcgg

SEQ ID NO: 10987 - RNA, 19 nt, Artificial Sequence
  Synthetic
auagagcgccugggggcgg

SEQ ID NO: 10988 - RNA, 20 nt, Artificial Sequence
  Synthetic
cauagagcgccugggggcgg

SEQ ID NO: 10989 - RNA, 21 nt, Artificial Sequence
  Synthetic
gcauagagcgccugggggcgg

SEQ ID NO: 10990 - RNA, 22 nt, Artificial Sequence
  Synthetic
cgcauagagcgccugggggcgg

SEQ ID NO: 10991 - RNA, 23 nt, Artificial Sequence
  Synthetic
ccgcauagagcgccugggggcgg

SEQ ID NO: 10992 - RNA, 24 nt, Artificial Sequence
  Synthetic
accgcauagagcgccugggggcgg

SEQ ID NO: 10993 - RNA, 18 nt, Artificial Sequence
  Synthetic
auguguggcaguuuucgg

SEQ ID NO: 10994 - RNA, 19 nt, Artificial Sequence
  Synthetic
gauguguggcaguuuucgg

SEQ ID NO: 10995 - RNA, 20 nt, Artificial Sequence
  Synthetic
agauguguggcaguuuucgg

SEQ ID NO: 10996 - RNA, 21 nt, Artificial Sequence
  Synthetic
aagauguguggcaguuuucgg

SEQ ID NO: 10997 - RNA, 22 nt, Artificial Sequence
  Synthetic
caagauguguggcaguuuucgg

SEQ ID NO: 10998 - RNA, 23 nt, Artificial Sequence
  Synthetic
ucaagauguguggcaguuuucgg

SEQ ID NO: 10999 - RNA, 24 nt, Artificial Sequence
  Synthetic
cucaagauguguggcaguuuucgg

SEQ ID NO: 11000 - RNA, 18 nt, Artificial Sequence
  Synthetic
aauuugaagcccccaggg

SEQ ID NO: 11001 - RNA, 19 nt, Artificial Sequence
  Synthetic
aaauuugaagcccccaggg

SEQ ID NO: 11002 - RNA, 20 nt, Artificial Sequence
  Synthetic
aaaauuugaagcccccaggg

SEQ ID NO: 11003 - RNA, 21 nt, Artificial Sequence
  Synthetic
gaaaauuugaagcccccaggg

SEQ ID NO: 11004 - RNA, 22 nt, Artificial Sequence
  Synthetic
agaaaauuugaagcccccaggg

SEQ ID NO: 11005 - RNA, 23 nt, Artificial Sequence
  Synthetic
gagaaaauuugaagcccccaggg

SEQ ID NO: 11006 - RNA, 24 nt, Artificial Sequence
  Synthetic
ugagaaaauuugaagcccccaggg

SEQ ID NO: 11007 - RNA, 18 nt, Artificial Sequence
  Synthetic
guggacuacggcuucggg

SEQ ID NO: 11008 - RNA, 19 nt, Artificial Sequence
  Synthetic
gguggacuacggcuucggg

SEQ ID NO: 11009 - RNA, 20 nt, Artificial Sequence
  Synthetic
ggguggacuacggcuucggg

SEQ ID NO: 11010 - RNA, 21 nt, Artificial Sequence
  Synthetic
aggguggacuacggcuucggg

SEQ ID NO: 11011 - RNA, 22 nt, Artificial Sequence
  Synthetic
gaggguggacuacggcuucggg

SEQ ID NO: 11012 - RNA, 23 nt, Artificial Sequence
  Synthetic
agaggguggacuacggcuucggg

SEQ ID NO: 11013 - RNA, 24 nt, Artificial Sequence
  Synthetic
gagaggguggacuacggcuucggg

SEQ ID NO: 11014 - RNA, 18 nt, Artificial Sequence
  Synthetic
ugaucccggagaacgggg

SEQ ID NO: 11015 - RNA, 19 nt, Artificial Sequence
  Synthetic
cugaucccggagaacgggg

SEQ ID NO: 11016 - RNA, 20 nt, Artificial Sequence
  Synthetic
ccugaucccggagaacgggg

SEQ ID NO: 11017 - RNA, 21 nt, Artificial Sequence
  Synthetic
accugaucccggagaacgggg

SEQ ID NO: 11018 - RNA, 22 nt, Artificial Sequence
  Synthetic
aaccugaucccggagaacgggg

SEQ ID NO: 11019 - RNA, 23 nt, Artificial Sequence
  Synthetic
caaccugaucccggagaacgggg

SEQ ID NO: 11020 - RNA, 24 nt, Artificial Sequence
  Synthetic
ccaaccugaucccggagaacgggg

SEQ ID NO: 11021 - RNA, 18 nt, Artificial Sequence
  Synthetic
gcauagagcgccuggggg

SEQ ID NO: 11022 - RNA, 19 nt, Artificial Sequence
  Synthetic
cgcauagagcgccuggggg

SEQ ID NO: 11023 - RNA, 20 nt, Artificial Sequence
  Synthetic
ccgcauagagcgccuggggg

SEQ ID NO: 11024 - RNA, 21 nt, Artificial Sequence
  Synthetic
accgcauagagcgccuggggg

SEQ ID NO: 11025 - RNA, 22 nt, Artificial Sequence
  Synthetic
caccgcauagagcgccuggggg

SEQ ID NO: 11026 - RNA, 23 nt, Artificial Sequence
  Synthetic
ccaccgcauagagcgccuggggg

SEQ ID NO: 11027 - RNA, 24 nt, Artificial Sequence
  Synthetic
cccaccgcauagagcgccuggggg

SEQ ID NO: 11028 - RNA, 18 nt, Artificial Sequence
  Synthetic
cgcauagagcgccugggg

SEQ ID NO: 11029 - RNA, 19 nt, Artificial Sequence
  Synthetic
ccgcauagagcgccugggg

SEQ ID NO: 11030 - RNA, 20 nt, Artificial Sequence
  Synthetic
accgcauagagcgccugggg

SEQ ID NO: 11031 - RNA, 21 nt, Artificial Sequence
  Synthetic
caccgcauagagcgccugggg

SEQ ID NO: 11032 - RNA, 22 nt, Artificial Sequence
  Synthetic
ccaccgcauagagcgccugggg

SEQ ID NO: 11033 - RNA, 23 nt, Artificial Sequence
  Synthetic
cccaccgcauagagcgccugggg

SEQ ID NO: 11034 - RNA, 24 nt, Artificial Sequence
  Synthetic
ccccaccgcauagagcgccugggg

SEQ ID NO: 11035 - RNA, 18 nt, Artificial Sequence
  Synthetic
auaagcgcggccaccugg

SEQ ID NO: 11036 - RNA, 19 nt, Artificial Sequence
  Synthetic
cauaagcgcggccaccugg

SEQ ID NO: 11037 - RNA, 20 nt, Artificial Sequence
  Synthetic
gcauaagcgcggccaccugg

SEQ ID NO: 11038 - RNA, 21 nt, Artificial Sequence
  Synthetic
agcauaagcgcggccaccugg

SEQ ID NO: 11039 - RNA, 22 nt, Artificial Sequence
  Synthetic
aagcauaagcgcggccaccugg

SEQ ID NO: 11040 - RNA, 23 nt, Artificial Sequence
  Synthetic
gaagcauaagcgcggccaccugg

SEQ ID NO: 11041 - RNA, 24 nt, Artificial Sequence
  Synthetic
agaagcauaagcgcggccaccugg

SEQ ID NO: 11042 - RNA, 18 nt, Artificial Sequence
  Synthetic
gagaggcuuccggccugg

SEQ ID NO: 11043 - RNA, 19 nt, Artificial Sequence
  Synthetic
agagaggcuuccggccugg

SEQ ID NO: 11044 - RNA, 20 nt, Artificial Sequence
  Synthetic
gagagaggcuuccggccugg

SEQ ID NO: 11045 - RNA, 21 nt, Artificial Sequence
  Synthetic
cgagagaggcuuccggccugg

SEQ ID NO: 11046 - RNA, 22 nt, Artificial Sequence
  Synthetic
ucgagagaggcuuccggccugg

SEQ ID NO: 11047 - RNA, 23 nt, Artificial Sequence
  Synthetic
aucgagagaggcuuccggccugg

SEQ ID NO: 11048 - RNA, 24 nt, Artificial Sequence
  Synthetic
uaucgagagaggcuuccggccugg

SEQ ID NO: 11049 - RNA, 18 nt, Artificial Sequence
  Synthetic
ccuuccaccagguccugg

SEQ ID NO: 11050 - RNA, 19 nt, Artificial Sequence
  Synthetic
gccuuccaccagguccugg

SEQ ID NO: 11051 - RNA, 20 nt, Artificial Sequence
  Synthetic
ggccuuccaccagguccugg

SEQ ID NO: 11052 - RNA, 21 nt, Artificial Sequence
  Synthetic
aggccuuccaccagguccugg

SEQ ID NO: 11053 - RNA, 22 nt, Artificial Sequence
  Synthetic
gaggccuuccaccagguccugg

SEQ ID NO: 11054 - RNA, 23 nt, Artificial Sequence
  Synthetic
cgaggccuuccaccagguccugg

SEQ ID NO: 11055 - RNA, 24 nt, Artificial Sequence
  Synthetic
gcgaggccuuccaccagguccugg

SEQ ID NO: 11056 - RNA, 18 nt, Artificial Sequence
  Synthetic
ggagacuuagagagcugg

SEQ ID NO: 11057 - RNA, 19 nt, Artificial Sequence
  Synthetic
aggagacuuagagagcugg

SEQ ID NO: 11058 - RNA, 20 nt, Artificial Sequence
  Synthetic
uaggagacuuagagagcugg

SEQ ID NO: 11059 - RNA, 21 nt, Artificial Sequence
  Synthetic
cuaggagacuuagagagcugg

SEQ ID NO: 11060 - RNA, 22 nt, Artificial Sequence
  Synthetic
ucuaggagacuuagagagcugg

SEQ ID NO: 11061 - RNA, 23 nt, Artificial Sequence
  Synthetic
cucuaggagacuuagagagcugg

SEQ ID NO: 11062 - RNA, 24 nt, Artificial Sequence
  Synthetic
ucucuaggagacuuagagagcugg

SEQ ID NO: 11063 - RNA, 18 nt, Artificial Sequence
  Synthetic
caccgcccggggagcugg

SEQ ID NO: 11064 - RNA, 19 nt, Artificial Sequence
  Synthetic
acaccgcccggggagcugg

SEQ ID NO: 11065 - RNA, 20 nt, Artificial Sequence
  Synthetic
cacaccgcccggggagcugg

SEQ ID NO: 11066 - RNA, 21 nt, Artificial Sequence
  Synthetic
ccacaccgcccggggagcugg

SEQ ID NO: 11067 - RNA, 22 nt, Artificial Sequence
  Synthetic
uccacaccgcccggggagcugg

SEQ ID NO: 11068 - RNA, 23 nt, Artificial Sequence
  Synthetic
cuccacaccgcccggggagcugg

SEQ ID NO: 11069 - RNA, 24 nt, Artificial Sequence
  Synthetic
ucuccacaccgcccggggagcugg

SEQ ID NO: 11070 - RNA, 18 nt, Artificial Sequence
  Synthetic
cagcggcacgggaagugg

SEQ ID NO: 11071 - RNA, 19 nt, Artificial Sequence
  Synthetic
gcagcggcacgggaagugg

SEQ ID NO: 11072 - RNA, 20 nt, Artificial Sequence
  Synthetic
cgcagcggcacgggaagugg

SEQ ID NO: 11073 - RNA, 21 nt, Artificial Sequence
  Synthetic
gcgcagcggcacgggaagugg

SEQ ID NO: 11074 - RNA, 22 nt, Artificial Sequence
  Synthetic
ggcgcagcggcacgggaagugg

SEQ ID NO: 11075 - RNA, 23 nt, Artificial Sequence
  Synthetic
gggcgcagcggcacgggaagugg

SEQ ID NO: 11076 - RNA, 24 nt, Artificial Sequence
  Synthetic
ggggcgcagcggcacgggaagugg

SEQ ID NO: 11077 - RNA, 18 nt, Artificial Sequence
  Synthetic
gcccugcccgacgucaug

SEQ ID NO: 11078 - RNA, 19 nt, Artificial Sequence
  Synthetic
cgcccugcccgacgucaug

SEQ ID NO: 11079 - RNA, 20 nt, Artificial Sequence
  Synthetic
gcgcccugcccgacgucaug

SEQ ID NO: 11080 - RNA, 21 nt, Artificial Sequence
  Synthetic
cgcgcccugcccgacgucaug

SEQ ID NO: 11081 - RNA, 22 nt, Artificial Sequence
  Synthetic
ccgcgcccugcccgacgucaug

SEQ ID NO: 11082 - RNA, 23 nt, Artificial Sequence
  Synthetic
gccgcgcccugcccgacgucaug

SEQ ID NO: 11083 - RNA, 24 nt, Artificial Sequence
  Synthetic
agccgcgcccugcccgacgucaug

SEQ ID NO: 11084 - RNA, 18 nt, Artificial Sequence
  Synthetic
cgacacuugugaguacug

SEQ ID NO: 11085 - RNA, 19 nt, Artificial Sequence
  Synthetic
gcgacacuugugaguacug

SEQ ID NO: 11086 - RNA, 20 nt, Artificial Sequence
  Synthetic
agcgacacuugugaguacug

SEQ ID NO: 11087 - RNA, 21 nt, Artificial Sequence
  Synthetic
cagcgacacuugugaguacug

SEQ ID NO: 11088 - RNA, 22 nt, Artificial Sequence
  Synthetic
gcagcgacacuugugaguacug

SEQ ID NO: 11089 - RNA, 23 nt, Artificial Sequence
  Synthetic
cgcagcgacacuugugaguacug

SEQ ID NO: 11090 - RNA, 24 nt, Artificial Sequence
  Synthetic
acgcagcgacacuugugaguacug

SEQ ID NO: 11091 - RNA, 18 nt, Artificial Sequence
  Synthetic
gaggaggaggaggagcug

SEQ ID NO: 11092 - RNA, 19 nt, Artificial Sequence
  Synthetic
agaggaggaggaggagcug

SEQ ID NO: 11093 - RNA, 20 nt, Artificial Sequence
  Synthetic
aagaggaggaggaggagcug

SEQ ID NO: 11094 - RNA, 21 nt, Artificial Sequence
  Synthetic
gaagaggaggaggaggagcug

SEQ ID NO: 11095 - RNA, 22 nt, Artificial Sequence
  Synthetic
ggaagaggaggaggaggagcug

SEQ ID NO: 11096 - RNA, 23 nt, Artificial Sequence
  Synthetic
aggaagaggaggaggaggagcug

SEQ ID NO: 11097 - RNA, 24 nt, Artificial Sequence
  Synthetic
gaggaagaggaggaggaggagcug

SEQ ID NO: 11098 - RNA, 18 nt, Artificial Sequence
  Synthetic
cuguccaaaaagcugcug

SEQ ID NO: 11099 - RNA, 19 nt, Artificial Sequence
  Synthetic
ccuguccaaaaagcugcug

SEQ ID NO: 11100 - RNA, 20 nt, Artificial Sequence
  Synthetic
gccuguccaaaaagcugcug

SEQ ID NO: 11101 - RNA, 21 nt, Artificial Sequence
  Synthetic
ggccuguccaaaaagcugcug

SEQ ID NO: 11102 - RNA, 22 nt, Artificial Sequence
  Synthetic
gggccuguccaaaaagcugcug

SEQ ID NO: 11103 - RNA, 23 nt, Artificial Sequence
  Synthetic
ggggccuguccaaaaagcugcug

SEQ ID NO: 11104 - RNA, 24 nt, Artificial Sequence
  Synthetic
gggggccuguccaaaaagcugcug

SEQ ID NO: 11105 - RNA, 18 nt, Artificial Sequence
  Synthetic
gcagcggcacgggaagug

SEQ ID NO: 11106 - RNA, 19 nt, Artificial Sequence
  Synthetic
cgcagcggcacgggaagug

SEQ ID NO: 11107 - RNA, 20 nt, Artificial Sequence
  Synthetic
gcgcagcggcacgggaagug

SEQ ID NO: 11108 - RNA, 21 nt, Artificial Sequence
  Synthetic
ggcgcagcggcacgggaagug

SEQ ID NO: 11109 - RNA, 22 nt, Artificial Sequence
  Synthetic
gggcgcagcggcacgggaagug

SEQ ID NO: 11110 - RNA, 23 nt, Artificial Sequence
  Synthetic
ggggcgcagcggcacgggaagug

SEQ ID NO: 11111 - RNA, 24 nt, Artificial Sequence
  Synthetic
cggggcgcagcggcacgggaagug

SEQ ID NO: 11112 - RNA, 18 nt, Artificial Sequence
  Synthetic
cccggcaccagcgacuug

SEQ ID NO: 11113 - RNA, 19 nt, Artificial Sequence
  Synthetic
acccggcaccagcgacuug

SEQ ID NO: 11114 - RNA, 20 nt, Artificial Sequence
  Synthetic
aacccggcaccagcgacuug

SEQ ID NO: 11115 - RNA, 21 nt, Artificial Sequence
  Synthetic
gaacccggcaccagcgacuug

SEQ ID NO: 11116 - RNA, 22 nt, Artificial Sequence
  Synthetic
ggaacccggcaccagcgacuug

SEQ ID NO: 11117 - RNA, 23 nt, Artificial Sequence
  Synthetic
cggaacccggcaccagcgacuug

SEQ ID NO: 11118 - RNA, 24 nt, Artificial Sequence
  Synthetic
ccggaacccggcaccagcgacuug

SEQ ID NO: 11119 - RNA, 18 nt, Artificial Sequence
  Synthetic
cuuaaguucugagaaaau

SEQ ID NO: 11120 - RNA, 19 nt, Artificial Sequence
  Synthetic
ccuuaaguucugagaaaau

SEQ ID NO: 11121 - RNA, 20 nt, Artificial Sequence
  Synthetic
cccuuaaguucugagaaaau

SEQ ID NO: 11122 - RNA, 21 nt, Artificial Sequence
  Synthetic
gcccuuaaguucugagaaaau

SEQ ID NO: 11123 - RNA, 22 nt, Artificial Sequence
  Synthetic
agcccuuaaguucugagaaaau

SEQ ID NO: 11124 - RNA, 23 nt, Artificial Sequence
  Synthetic
gagcccuuaaguucugagaaaau

SEQ ID NO: 11125 - RNA, 24 nt, Artificial Sequence
  Synthetic
agagcccuuaaguucugagaaaau

SEQ ID NO: 11126 - RNA, 18 nt, Artificial Sequence
  Synthetic
ggauuucucuaggagacu

SEQ ID NO: 11127 - RNA, 19 nt, Artificial Sequence
  Synthetic
uggauuucucuaggagacu

SEQ ID NO: 11128 - RNA, 20 nt, Artificial Sequence
  Synthetic
auggauuucucuaggagacu

SEQ ID NO: 11129 - RNA, 21 nt, Artificial Sequence
  Synthetic
cauggauuucucuaggagacu

SEQ ID NO: 11130 - RNA, 22 nt, Artificial Sequence
  Synthetic
ccauggauuucucuaggagacu

SEQ ID NO: 11131 - RNA, 23 nt, Artificial Sequence
  Synthetic
gccauggauuucucuaggagacu

SEQ ID NO: 11132 - RNA, 24 nt, Artificial Sequence
  Synthetic
cgccauggauuucucuaggagacu

SEQ ID NO: 11133 - RNA, 18 nt, Artificial Sequence
  Synthetic
auggauuaagaaucuacu

SEQ ID NO: 11134 - RNA, 19 nt, Artificial Sequence
  Synthetic
cauggauuaagaaucuacu

SEQ ID NO: 11135 - RNA, 20 nt, Artificial Sequence
  Synthetic
ucauggauuaagaaucuacu

SEQ ID NO: 11136 - RNA, 21 nt, Artificial Sequence
  Synthetic
cucauggauuaagaaucuacu

SEQ ID NO: 11137 - RNA, 22 nt, Artificial Sequence
  Synthetic
acucauggauuaagaaucuacu

SEQ ID NO: 11138 - RNA, 23 nt, Artificial Sequence
  Synthetic
cacucauggauuaagaaucuacu

SEQ ID NO: 11139 - RNA, 24 nt, Artificial Sequence
  Synthetic
acacucauggauuaagaaucuacu

SEQ ID NO: 11140 - RNA, 18 nt, Artificial Sequence
  Synthetic
gcgacacuugugaguacu

SEQ ID NO: 11141 - RNA, 19 nt, Artificial Sequence
  Synthetic
agcgacacuugugaguacu

SEQ ID NO: 11142 - RNA, 20 nt, Artificial Sequence
  Synthetic
cagcgacacuugugaguacu

SEQ ID NO: 11143 - RNA, 21 nt, Artificial Sequence
  Synthetic
gcagcgacacuugugaguacu

SEQ ID NO: 11144 - RNA, 22 nt, Artificial Sequence
  Synthetic
cgcagcgacacuugugaguacu

SEQ ID NO: 11145 - RNA, 23 nt, Artificial Sequence
  Synthetic
acgcagcgacacuugugaguacu

SEQ ID NO: 11146 - RNA, 24 nt, Artificial Sequence
  Synthetic
gacgcagcgacacuugugaguacu

SEQ ID NO: 11147 - RNA, 18 nt, Artificial Sequence
  Synthetic
ccaccgcauagagcgccu

SEQ ID NO: 11148 - RNA, 19 nt, Artificial Sequence
  Synthetic
cccaccgcauagagcgccu

SEQ ID NO: 11149 - RNA, 20 nt, Artificial Sequence
  Synthetic
ccccaccgcauagagcgccu

SEQ ID NO: 11150 - RNA, 21 nt, Artificial Sequence
  Synthetic
cccccaccgcauagagcgccu

SEQ ID NO: 11151 - RNA, 22 nt, Artificial Sequence
  Synthetic
acccccaccgcauagagcgccu

SEQ ID NO: 11152 - RNA, 23 nt, Artificial Sequence
  Synthetic
gacccccaccgcauagagcgccu

SEQ ID NO: 11153 - RNA, 24 nt, Artificial Sequence
  Synthetic
ggacccccaccgcauagagcgccu

SEQ ID NO: 11154 - RNA, 18 nt, Artificial Sequence
  Synthetic
ccccgggcgagucggccu

SEQ ID NO: 11155 - RNA, 19 nt, Artificial Sequence
  Synthetic
uccccgggcgagucggccu

SEQ ID NO: 11156 - RNA, 20 nt, Artificial Sequence
  Synthetic
cuccccgggcgagucggccu

SEQ ID NO: 11157 - RNA, 21 nt, Artificial Sequence
  Synthetic
gcuccccgggcgagucggccu

SEQ ID NO: 11158 - RNA, 22 nt, Artificial Sequence
  Synthetic
ugcuccccgggcgagucggccu

SEQ ID NO: 11159 - RNA, 23 nt, Artificial Sequence
  Synthetic
cugcuccccgggcgagucggccu

SEQ ID NO: 11160 - RNA, 24 nt, Artificial Sequence
  Synthetic
gcugcuccccgggcgagucggccu

SEQ ID NO: 11161 - RNA, 18 nt, Artificial Sequence
  Synthetic
ccucgucggagcacuccu

SEQ ID NO: 11162 - RNA, 19 nt, Artificial Sequence
  Synthetic
uccucgucggagcacuccu

SEQ ID NO: 11163 - RNA, 20 nt, Artificial Sequence
  Synthetic
cuccucgucggagcacuccu

SEQ ID NO: 11164 - RNA, 21 nt, Artificial Sequence
  Synthetic
ccuccucgucggagcacuccu

SEQ ID NO: 11165 - RNA, 22 nt, Artificial Sequence
  Synthetic
gccuccucgucggagcacuccu

SEQ ID NO: 11166 - RNA, 23 nt, Artificial Sequence
  Synthetic
ugccuccucgucggagcacuccu

SEQ ID NO: 11167 - RNA, 24 nt, Artificial Sequence
  Synthetic
uugccuccucgucggagcacuccu

SEQ ID NO: 11168 - RNA, 18 nt, Artificial Sequence
  Synthetic
aagaucccuuccuuagcu

SEQ ID NO: 11169 - RNA, 19 nt, Artificial Sequence
  Synthetic
aaagaucccuuccuuagcu

SEQ ID NO: 11170 - RNA, 20 nt, Artificial Sequence
  Synthetic
caaagaucccuuccuuagcu

SEQ ID NO: 11171 - RNA, 21 nt, Artificial Sequence
  Synthetic
ucaaagaucccuuccuuagcu

SEQ ID NO: 11172 - RNA, 22 nt, Artificial Sequence
  Synthetic
cucaaagaucccuuccuuagcu

SEQ ID NO: 11173 - RNA, 23 nt, Artificial Sequence
  Synthetic
gcucaaagaucccuuccuuagcu

SEQ ID NO: 11174 - RNA, 24 nt, Artificial Sequence
  Synthetic
agcucaaagaucccuuccuuagcu

SEQ ID NO: 11175 - RNA, 18 nt, Artificial Sequence
  Synthetic
agaggguggacuacggcu

SEQ ID NO: 11176 - RNA, 19 nt, Artificial Sequence
  Synthetic
gagaggguggacuacggcu

SEQ ID NO: 11177 - RNA, 20 nt, Artificial Sequence
  Synthetic
cgagaggguggacuacggcu

SEQ ID NO: 11178 - RNA, 21 nt, Artificial Sequence
  Synthetic
gcgagaggguggacuacggcu

SEQ ID NO: 11179 - RNA, 22 nt, Artificial Sequence
  Synthetic
agcgagaggguggacuacggcu

SEQ ID NO: 11180 - RNA, 23 nt, Artificial Sequence
  Synthetic
gagcgagaggguggacuacggcu

SEQ ID NO: 11181 - RNA, 24 nt, Artificial Sequence
  Synthetic
agagcgagaggguggacuacggcu

SEQ ID NO: 11182 - RNA, 18 nt, Artificial Sequence
  Synthetic
cgguugaauccaauggcu

SEQ ID NO: 11183 - RNA, 19 nt, Artificial Sequence
  Synthetic
gcgguugaauccaauggcu

SEQ ID NO: 11184 - RNA, 20 nt, Artificial Sequence
  Synthetic
ugcgguugaauccaauggcu

SEQ ID NO: 11185 - RNA, 21 nt, Artificial Sequence
  Synthetic
cugcgguugaauccaauggcu

SEQ ID NO: 11186 - RNA, 22 nt, Artificial Sequence
  Synthetic
gcugcgguugaauccaauggcu

SEQ ID NO: 11187 - RNA, 23 nt, Artificial Sequence
  Synthetic
ugcugcgguugaauccaauggcu

SEQ ID NO: 11188 - RNA, 24 nt, Artificial Sequence
  Synthetic
gugcugcgguugaauccaauggcu

SEQ ID NO: 11189 - RNA, 18 nt, Artificial Sequence
  Synthetic
agcuggacggagggaucu

SEQ ID NO: 11190 - RNA, 19 nt, Artificial Sequence
  Synthetic
gagcuggacggagggaucu

SEQ ID NO: 11191 - RNA, 20 nt, Artificial Sequence
  Synthetic
ggagcuggacggagggaucu

SEQ ID NO: 11192 - RNA, 21 nt, Artificial Sequence
  Synthetic
gggagcuggacggagggaucu

SEQ ID NO: 11193 - RNA, 22 nt, Artificial Sequence
  Synthetic
ggggagcuggacggagggaucu

SEQ ID NO: 11194 - RNA, 23 nt, Artificial Sequence
  Synthetic
cggggagcuggacggagggaucu

SEQ ID NO: 11195 - RNA, 24 nt, Artificial Sequence
  Synthetic
ccggggagcuggacggagggaucu

SEQ ID NO: 11196 - RNA, 18 nt, Artificial Sequence
  Synthetic
cccgccauggauuucucu

SEQ ID NO: 11197 - RNA, 19 nt, Artificial Sequence
  Synthetic
ucccgccauggauuucucu

SEQ ID NO: 11198 - RNA, 20 nt, Artificial Sequence
  Synthetic
cucccgccauggauuucucu

SEQ ID NO: 11199 - RNA, 21 nt, Artificial Sequence
  Synthetic
ccucccgccauggauuucucu

SEQ ID NO: 11200 - RNA, 22 nt, Artificial Sequence
  Synthetic
gccucccgccauggauuucucu

SEQ ID NO: 11201 - RNA, 23 nt, Artificial Sequence
  Synthetic
agccucccgccauggauuucucu

SEQ ID NO: 11202 - RNA, 24 nt, Artificial Sequence
  Synthetic
gagccucccgccauggauuucucu

SEQ ID NO: 11203 - RNA, 18 nt, Artificial Sequence
  Synthetic
cgagagcccuuaaguucu

SEQ ID NO: 11204 - RNA, 19 nt, Artificial Sequence
  Synthetic
ucgagagcccuuaaguucu

SEQ ID NO: 11205 - RNA, 20 nt, Artificial Sequence
  Synthetic
cucgagagcccuuaaguucu

SEQ ID NO: 11206 - RNA, 21 nt, Artificial Sequence
  Synthetic
gcucgagagcccuuaaguucu

SEQ ID NO: 11207 - RNA, 22 nt, Artificial Sequence
  Synthetic
agcucgagagcccuuaaguucu

SEQ ID NO: 11208 - RNA, 23 nt, Artificial Sequence
  Synthetic
aagcucgagagcccuuaaguucu

SEQ ID NO: 11209 - RNA, 24 nt, Artificial Sequence
  Synthetic
gaagcucgagagcccuuaaguucu

SEQ ID NO: 11210 - RNA, 18 nt, Artificial Sequence
  Synthetic
cgccuuuugccuccucgu

SEQ ID NO: 11211 - RNA, 19 nt, Artificial Sequence
  Synthetic
ucgccuuuugccuccucgu

SEQ ID NO: 11212 - RNA, 20 nt, Artificial Sequence
  Synthetic
aucgccuuuugccuccucgu

SEQ ID NO: 11213 - RNA, 21 nt, Artificial Sequence
  Synthetic
aaucgccuuuugccuccucgu

SEQ ID NO: 11214 - RNA, 22 nt, Artificial Sequence
  Synthetic
caaucgccuuuugccuccucgu

SEQ ID NO: 11215 - RNA, 23 nt, Artificial Sequence
  Synthetic
acaaucgccuuuugccuccucgu

SEQ ID NO: 11216 - RNA, 24 nt, Artificial Sequence
  Synthetic
gacaaucgccuuuugccuccucgu

SEQ ID NO: 11217 - RNA, 18 nt, Artificial Sequence
  Synthetic
acgccccauauuaguggu

SEQ ID NO: 11218 - RNA, 19 nt, Artificial Sequence
  Synthetic
cacgccccauauuaguggu

SEQ ID NO: 11219 - RNA, 20 nt, Artificial Sequence
  Synthetic
gcacgccccauauuaguggu

SEQ ID NO: 11220 - RNA, 21 nt, Artificial Sequence
  Synthetic
agcacgccccauauuaguggu

SEQ ID NO: 11221 - RNA, 22 nt, Artificial Sequence
  Synthetic
gagcacgccccauauuaguggu

SEQ ID NO: 11222 - RNA, 23 nt, Artificial Sequence
  Synthetic
ggagcacgccccauauuaguggu

SEQ ID NO: 11223 - RNA, 24 nt, Artificial Sequence
  Synthetic
gggagcacgccccauauuaguggu

SEQ ID NO: 11224 - RNA, 18 nt, Artificial Sequence
  Synthetic
gacacuugugaguacugu

SEQ ID NO: 11225 - RNA, 19 nt, Artificial Sequence
  Synthetic
cgacacuugugaguacugu

SEQ ID NO: 11226 - RNA, 20 nt, Artificial Sequence
  Synthetic
gcgacacuugugaguacugu

SEQ ID NO: 11227 - RNA, 21 nt, Artificial Sequence
  Synthetic
agcgacacuugugaguacugu

SEQ ID NO: 11228 - RNA, 22 nt, Artificial Sequence
  Synthetic
cagcgacacuugugaguacugu

SEQ ID NO: 11229 - RNA, 23 nt, Artificial Sequence
  Synthetic
gcagcgacacuugugaguacugu

SEQ ID NO: 11230 - RNA, 24 nt, Artificial Sequence
  Synthetic
cgcagcgacacuugugaguacugu

SEQ ID NO: 11231 - RNA, 18 nt, Artificial Sequence
  Synthetic
cgcggguugguaucccuu

SEQ ID NO: 11232 - RNA, 19 nt, Artificial Sequence
  Synthetic
ccgcggguugguaucccuu

SEQ ID NO: 11233 - RNA, 20 nt, Artificial Sequence
  Synthetic
cccgcggguugguaucccuu

SEQ ID NO: 11234 - RNA, 21 nt, Artificial Sequence
  Synthetic
ccccgcggguugguaucccuu

SEQ ID NO: 11235 - RNA, 22 nt, Artificial Sequence
  Synthetic
accccgcggguugguaucccuu

SEQ ID NO: 11236 - RNA, 23 nt, Artificial Sequence
  Synthetic
gaccccgcggguugguaucccuu

SEQ ID NO: 11237 - RNA, 24 nt, Artificial Sequence
  Synthetic
ugaccccgcggguugguaucccuu

SEQ ID NO: 11238 - RNA, 18 nt, Artificial Sequence
  Synthetic
agaucccuuccuuagcuu

SEQ ID NO: 11239 - RNA, 19 nt, Artificial Sequence
  Synthetic
aagaucccuuccuuagcuu

SEQ ID NO: 11240 - RNA, 20 nt, Artificial Sequence
  Synthetic
aaagaucccuuccuuagcuu

SEQ ID NO: 11241 - RNA, 21 nt, Artificial Sequence
  Synthetic
caaagaucccuuccuuagcuu

SEQ ID NO: 11242 - RNA, 22 nt, Artificial Sequence
  Synthetic
ucaaagaucccuuccuuagcuu

SEQ ID NO: 11243 - RNA, 23 nt, Artificial Sequence
  Synthetic
cucaaagaucccuuccuuagcuu

SEQ ID NO: 11244 - RNA, 24 nt, Artificial Sequence
  Synthetic
gcucaaagaucccuuccuuagcuu

SEQ ID NO: 11245 - RNA, 18 nt, Artificial Sequence
  Synthetic
cucgagagcccuuaaguu

SEQ ID NO: 11246 - RNA, 19 nt, Artificial Sequence
  Synthetic
gcucgagagcccuuaaguu

SEQ ID NO: 11247 - RNA, 20 nt, Artificial Sequence
  Synthetic
agcucgagagcccuuaaguu

SEQ ID NO: 11248 - RNA, 21 nt, Artificial Sequence
  Synthetic
aagcucgagagcccuuaaguu

SEQ ID NO: 11249 - RNA, 22 nt, Artificial Sequence
  Synthetic
gaagcucgagagcccuuaaguu

SEQ ID NO: 11250 - RNA, 23 nt, Artificial Sequence
  Synthetic
ggaagcucgagagcccuuaaguu

SEQ ID NO: 11251 - RNA, 24 nt, Artificial Sequence
  Synthetic
uggaagcucgagagcccuuaaguu

SEQ ID NO: 11252 - RNA, 18 nt, Artificial Sequence
  Synthetic
ggcaagacguucaaauuu

SEQ ID NO: 11253 - RNA, 19 nt, Artificial Sequence
  Synthetic
cggcaagacguucaaauuu

SEQ ID NO: 11254 - RNA, 20 nt, Artificial Sequence
  Synthetic
gcggcaagacguucaaauuu

SEQ ID NO: 11255 - RNA, 21 nt, Artificial Sequence
  Synthetic
ugcggcaagacguucaaauuu

SEQ ID NO: 11256 - RNA, 22 nt, Artificial Sequence
  Synthetic
cugcggcaagacguucaaauuu

SEQ ID NO: 11257 - RNA, 23 nt, Artificial Sequence
  Synthetic
ucugcggcaagacguucaaauuu

SEQ ID NO: 11258 - RNA, 24 nt, Artificial Sequence
  Synthetic
uucugcggcaagacguucaaauuu

SEQ ID NO: 11259 - RNA, 17 nt, Artificial Sequence
  Synthetic
cgauuggugaaggggaa

SEQ ID NO: 11260 - RNA, 17 nt, Artificial Sequence
  Synthetic
auuggaugcuuuuuuca

SEQ ID NO: 11261 - RNA, 17 nt, Artificial Sequence
  Synthetic
caggucacgccagagga

SEQ ID NO: 11262 - RNA, 17 nt, Artificial Sequence
  Synthetic
cuuacgcgagaauuccc

SEQ ID NO: 11263 - RNA, 17 nt, Artificial Sequence
  Synthetic
ccuggaugccaaccucc

SEQ ID NO: 11264 - RNA, 17 nt, Artificial Sequence
  Synthetic
aacaaugcaauggcagc

SEQ ID NO: 11265 - RNA, 17 nt, Artificial Sequence
  Synthetic
ggggaagguggcuuauc

SEQ ID NO: 11266 - RNA, 17 nt, Artificial Sequence
  Synthetic
gguucaucaucuguaag

SEQ ID NO: 11267 - RNA, 17 nt, Artificial Sequence
  Synthetic
ugcacucaucccaggcg

SEQ ID NO: 11268 - RNA, 17 nt, Artificial Sequence
  Synthetic
uuaagugcugggguuug

SEQ ID NO: 11269 - RNA, 17 nt, Artificial Sequence
  Synthetic
ccaaccuccacgggauu

SEQ ID NO: 11270 - RNA, 20 nt, Artificial Sequence
  Synthetic
ucucgauuggugaaggggaa

SEQ ID NO: 11271 - RNA, 20 nt, Artificial Sequence
  Synthetic
gggauuggaugcuuuuuuca

SEQ ID NO: 11272 - RNA, 20 nt, Artificial Sequence
  Synthetic
auccaggucacgccagagga

SEQ ID NO: 11273 - RNA, 20 nt, Artificial Sequence
  Synthetic
uuacuuacgcgagaauuccc

SEQ ID NO: 11274 - RNA, 20 nt, Artificial Sequence
  Synthetic
ugaccuggaugccaaccucc

SEQ ID NO: 11275 - RNA, 20 nt, Artificial Sequence
  Synthetic
ggaaacaaugcaauggcagc

SEQ ID NO: 11276 - RNA, 20 nt, Artificial Sequence
  Synthetic
gaaggggaagguggcuuauc

SEQ ID NO: 11277 - RNA, 20 nt, Artificial Sequence
  Synthetic
ucugguucaucaucuguaag

SEQ ID NO: 11278 - RNA, 20 nt, Artificial Sequence
  Synthetic
uucugcacucaucccaggcg

SEQ ID NO: 11279 - RNA, 20 nt, Artificial Sequence
  Synthetic
ugcuuaagugcugggguuug

SEQ ID NO: 11280 - RNA, 20 nt, Artificial Sequence
  Synthetic
augccaaccuccacgggauu

SEQ ID NO: 11281 - RNA, 17 nt, Artificial Sequence
  Synthetic
uccgacgaggaggcaaa

SEQ ID NO: 11282 - RNA, 17 nt, Artificial Sequence
  Synthetic
cuuccggccuggcagaa

SEQ ID NO: 11283 - RNA, 17 nt, Artificial Sequence
  Synthetic
uccguguucgcuuucua

SEQ ID NO: 11284 - RNA, 17 nt, Artificial Sequence
  Synthetic
agagcgagaggguggac

SEQ ID NO: 11285 - RNA, 17 nt, Artificial Sequence
  Synthetic
cgggaggcuccauagcc

SEQ ID NO: 11286 - RNA, 17 nt, Artificial Sequence
  Synthetic
uucccagccaccucucc

SEQ ID NO: 11287 - RNA, 17 nt, Artificial Sequence
  Synthetic
agcuggggcugcccagc

SEQ ID NO: 11288 - RNA, 17 nt, Artificial Sequence
  Synthetic
gcuauggagccucccgc

SEQ ID NO: 11289 - RNA, 17 nt, Artificial Sequence
  Synthetic
cggccagguggccgcgc

SEQ ID NO: 11290 - RNA, 17 nt, Artificial Sequence
  Synthetic
gcgucuucauguggcgc

SEQ ID NO: 11291 - RNA, 17 nt, Artificial Sequence
  Synthetic
ucagaacuuaagggcuc

SEQ ID NO: 11292 - RNA, 17 nt, Artificial Sequence
  Synthetic
agcucaaagaucccuuc

SEQ ID NO: 11293 - RNA, 17 nt, Artificial Sequence
  Synthetic
gcaggucgaacuccuuc

SEQ ID NO: 11294 - RNA, 17 nt, Artificial Sequence
  Synthetic
ggggcgucgccaggaag

SEQ ID NO: 11295 - RNA, 17 nt, Artificial Sequence
  Synthetic
ccaggaucaguaucgag

SEQ ID NO: 11296 - RNA, 17 nt, Artificial Sequence
  Synthetic
ggcugggagggaggagg

SEQ ID NO: 11297 - RNA, 17 nt, Artificial Sequence
  Synthetic
gacuugaccgucauggg

SEQ ID NO: 11298 - RNA, 17 nt, Artificial Sequence
  Synthetic
cggccucggccaggugg

SEQ ID NO: 11299 - RNA, 17 nt, Artificial Sequence
  Synthetic
gcaugugcgucuucaug

SEQ ID NO: 11300 - RNA, 17 nt, Artificial Sequence
  Synthetic
cgcacagguugcacuug

SEQ ID NO: 11301 - RNA, 17 nt, Artificial Sequence
  Synthetic
acuccuucucgagcuug

SEQ ID NO: 11302 - RNA, 17 nt, Artificial Sequence
  Synthetic
aacacgcacagaacacu

SEQ ID NO: 11303 - RNA, 17 nt, Artificial Sequence
  Synthetic
ccucggagaacgggagu

SEQ ID NO: 11304 - RNA, 17 nt, Artificial Sequence
  Synthetic
ggucaggggacuuccgu

SEQ ID NO: 11305 - RNA, 20 nt, Artificial Sequence
  Synthetic
ugcuccgacgaggaggcaaa

SEQ ID NO: 11306 - RNA, 20 nt, Artificial Sequence
  Synthetic
aggcuuccggccuggcagaa

SEQ ID NO: 11307 - RNA, 20 nt, Artificial Sequence
  Synthetic
acuuccguguucgcuuucua

SEQ ID NO: 11308 - RNA, 20 nt, Artificial Sequence
  Synthetic
cggagagcgagaggguggac

SEQ ID NO: 11309 - RNA, 20 nt, Artificial Sequence
  Synthetic
uggcgggaggcuccauagcc

SEQ ID NO: 11310 - RNA, 20 nt, Artificial Sequence
  Synthetic
uccuucccagccaccucucc

SEQ ID NO: 11311 - RNA, 20 nt, Artificial Sequence
  Synthetic
gcgagcuggggcugcccagc

SEQ ID NO: 11312 - RNA, 20 nt, Artificial Sequence
  Synthetic
auggcuauggagccucccgc

SEQ ID NO: 11313 - RNA, 20 nt, Artificial Sequence
  Synthetic
ccucggccagguggccgcgc

SEQ ID NO: 11314 - RNA, 20 nt, Artificial Sequence
  Synthetic
ugugcgucuucauguggcgc

SEQ ID NO: 11315 - RNA, 20 nt, Artificial Sequence
  Synthetic
uucucagaacuuaagggcuc

SEQ ID NO: 11316 - RNA, 20 nt, Artificial Sequence
  Synthetic
ggcagcucaaagaucccuuc

SEQ ID NO: 11317 - RNA, 20 nt, Artificial Sequence
  Synthetic
ggggcaggucgaacuccuuc

SEQ ID NO: 11318 - RNA, 20 nt, Artificial Sequence
  Synthetic
gggggggcgucgccaggaag

SEQ ID NO: 11319 - RNA, 20 nt, Artificial Sequence
  Synthetic
auaccaggaucaguaucgag

SEQ ID NO: 11320 - RNA, 20 nt, Artificial Sequence
  Synthetic
gggggcugggagggaggagg

SEQ ID NO: 11321 - RNA, 20 nt, Artificial Sequence
  Synthetic
ucggacuugaccgucauggg

SEQ ID NO: 11322 - RNA, 20 nt, Artificial Sequence
  Synthetic
ccucggccucggccaggugg

SEQ ID NO: 11323 - RNA, 20 nt, Artificial Sequence
  Synthetic
ugugcaugugcgucuucaug

SEQ ID NO: 11324 - RNA, 20 nt, Artificial Sequence
  Synthetic
ggucgcacagguugcacuug

SEQ ID NO: 11325 - RNA, 20 nt, Artificial Sequence
  Synthetic
cgaacuccuucucgagcuug

SEQ ID NO: 11326 - RNA, 20 nt, Artificial Sequence
  Synthetic
ugcaacacgcacagaacacu

SEQ ID NO: 11327 - RNA, 20 nt, Artificial Sequence
  Synthetic
acuccucggagaacgggagu

SEQ ID NO: 11328 - RNA, 20 nt, Artificial Sequence
  Synthetic
cggggucaggggacuuccgu

SEQ ID NO: 11329 - RNA, 17 nt, Artificial Sequence
  Synthetic
aagugcauacacggcaa

SEQ ID NO: 11330 - RNA, 17 nt, Artificial Sequence
  Synthetic
uugcuugcggcgagaca

SEQ ID NO: 11331 - RNA, 17 nt, Artificial Sequence
  Synthetic
augucucgccgcaagca

SEQ ID NO: 11332 - RNA, 17 nt, Artificial Sequence
  Synthetic
ugacguucaaguucgca

SEQ ID NO: 11333 - RNA, 17 nt, Artificial Sequence
  Synthetic
uugugggagagccguca

SEQ ID NO: 11334 - RNA, 17 nt, Artificial Sequence
  Synthetic
acggcaaugguuccaga

SEQ ID NO: 11335 - RNA, 17 nt, Artificial Sequence
  Synthetic
gcgcucgcugcggccac

SEQ ID NO: 11336 - RNA, 17 nt, Artificial Sequence
  Synthetic
acgccagacgcggcccc

SEQ ID NO: 11337 - RNA, 17 nt, Artificial Sequence
  Synthetic
uucacaucgggagagcc

SEQ ID NO: 11338 - RNA, 17 nt, Artificial Sequence
  Synthetic
guucacaucgggagagc

SEQ ID NO: 11339 - RNA, 17 nt, Artificial Sequence
  Synthetic
uaaucacgagagcgcgc

SEQ ID NO: 11340 - RNA, 17 nt, Artificial Sequence
  Synthetic
cugacguucaaguucgc

SEQ ID NO: 11341 - RNA, 17 nt, Artificial Sequence
  Synthetic
cccguuugcuuaagugc

SEQ ID NO: 11342 - RNA, 17 nt, Artificial Sequence
  Synthetic
acggcucgguucacauc

SEQ ID NO: 11343 - RNA, 17 nt, Artificial Sequence
  Synthetic
cuugaacgucaggaguc

SEQ ID NO: 11344 - RNA, 17 nt, Artificial Sequence
  Synthetic
cugcgaacuugaacguc

SEQ ID NO: 11345 - RNA, 17 nt, Artificial Sequence
  Synthetic
cccccgggggccgcguc

SEQ ID NO: 11346 - RNA, 17 nt, Artificial Sequence
  Synthetic
uccgcggacgccagacg

SEQ ID NO: 11347 - RNA, 17 nt, Artificial Sequence
  Synthetic
gacuagaagcaaaagcg

SEQ ID NO: 11348 - RNA, 17 nt, Artificial Sequence
  Synthetic
agacauggugggcugcg

SEQ ID NO: 11349 - RNA, 17 nt, Artificial Sequence
  Synthetic
aaaaccuccgagagucg

SEQ ID NO: 11350 - RNA, 17 nt, Artificial Sequence
  Synthetic
uuuaccucgacucucgg

SEQ ID NO: 11351 - RNA, 17 nt, Artificial Sequence
  Synthetic
aguccgcgugugugggg

SEQ ID NO: 11352 - RNA, 17 nt, Artificial Sequence
  Synthetic
cguuugcuuaagugcug

SEQ ID NO: 11353 - RNA, 17 nt, Artificial Sequence
  Synthetic
uagaguccgcgugugug

SEQ ID NO: 11354 - RNA, 17 nt, Artificial Sequence
  Synthetic
gacggcucgguucacau

SEQ ID NO: 11355 - RNA, 17 nt, Artificial Sequence
  Synthetic
cuccccgcacuggccau

SEQ ID NO: 11356 - RNA, 17 nt, Artificial Sequence
  Synthetic
cggcaaugguuccagau

SEQ ID NO: 11357 - RNA, 17 nt, Artificial Sequence
  Synthetic
gcgggcggacgacggcu

SEQ ID NO: 11358 - RNA, 17 nt, Artificial Sequence
  Synthetic
ccguuugcuuaagugcu

SEQ ID NO: 11359 - RNA, 17 nt, Artificial Sequence
  Synthetic
uugcggcgagacauggu

SEQ ID NO: 11360 - RNA, 20 nt, Artificial Sequence
  Synthetic
cguggccgggagagaagaaa

SEQ ID NO: 11361 - RNA, 20 nt, Artificial Sequence
  Synthetic
gccuugcuugcggcgagaca

SEQ ID NO: 11362 - RNA, 20 nt, Artificial Sequence
  Synthetic
accaugucucgccgcaagca

SEQ ID NO: 11363 - RNA, 20 nt, Artificial Sequence
  Synthetic
uccugacguucaaguucgca

SEQ ID NO: 11364 - RNA, 20 nt, Artificial Sequence
  Synthetic
acaccaauggacacacauca

SEQ ID NO: 11365 - RNA, 20 nt, Artificial Sequence
  Synthetic
uacacggcaaugguuccaga

SEQ ID NO: 11366 - RNA, 20 nt, Artificial Sequence
  Synthetic
gccaauggccagugcgggga

SEQ ID NO: 11367 - RNA, 20 nt, Artificial Sequence
  Synthetic
aaugguuccagaugggauga

SEQ ID NO: 11368 - RNA, 20 nt, Artificial Sequence
  Synthetic
gagucuccuucuuucuaacc

SEQ ID NO: 11369 - RNA, 20 nt, Artificial Sequence
  Synthetic
cgguucacaucgggagagcc

SEQ ID NO: 11370 - RNA, 20 nt, Artificial Sequence
  Synthetic
ucgguucacaucgggagagc

SEQ ID NO: 11371 - RNA, 20 nt, Artificial Sequence
  Synthetic
ccgcgugugugggggggagc

SEQ ID NO: 11372 - RNA, 20 nt, Artificial Sequence
  Synthetic
uaauaaucacgagagcgcgc

SEQ ID NO: 11373 - RNA, 20 nt, Artificial Sequence
  Synthetic
aaauaauacaaagauggcgc

SEQ ID NO: 11374 - RNA, 20 nt, Artificial Sequence
  Synthetic
cuccugacguucaaguucgc

SEQ ID NO: 11375 - RNA, 20 nt, Artificial Sequence
  Synthetic
gagacacacaaaacaugggc

SEQ ID NO: 11376 - RNA, 20 nt, Artificial Sequence
  Synthetic
auucccguuugcuuaagugc

SEQ ID NO: 11377 - RNA, 20 nt, Artificial Sequence
  Synthetic
acgacggcucgguucacauc

SEQ ID NO: 11378 - RNA, 20 nt, Artificial Sequence
  Synthetic
cgcacuugaacuugcagcuc

SEQ ID NO: 11379 - RNA, 20 nt, Artificial Sequence
  Synthetic
ucccugcgaacuugaacguc

SEQ ID NO: 11380 - RNA, 20 nt, Artificial Sequence
  Synthetic
ucgagguaaaagagauaaag

SEQ ID NO: 11381 - RNA, 20 nt, Artificial Sequence
  Synthetic
ccaauggccagugcggggag

SEQ ID NO: 11382 - RNA, 20 nt, Artificial Sequence
  Synthetic
gacgccagacgcggcccccg

SEQ ID NO: 11383 - RNA, 20 nt, Artificial Sequence
  Synthetic
ugcggccacuggugagcccg

SEQ ID NO: 11384 - RNA, 20 nt, Artificial Sequence
  Synthetic
ggggccgcgucuggcguccg

SEQ ID NO: 11385 - RNA, 20 nt, Artificial Sequence
  Synthetic
gcgagacauggugggcugcg

SEQ ID NO: 11386 - RNA, 20 nt, Artificial Sequence
  Synthetic
agaaaaaccuccgagagucg

SEQ ID NO: 11387 - RNA, 20 nt, Artificial Sequence
  Synthetic
acgccagacgcggcccccgg

SEQ ID NO: 11388 - RNA, 20 nt, Artificial Sequence
  Synthetic
ucuuuuaccucgacucucgg

SEQ ID NO: 11389 - RNA, 20 nt, Artificial Sequence
  Synthetic
uagaguccgcgugugugggg

SEQ ID NO: 11390 - RNA, 20 nt, Artificial Sequence
  Synthetic
uuuagaguccgcgugugugg

SEQ ID NO: 11391 - RNA, 20 nt, Artificial Sequence
  Synthetic
caaugguuccagaugggaug

SEQ ID NO: 11392 - RNA, 20 nt, Artificial Sequence
  Synthetic
cggcgagacauggugggcug

SEQ ID NO: 11393 - RNA, 20 nt, Artificial Sequence
  Synthetic
cugagcugcaaguucaagug

SEQ ID NO: 11394 - RNA, 20 nt, Artificial Sequence
  Synthetic
cauuuuagaguccgcgugug

SEQ ID NO: 11395 - RNA, 20 nt, Artificial Sequence
  Synthetic
gacgacggcucgguucacau

SEQ ID NO: 11396 - RNA, 20 nt, Artificial Sequence
  Synthetic
agccccugauguguguccau

SEQ ID NO: 11397 - RNA, 20 nt, Artificial Sequence
  Synthetic
gcggcgggcggacgacggcu

SEQ ID NO: 11398 - RNA, 20 nt, Artificial Sequence
  Synthetic
aucucuuuuaccucgacucu

SEQ ID NO: 11399 - RNA, 20 nt, Artificial Sequence
  Synthetic
ugcuugcggcgagacauggu

SEQ ID NO: 11400 - RNA, 20 nt, Artificial Sequence
  Synthetic
auuuuagaguccgcgugugu

SEQ ID NO: 11401 - RNA, 17 nt, Artificial Sequence
  Synthetic
gagagagaugaaaaaaa

SEQ ID NO: 11402 - RNA, 17 nt, Artificial Sequence
  Synthetic
cccagcacuuaagcaaa

SEQ ID NO: 11403 - RNA, 17 nt, Artificial Sequence
  Synthetic
uuauuuuggaugucaaa

SEQ ID NO: 11404 - RNA, 17 nt, Artificial Sequence
  Synthetic
ggccgggagagaagaaa

SEQ ID NO: 11405 - RNA, 17 nt, Artificial Sequence
  Synthetic
gcaggggugggaggaaa

SEQ ID NO: 11406 - RNA, 17 nt, Artificial Sequence
  Synthetic
gagguaaaagagauaaa

SEQ ID NO: 11407 - RNA, 17 nt, Artificial Sequence
  Synthetic
aauuaaauaaaauuaaa

SEQ ID NO: 11408 - RNA, 17 nt, Artificial Sequence
  Synthetic
ggggaagcucacaccaa

SEQ ID NO: 11409 - RNA, 17 nt, Artificial Sequence
  Synthetic
agaccaggacaagccaa

SEQ ID NO: 11410 - RNA, 17 nt, Artificial Sequence
  Synthetic
uggccgggagagaagaa

SEQ ID NO: 11411 - RNA, 17 nt, Artificial Sequence
  Synthetic
gggcgagcaggagagaa

SEQ ID NO: 11412 - RNA, 17 nt, Artificial Sequence
  Synthetic
ggcaggggugggaggaa

SEQ ID NO: 11413 - RNA, 17 nt, Artificial Sequence
  Synthetic
agaaggggaggagggaa

SEQ ID NO: 11414 - RNA, 17 nt, Artificial Sequence
  Synthetic
cgagguaaaagagauaa

SEQ ID NO: 11415 - RNA, 17 nt, Artificial Sequence
  Synthetic
cagagacacacaaaaca

SEQ ID NO: 11416 - RNA, 17 nt, Artificial Sequence
  Synthetic
ucucaaaagugcauaca

SEQ ID NO: 11417 - RNA, 17 nt, Artificial Sequence
  Synthetic
gugugugggggggagca

SEQ ID NO: 11418 - RNA, 17 nt, Artificial Sequence
  Synthetic
aauacaaagauggcgca

SEQ ID NO: 11419 - RNA, 17 nt, Artificial Sequence
  Synthetic
cacacaaaacaugggca

SEQ ID NO: 11420 - RNA, 17 nt, Artificial Sequence
  Synthetic
agaagaaagggguggca

SEQ ID NO: 11421 - RNA, 17 nt, Artificial Sequence
  Synthetic
ccaauggacacacauca

SEQ ID NO: 11422 - RNA, 17 nt, Artificial Sequence
  Synthetic
cuugaacuugcagcuca

SEQ ID NO: 11423 - RNA, 17 nt, Artificial Sequence
  Synthetic
aaaaaaaaaaaaaaaga

SEQ ID NO: 11424 - RNA, 17 nt, Artificial Sequence
  Synthetic
uagaaauaauacaaaga

SEQ ID NO: 11425 - RNA, 17 nt, Artificial Sequence
  Synthetic
gagccggguuagaaaga

SEQ ID NO: 11426 - RNA, 17 nt, Artificial Sequence
  Synthetic
agggcgagcaggagaga

SEQ ID NO: 11427 - RNA, 17 nt, Artificial Sequence
  Synthetic
aaagcgagggggagaga

SEQ ID NO: 11428 - RNA, 17 nt, Artificial Sequence
  Synthetic
gagagaagagagauaga

SEQ ID NO: 11429 - RNA, 17 nt, Artificial Sequence
  Synthetic
cggcggcgggcggacga

SEQ ID NO: 11430 - RNA, 17 nt, Artificial Sequence
  Synthetic
ggggaggggcgggccga

SEQ ID NO: 11431 - RNA, 17 nt, Artificial Sequence
  Synthetic
acuagaagcaaaagcga

SEQ ID NO: 11432 - RNA, 17 nt, Artificial Sequence
  Synthetic
aggagagaaggggagga

SEQ ID NO: 11433 - RNA, 17 nt, Artificial Sequence
  Synthetic
gagaaggggaggaggga

SEQ ID NO: 11434 - RNA, 17 nt, Artificial Sequence
  Synthetic
ggggcgggccgagggga

SEQ ID NO: 11435 - RNA, 17 nt, Artificial Sequence
  Synthetic
aauggccagugcgggga

SEQ ID NO: 11436 - RNA, 17 nt, Artificial Sequence
  Synthetic
acgcggcccccggggga

SEQ ID NO: 11437 - RNA, 17 nt, Artificial Sequence
  Synthetic
aacgucaggagucugga

SEQ ID NO: 11438 - RNA, 17 nt, Artificial Sequence
  Synthetic
uuaaaaaaaagccauga

SEQ ID NO: 11439 - RNA, 17 nt, Artificial Sequence
  Synthetic
gguuccagaugggauga

SEQ ID NO: 11440 - RNA, 17 nt, Artificial Sequence
  Synthetic
ccagcacuuaagcaaac

SEQ ID NO: 11441 - RNA, 17 nt, Artificial Sequence
  Synthetic
ccucccccuccccgcac

SEQ ID NO: 11442 - RNA, 17 nt, Artificial Sequence
  Synthetic
ucuccuucuuucuaacc

SEQ ID NO: 11443 - RNA, 17 nt, Artificial Sequence
  Synthetic
gacaugaaaaagagacc

SEQ ID NO: 11444 - RNA, 17 nt, Artificial Sequence
  Synthetic
cgccagacgcggccccc

SEQ ID NO: 11445 - RNA, 17 nt, Artificial Sequence
  Synthetic
cggcccgccccuccccc

SEQ ID NO: 11446 - RNA, 17 nt, Artificial Sequence
  Synthetic
ucggcccgccccucccc

SEQ ID NO: 11447 - RNA, 17 nt, Artificial Sequence
  Synthetic
gcggcgguggcguggcc

SEQ ID NO: 11448 - RNA, 17 nt, Artificial Sequence
  Synthetic
accccuuucuucucucc

SEQ ID NO: 11449 - RNA, 17 nt, Artificial Sequence
  Synthetic
uggccauuggcuugucc

SEQ ID NO: 11450 - RNA, 17 nt, Artificial Sequence
  Synthetic
acaugggcagggcgagc

SEQ ID NO: 11451 - RNA, 17 nt, Artificial Sequence
  Synthetic
cgugugugggggggagc

SEQ ID NO: 11452 - RNA, 17 nt, Artificial Sequence
  Synthetic
gggggcgcuggggccgc

SEQ ID NO: 11453 - RNA, 17 nt, Artificial Sequence
  Synthetic
ccgaggggagggggcgc

SEQ ID NO: 11454 - RNA, 17 nt, Artificial Sequence
  Synthetic
uaauacaaagauggcgc

SEQ ID NO: 11455 - RNA, 17 nt, Artificial Sequence
  Synthetic
gcggcggcggcggcggc

SEQ ID NO: 11456 - RNA, 17 nt, Artificial Sequence
  Synthetic
ggacacacaucaggggc

SEQ ID NO: 11457 - RNA, 17 nt, Artificial Sequence
  Synthetic
gcccccgggggaggggc

SEQ ID NO: 11458 - RNA, 17 nt, Artificial Sequence
  Synthetic
auggugggcugcggggc

SEQ ID NO: 11459 - RNA, 17 nt, Artificial Sequence
  Synthetic
agggggaggugcggggc

SEQ ID NO: 11460 - RNA, 17 nt, Artificial Sequence
  Synthetic
acacacaaaacaugggc

SEQ ID NO: 11461 - RNA, 17 nt, Artificial Sequence
  Synthetic
cgcggcgguggcguggc

SEQ ID NO: 11462 - RNA, 17 nt, Artificial Sequence
  Synthetic
gagaagaaagggguggc

SEQ ID NO: 11463 - RNA, 17 nt, Artificial Sequence
  Synthetic
gagacauggugggcugc

SEQ ID NO: 11464 - RNA, 17 nt, Artificial Sequence
  Synthetic
aagccaauggccagugc

SEQ ID NO: 11465 - RNA, 17 nt, Artificial Sequence
  Synthetic
cggggagggggaggugc

SEQ ID NO: 11466 - RNA, 17 nt, Artificial Sequence
  Synthetic
accaauggacacacauc

SEQ ID NO: 11467 - RNA, 17 nt, Artificial Sequence
  Synthetic
aaaacccucaucccauc

SEQ ID NO: 11468 - RNA, 17 nt, Artificial Sequence
  Synthetic
acuugaacuugcagcuc

SEQ ID NO: 11469 - RNA, 17 nt, Artificial Sequence
  Synthetic
gaugaagauauuuucuc

SEQ ID NO: 11470 - RNA, 17 nt, Artificial Sequence
  Synthetic
aaaaaaaaaaaaaaaag

SEQ ID NO: 11471 - RNA, 17 nt, Artificial Sequence
  Synthetic
gccgggagagaagaaag

SEQ ID NO: 11472 - RNA, 17 nt, Artificial Sequence
  Synthetic
agguaaaagagauaaag

SEQ ID NO: 11473 - RNA, 17 nt, Artificial Sequence
  Synthetic
ggcgagcaggagagaag

SEQ ID NO: 11474 - RNA, 17 nt, Artificial Sequence
  Synthetic
gaaggggaggagggaag

SEQ ID NO: 11475 - RNA, 17 nt, Artificial Sequence
  Synthetic
ggccgcgggcucaccag

SEQ ID NO: 11476 - RNA, 17 nt, Artificial Sequence
  Synthetic
gaagaaagggguggcag

SEQ ID NO: 11477 - RNA, 17 nt, Artificial Sequence
  Synthetic
caauggacacacaucag

SEQ ID NO: 11478 - RNA, 17 nt, Artificial Sequence
  Synthetic
uugaacuugcagcucag

SEQ ID NO: 11479 - RNA, 17 nt, Artificial Sequence
  Synthetic
aagcgagggggagagag

SEQ ID NO: 11480 - RNA, 17 nt, Artificial Sequence
  Synthetic
aaaagcgagggggagag

SEQ ID NO: 11481 - RNA, 17 nt, Artificial Sequence
  Synthetic
gggaggggcgggccgag

SEQ ID NO: 11482 - RNA, 17 nt, Artificial Sequence
  Synthetic
cuagaagcaaaagcgag

SEQ ID NO: 11483 - RNA, 17 nt, Artificial Sequence
  Synthetic
gggcgggccgaggggag

SEQ ID NO: 11484 - RNA, 17 nt, Artificial Sequence
  Synthetic
auggccagugcggggag

SEQ ID NO: 11485 - RNA, 17 nt, Artificial Sequence
  Synthetic
cgcggcccccgggggag

SEQ ID NO: 11486 - RNA, 17 nt, Artificial Sequence
  Synthetic
agagagaagagagauag

SEQ ID NO: 11487 - RNA, 17 nt, Artificial Sequence
  Synthetic
gcucccccccacacacg

SEQ ID NO: 11488 - RNA, 17 nt, Artificial Sequence
  Synthetic
gccagacgcggcccccg

SEQ ID NO: 11489 - RNA, 17 nt, Artificial Sequence
  Synthetic
ggcccgccccucccccg

SEQ ID NO: 11490 - RNA, 17 nt, Artificial Sequence
  Synthetic
ggccacuggugagcccg

SEQ ID NO: 11491 - RNA, 17 nt, Artificial Sequence
  Synthetic
cggccacgccaccgccg

SEQ ID NO: 11492 - RNA, 17 nt, Artificial Sequence
  Synthetic
ggccgcagcgagcgccg

SEQ ID NO: 11493 - RNA, 17 nt, Artificial Sequence
  Synthetic
gggggaggggcgggccg

SEQ ID NO: 11494 - RNA, 17 nt, Artificial Sequence
  Synthetic
agggggcgcuggggccg

SEQ ID NO: 11495 - RNA, 17 nt, Artificial Sequence
  Synthetic
cggggcggggggcuccg

SEQ ID NO: 11496 - RNA, 17 nt, Artificial Sequence
  Synthetic
gccgcgucuggcguccg

SEQ ID NO: 11497 - RNA, 17 nt, Artificial Sequence
  Synthetic
gggggaggugcggggcg

SEQ ID NO: 11498 - RNA, 17 nt, Artificial Sequence
  Synthetic
gcgccgcggcgguggcg

SEQ ID NO: 11499 - RNA, 17 nt, Artificial Sequence
  Synthetic
agccaauggccagugcg

SEQ ID NO: 11500 - RNA, 17 nt, Artificial Sequence
  Synthetic
ggggagggggaggugcg

SEQ ID NO: 11501 - RNA, 17 nt, Artificial Sequence
  Synthetic
gguaaaagagauaaagg

SEQ ID NO: 11502 - RNA, 17 nt, Artificial Sequence
  Synthetic
ugaacuugcagcucagg

SEQ ID NO: 11503 - RNA, 17 nt, Artificial Sequence
  Synthetic
uagaagcaaaagcgagg

SEQ ID NO: 11504 - RNA, 17 nt, Artificial Sequence
  Synthetic
caggagagaaggggagg

SEQ ID NO: 11505 - RNA, 17 nt, Artificial Sequence
  Synthetic
ggcgggccgaggggagg

SEQ ID NO: 11506 - RNA, 17 nt, Artificial Sequence
  Synthetic
uggccagugcggggagg

SEQ ID NO: 11507 - RNA, 17 nt, Artificial Sequence
  Synthetic
ccagacgcggcccccgg

SEQ ID NO: 11508 - RNA, 17 nt, Artificial Sequence
  Synthetic
gcccgccccucccccgg

SEQ ID NO: 11509 - RNA, 17 nt, Artificial Sequence
  Synthetic
cgcagcgagcgccgcgg

SEQ ID NO: 11510 - RNA, 17 nt, Artificial Sequence
  Synthetic
agcgagcgccgcggcgg

SEQ ID NO: 11511 - RNA, 17 nt, Artificial Sequence
  Synthetic
ggcggcggcggcggcgg

SEQ ID NO: 11512 - RNA, 17 nt, Artificial Sequence
  Synthetic
gcgggcggcggcggcgg

SEQ ID NO: 11513 - RNA, 17 nt, Artificial Sequence
  Synthetic
ggggcgggcggcggcgg

SEQ ID NO: 11514 - RNA, 17 nt, Artificial Sequence
  Synthetic
ugcggggcgggcggcgg

SEQ ID NO: 11515 - RNA, 17 nt, Artificial Sequence
  Synthetic
ggcugcggggcgggcgg

SEQ ID NO: 11516 - RNA, 17 nt, Artificial Sequence
  Synthetic
ggggaggugcggggcgg

SEQ ID NO: 11517 - RNA, 17 nt, Artificial Sequence
  Synthetic
ggggugggaggaaaggg

SEQ ID NO: 11518 - RNA, 17 nt, Artificial Sequence
  Synthetic
gaacuugcagcucaggg

SEQ ID NO: 11519 - RNA, 17 nt, Artificial Sequence
  Synthetic
gcggcggcggcggcggg

SEQ ID NO: 11520 - RNA, 17 nt, Artificial Sequence
  Synthetic
gugggcugcggggcggg

SEQ ID NO: 11521 - RNA, 17 nt, Artificial Sequence
  Synthetic
gggaggugcggggcggg

SEQ ID NO: 11522 - RNA, 17 nt, Artificial Sequence
  Synthetic
gggagagaagaaagggg

SEQ ID NO: 11523 - RNA, 17 nt, Artificial Sequence
  Synthetic
gagcaggagagaagggg

SEQ ID NO: 11524 - RNA, 17 nt, Artificial Sequence
  Synthetic
gaaagggguggcagggg

SEQ ID NO: 11525 - RNA, 17 nt, Artificial Sequence
  Synthetic
aggggcgggccgagggg

SEQ ID NO: 11526 - RNA, 17 nt, Artificial Sequence
  Synthetic
ggcccccgggggagggg

SEQ ID NO: 11527 - RNA, 17 nt, Artificial Sequence
  Synthetic
cauggugggcugcgggg

SEQ ID NO: 11528 - RNA, 17 nt, Artificial Sequence
  Synthetic
caauggccagugcgggg

SEQ ID NO: 11529 - RNA, 17 nt, Artificial Sequence
  Synthetic
gagggggaggugcgggg

SEQ ID NO: 11530 - RNA, 17 nt, Artificial Sequence
  Synthetic
ccagugcggggaggggg

SEQ ID NO: 11531 - RNA, 17 nt, Artificial Sequence
  Synthetic
gacgcggcccccggggg

SEQ ID NO: 11532 - RNA, 17 nt, Artificial Sequence
  Synthetic
gggaggaaagggugggg

SEQ ID NO: 11533 - RNA, 17 nt, Artificial Sequence
  Synthetic
ugggaggaaaggguggg

SEQ ID NO: 11534 - RNA, 17 nt, Artificial Sequence
  Synthetic
gggguggcagggguggg

SEQ ID NO: 11535 - RNA, 17 nt, Artificial Sequence
  Synthetic
gaguccgcguguguggg

SEQ ID NO: 11536 - RNA, 17 nt, Artificial Sequence
  Synthetic
cuugcggcgagacaugg

SEQ ID NO: 11537 - RNA, 17 nt, Artificial Sequence
  Synthetic
gugggaggaaagggugg

SEQ ID NO: 11538 - RNA, 17 nt, Artificial Sequence
  Synthetic
agaguccgcgugugugg

SEQ ID NO: 11539 - RNA, 17 nt, Artificial Sequence
  Synthetic
ugguuccagaugggaug

SEQ ID NO: 11540 - RNA, 17 nt, Artificial Sequence
  Synthetic
gaggggagggggcgcug

SEQ ID NO: 11541 - RNA, 17 nt, Artificial Sequence
  Synthetic
cgccgcggcgcucgcug

SEQ ID NO: 11542 - RNA, 17 nt, Artificial Sequence
  Synthetic
cgagacauggugggcug

SEQ ID NO: 11543 - RNA, 17 nt, Artificial Sequence
  Synthetic
agcugcaaguucaagug

SEQ ID NO: 11544 - RNA, 17 nt, Artificial Sequence
  Synthetic
caagccaauggccagug

SEQ ID NO: 11545 - RNA, 17 nt, Artificial Sequence
  Synthetic
gcggggagggggaggug

SEQ ID NO: 11546 - RNA, 17 nt, Artificial Sequence
  Synthetic
ggugggaggaaagggug

SEQ ID NO: 11547 - RNA, 17 nt, Artificial Sequence
  Synthetic
uuuagaguccgcgugug

SEQ ID NO: 11548 - RNA, 17 nt, Artificial Sequence
  Synthetic
gcagggaagaugaauug

SEQ ID NO: 11549 - RNA, 17 nt, Artificial Sequence
  Synthetic
gggguuugccuugcuug

SEQ ID NO: 11550 - RNA, 17 nt, Artificial Sequence
  Synthetic
agagacacacaaaacau

SEQ ID NO: 11551 - RNA, 17 nt, Artificial Sequence
  Synthetic
cccugauguguguccau

SEQ ID NO: 11552 - RNA, 17 nt, Artificial Sequence
  Synthetic
auuauuauuacuauuau

SEQ ID NO: 11553 - RNA, 17 nt, Artificial Sequence
  Synthetic
ccagcgcccccuccccu

SEQ ID NO: 11554 - RNA, 17 nt, Artificial Sequence
  Synthetic
cgaggggagggggcgcu

SEQ ID NO: 11555 - RNA, 17 nt, Artificial Sequence
  Synthetic
ucuuuuaccucgacucu

SEQ ID NO: 11556 - RNA, 17 nt, Artificial Sequence
  Synthetic
gggugggaggaaagggu

SEQ ID NO: 11557 - RNA, 17 nt, Artificial Sequence
  Synthetic
aaagggguggcaggggu

SEQ ID NO: 11558 - RNA, 17 nt, Artificial Sequence
  Synthetic
uuagaguccgcgugugu

SEQ ID NO: 11559 - RNA, 17 nt, Artificial Sequence
  Synthetic
cagggaagaugaauugu

SEQ ID NO: 11560 - RNA, 17 nt, Artificial Sequence
  Synthetic
uuauuauuacuauuauu

SEQ ID NO: 11561 - RNA, 17 nt, Artificial Sequence
  Synthetic
uuauuucuaauuuauuu

SEQ ID NO: 11562 - RNA, 20 nt, Artificial Sequence
  Synthetic
agagagagagaugaaaaaaa

SEQ ID NO: 11563 - RNA, 20 nt, Artificial Sequence
  Synthetic
aaccccagcacuuaagcaaa

SEQ ID NO: 11564 - RNA, 20 nt, Artificial Sequence
  Synthetic
aauuuauuuuggaugucaaa

SEQ ID NO: 11565 - RNA, 20 nt, Artificial Sequence
  Synthetic
guggcaggggugggaggaaa

SEQ ID NO: 11566 - RNA, 20 nt, Artificial Sequence
  Synthetic
gucgagguaaaagagauaaa

SEQ ID NO: 11567 - RNA, 20 nt, Artificial Sequence
  Synthetic
uaaaauuaaauaaaauuaaa

SEQ ID NO: 11568 - RNA, 20 nt, Artificial Sequence
  Synthetic
gaaggggaagcucacaccaa

SEQ ID NO: 11569 - RNA, 20 nt, Artificial Sequence
  Synthetic
aagagaccaggacaagccaa

SEQ ID NO: 11570 - RNA, 20 nt, Artificial Sequence
  Synthetic
caaaagugcauacacggcaa

SEQ ID NO: 11571 - RNA, 20 nt, Artificial Sequence
  Synthetic
gcguggccgggagagaagaa

SEQ ID NO: 11572 - RNA, 20 nt, Artificial Sequence
  Synthetic
gcagggcgagcaggagagaa

SEQ ID NO: 11573 - RNA, 20 nt, Artificial Sequence
  Synthetic
gguggcaggggugggaggaa

SEQ ID NO: 11574 - RNA, 20 nt, Artificial Sequence
  Synthetic
gagagaaggggaggagggaa

SEQ ID NO: 11575 - RNA, 20 nt, Artificial Sequence
  Synthetic
agucgagguaaaagagauaa

SEQ ID NO: 11576 - RNA, 20 nt, Artificial Sequence
  Synthetic
ggacagagacacacaaaaca

SEQ ID NO: 11577 - RNA, 20 nt, Artificial Sequence
  Synthetic
cugucucaaaagugcauaca

SEQ ID NO: 11578 - RNA, 20 nt, Artificial Sequence
  Synthetic
cgcgugugugggggggagca

SEQ ID NO: 11579 - RNA, 20 nt, Artificial Sequence
  Synthetic
aauaauacaaagauggcgca

SEQ ID NO: 11580 - RNA, 20 nt, Artificial Sequence
  Synthetic
agacacacaaaacaugggca

SEQ ID NO: 11581 - RNA, 20 nt, Artificial Sequence
  Synthetic
gagagaagaaagggguggca

SEQ ID NO: 11582 - RNA, 20 nt, Artificial Sequence
  Synthetic
gcacuugaacuugcagcuca

SEQ ID NO: 11583 - RNA, 20 nt, Artificial Sequence
  Synthetic
gaauugugggagagccguca

SEQ ID NO: 11584 - RNA, 20 nt, Artificial Sequence
  Synthetic
aaaaaaaaaaaaaaaaaaga

SEQ ID NO: 11585 - RNA, 20 nt, Artificial Sequence
  Synthetic
aauuagaaauaauacaaaga

SEQ ID NO: 11586 - RNA, 20 nt, Artificial Sequence
  Synthetic
ggagagccggguuagaaaga

SEQ ID NO: 11587 - RNA, 20 nt, Artificial Sequence
  Synthetic
ggcagggcgagcaggagaga

SEQ ID NO: 11588 - RNA, 20 nt, Artificial Sequence
  Synthetic
gcaaaagcgagggggagaga

SEQ ID NO: 11589 - RNA, 20 nt, Artificial Sequence
  Synthetic
agagagagaagagagauaga

SEQ ID NO: 11590 - RNA, 20 nt, Artificial Sequence
  Synthetic
cggcggcggcgggcggacga

SEQ ID NO: 11591 - RNA, 20 nt, Artificial Sequence
  Synthetic
ccgggggaggggcgggccga

SEQ ID NO: 11592 - RNA, 20 nt, Artificial Sequence
  Synthetic
aggacuagaagcaaaagcga

SEQ ID NO: 11593 - RNA, 20 nt, Artificial Sequence
  Synthetic
agcaggagagaaggggagga

SEQ ID NO: 11594 - RNA, 20 nt, Artificial Sequence
  Synthetic
ggagagaaggggaggaggga

SEQ ID NO: 11595 - RNA, 20 nt, Artificial Sequence
  Synthetic
ggaggggcgggccgagggga

SEQ ID NO: 11596 - RNA, 20 nt, Artificial Sequence
  Synthetic
cagacgcggcccccggggga

SEQ ID NO: 11597 - RNA, 20 nt, Artificial Sequence
  Synthetic
uugaacgucaggagucugga

SEQ ID NO: 11598 - RNA, 20 nt, Artificial Sequence
  Synthetic
ugcuuaaaaaaaagccauga

SEQ ID NO: 11599 - RNA, 20 nt, Artificial Sequence
  Synthetic
accccagcacuuaagcaaac

SEQ ID NO: 11600 - RNA, 20 nt, Artificial Sequence
  Synthetic
gcggcgcucgcugcggccac

SEQ ID NO: 11601 - RNA, 20 nt, Artificial Sequence
  Synthetic
gcaccucccccuccccgcac

SEQ ID NO: 11602 - RNA, 20 nt, Artificial Sequence
  Synthetic
cuggacaugaaaaagagacc

SEQ ID NO: 11603 - RNA, 20 nt, Artificial Sequence
  Synthetic
ggacgccagacgcggccccc

SEQ ID NO: 11604 - RNA, 20 nt, Artificial Sequence
  Synthetic
ccucggcccgccccuccccc

SEQ ID NO: 11605 - RNA, 20 nt, Artificial Sequence
  Synthetic
cggacgccagacgcggcccc

SEQ ID NO: 11606 - RNA, 20 nt, Artificial Sequence
  Synthetic
cccucggcccgccccucccc

SEQ ID NO: 11607 - RNA, 20 nt, Artificial Sequence
  Synthetic
gccgcggcgguggcguggcc

SEQ ID NO: 11608 - RNA, 20 nt, Artificial Sequence
  Synthetic
gccaccccuuucuucucucc

SEQ ID NO: 11609 - RNA, 20 nt, Artificial Sequence
  Synthetic
cacuggccauuggcuugucc

SEQ ID NO: 11610 - RNA, 20 nt, Artificial Sequence
  Synthetic
aaaacaugggcagggcgagc

SEQ ID NO: 11611 - RNA, 20 nt, Artificial Sequence
  Synthetic
ggagggggcgcuggggccgc

SEQ ID NO: 11612 - RNA, 20 nt, Artificial Sequence
  Synthetic
gggccgaggggagggggcgc

SEQ ID NO: 11613 - RNA, 20 nt, Artificial Sequence
  Synthetic
gcggcggcggcggcggcggc

SEQ ID NO: 11614 - RNA, 20 nt, Artificial Sequence
  Synthetic
aauggacacacaucaggggc

SEQ ID NO: 11615 - RNA, 20 nt, Artificial Sequence
  Synthetic
gcggcccccgggggaggggc

SEQ ID NO: 11616 - RNA, 20 nt, Artificial Sequence
  Synthetic
gacauggugggcugcggggc

SEQ ID NO: 11617 - RNA, 20 nt, Artificial Sequence
  Synthetic
gggagggggaggugcggggc

SEQ ID NO: 11618 - RNA, 20 nt, Artificial Sequence
  Synthetic
cgccgcggcgguggcguggc

SEQ ID NO: 11619 - RNA, 20 nt, Artificial Sequence
  Synthetic
ggagagaagaaagggguggc

SEQ ID NO: 11620 - RNA, 20 nt, Artificial Sequence
  Synthetic
ggcgagacauggugggcugc

SEQ ID NO: 11621 - RNA, 20 nt, Artificial Sequence
  Synthetic
gacaagccaauggccagugc

SEQ ID NO: 11622 - RNA, 20 nt, Artificial Sequence
  Synthetic
gugcggggagggggaggugc

SEQ ID NO: 11623 - RNA, 20 nt, Artificial Sequence
  Synthetic
cacaccaauggacacacauc

SEQ ID NO: 11624 - RNA, 20 nt, Artificial Sequence
  Synthetic
gaaaaaacccucaucccauc

SEQ ID NO: 11625 - RNA, 20 nt, Artificial Sequence
  Synthetic
acugaugaagauauuuucuc

SEQ ID NO: 11626 - RNA, 20 nt, Artificial Sequence
  Synthetic
gaacuugaacgucaggaguc

SEQ ID NO: 11627 - RNA, 20 nt, Artificial Sequence
  Synthetic
ccucccccgggggccgcguc

SEQ ID NO: 11628 - RNA, 20 nt, Artificial Sequence
  Synthetic
aaaaaaaaaaaaaaaaaaag

SEQ ID NO: 11629 - RNA, 20 nt, Artificial Sequence
  Synthetic
guggccgggagagaagaaag

SEQ ID NO: 11630 - RNA, 20 nt, Artificial Sequence
  Synthetic
cagggcgagcaggagagaag

SEQ ID NO: 11631 - RNA, 20 nt, Artificial Sequence
  Synthetic
agagaaggggaggagggaag

SEQ ID NO: 11632 - RNA, 20 nt, Artificial Sequence
  Synthetic
uggggccgcgggcucaccag

SEQ ID NO: 11633 - RNA, 20 nt, Artificial Sequence
  Synthetic
agagaagaaagggguggcag

SEQ ID NO: 11634 - RNA, 20 nt, Artificial Sequence
  Synthetic
caccaauggacacacaucag

SEQ ID NO: 11635 - RNA, 20 nt, Artificial Sequence
  Synthetic
cacuugaacuugcagcucag

SEQ ID NO: 11636 - RNA, 20 nt, Artificial Sequence
  Synthetic
caaaagcgagggggagagag

SEQ ID NO: 11637 - RNA, 20 nt, Artificial Sequence
  Synthetic
agcaaaagcgagggggagag

SEQ ID NO: 11638 - RNA, 20 nt, Artificial Sequence
  Synthetic
cgggggaggggcgggccgag

SEQ ID NO: 11639 - RNA, 20 nt, Artificial Sequence
  Synthetic
ggacuagaagcaaaagcgag

SEQ ID NO: 11640 - RNA, 20 nt, Artificial Sequence
  Synthetic
gaggggcgggccgaggggag

SEQ ID NO: 11641 - RNA, 20 nt, Artificial Sequence
  Synthetic
agacgcggcccccgggggag

SEQ ID NO: 11642 - RNA, 20 nt, Artificial Sequence
  Synthetic
gagagagagaagagagauag

SEQ ID NO: 11643 - RNA, 20 nt, Artificial Sequence
  Synthetic
ccugcucccccccacacacg

SEQ ID NO: 11644 - RNA, 20 nt, Artificial Sequence
  Synthetic
ggcuccgcggacgccagacg

SEQ ID NO: 11645 - RNA, 20 nt, Artificial Sequence
  Synthetic
cucggcccgccccucccccg

SEQ ID NO: 11646 - RNA, 20 nt, Artificial Sequence
  Synthetic
ucccggccacgccaccgccg

SEQ ID NO: 11647 - RNA, 20 nt, Artificial Sequence
  Synthetic
aguggccgcagcgagcgccg

SEQ ID NO: 11648 - RNA, 20 nt, Artificial Sequence
  Synthetic
cccgggggaggggcgggccg

SEQ ID NO: 11649 - RNA, 20 nt, Artificial Sequence
  Synthetic
gggagggggcgcuggggccg

SEQ ID NO: 11650 - RNA, 20 nt, Artificial Sequence
  Synthetic
gugcggggcggggggcuccg

SEQ ID NO: 11651 - RNA, 20 nt, Artificial Sequence
  Synthetic
caggacuagaagcaaaagcg

SEQ ID NO: 11652 - RNA, 20 nt, Artificial Sequence
  Synthetic
ggagggggaggugcggggcg

SEQ ID NO: 11653 - RNA, 20 nt, Artificial Sequence
  Synthetic
cgagcgccgcggcgguggcg

SEQ ID NO: 11654 - RNA, 20 nt, Artificial Sequence
  Synthetic
acaagccaauggccagugcg

SEQ ID NO: 11655 - RNA, 20 nt, Artificial Sequence
  Synthetic
ugcggggagggggaggugcg

SEQ ID NO: 11656 - RNA, 20 nt, Artificial Sequence
  Synthetic
cgagguaaaagagauaaagg

SEQ ID NO: 11657 - RNA, 20 nt, Artificial Sequence
  Synthetic
acuugaacuugcagcucagg

SEQ ID NO: 11658 - RNA, 20 nt, Artificial Sequence
  Synthetic
gacuagaagcaaaagcgagg

SEQ ID NO: 11659 - RNA, 20 nt, Artificial Sequence
  Synthetic
gagcaggagagaaggggagg

SEQ ID NO: 11660 - RNA, 20 nt, Artificial Sequence
  Synthetic
aggggcgggccgaggggagg

SEQ ID NO: 11661 - RNA, 20 nt, Artificial Sequence
  Synthetic
caauggccagugcggggagg

SEQ ID NO: 11662 - RNA, 20 nt, Artificial Sequence
  Synthetic
ucggcccgccccucccccgg

SEQ ID NO: 11663 - RNA, 20 nt, Artificial Sequence
  Synthetic
ggccgcagcgagcgccgcgg

SEQ ID NO: 11664 - RNA, 20 nt, Artificial Sequence
  Synthetic
cgcagcgagcgccgcggcgg

SEQ ID NO: 11665 - RNA, 20 nt, Artificial Sequence
  Synthetic
ggcggcggcggcggcggcgg

SEQ ID NO: 11666 - RNA, 20 nt, Artificial Sequence
  Synthetic
gcgggcggcggcggcggcgg

SEQ ID NO: 11667 - RNA, 20 nt, Artificial Sequence
  Synthetic
ggggcgggcggcggcggcgg

SEQ ID NO: 11668 - RNA, 20 nt, Artificial Sequence
  Synthetic
ugcggggcgggcggcggcgg

SEQ ID NO: 11669 - RNA, 20 nt, Artificial Sequence
  Synthetic
ggcugcggggcgggcggcgg

SEQ ID NO: 11670 - RNA, 20 nt, Artificial Sequence
  Synthetic
gugggcugcggggcgggcgg

SEQ ID NO: 11671 - RNA, 20 nt, Artificial Sequence
  Synthetic
gagggggaggugcggggcgg

SEQ ID NO: 11672 - RNA, 20 nt, Artificial Sequence
  Synthetic
gcaggggugggaggaaaggg

SEQ ID NO: 11673 - RNA, 20 nt, Artificial Sequence
  Synthetic
cuugaacuugcagcucaggg

SEQ ID NO: 11674 - RNA, 20 nt, Artificial Sequence
  Synthetic
gcggcggcggcggcggcggg

SEQ ID NO: 11675 - RNA, 20 nt, Artificial Sequence
  Synthetic
auggugggcugcggggcggg

SEQ ID NO: 11676 - RNA, 20 nt, Artificial Sequence
  Synthetic
agggggaggugcggggcggg

SEQ ID NO: 11677 - RNA, 20 nt, Artificial Sequence
  Synthetic
gccgggagagaagaaagggg

SEQ ID NO: 11678 - RNA, 20 nt, Artificial Sequence
  Synthetic
ggcgagcaggagagaagggg

SEQ ID NO: 11679 - RNA, 20 nt, Artificial Sequence
  Synthetic
gaagaaagggguggcagggg

SEQ ID NO: 11680 - RNA, 20 nt, Artificial Sequence
  Synthetic
gggaggggcgggccgagggg

SEQ ID NO: 11681 - RNA, 20 nt, Artificial Sequence
  Synthetic
cgcggcccccgggggagggg

SEQ ID NO: 11682 - RNA, 20 nt, Artificial Sequence
  Synthetic
agacauggugggcugcgggg

SEQ ID NO: 11683 - RNA, 20 nt, Artificial Sequence
  Synthetic
agccaauggccagugcgggg

SEQ ID NO: 11684 - RNA, 20 nt, Artificial Sequence
  Synthetic
ggggagggggaggugcgggg

SEQ ID NO: 11685 - RNA, 20 nt, Artificial Sequence
  Synthetic
uggccagugcggggaggggg

SEQ ID NO: 11686 - RNA, 20 nt, Artificial Sequence
  Synthetic
ccagacgcggcccccggggg

SEQ ID NO: 11687 - RNA, 20 nt, Artificial Sequence
  Synthetic
ggugggaggaaagggugggg

SEQ ID NO: 11688 - RNA, 20 nt, Artificial Sequence
  Synthetic
gggugggaggaaaggguggg

SEQ ID NO: 11689 - RNA, 20 nt, Artificial Sequence
  Synthetic
aaagggguggcagggguggg

SEQ ID NO: 11690 - RNA, 20 nt, Artificial Sequence
  Synthetic
uuagaguccgcguguguggg

SEQ ID NO: 11691 - RNA, 20 nt, Artificial Sequence
  Synthetic
uugcuugcggcgagacaugg

SEQ ID NO: 11692 - RNA, 20 nt, Artificial Sequence
  Synthetic
ggggugggaggaaagggugg

SEQ ID NO: 11693 - RNA, 20 nt, Artificial Sequence
  Synthetic
gccgaggggagggggcgcug

SEQ ID NO: 11694 - RNA, 20 nt, Artificial Sequence
  Synthetic
caccgccgcggcgcucgcug

SEQ ID NO: 11695 - RNA, 20 nt, Artificial Sequence
  Synthetic
ucccguuugcuuaagugcug

SEQ ID NO: 11696 - RNA, 20 nt, Artificial Sequence
  Synthetic
ggacaagccaauggccagug

SEQ ID NO: 11697 - RNA, 20 nt, Artificial Sequence
  Synthetic
agugcggggagggggaggug

SEQ ID NO: 11698 - RNA, 20 nt, Artificial Sequence
  Synthetic
aggggugggaggaaagggug

SEQ ID NO: 11699 - RNA, 20 nt, Artificial Sequence
  Synthetic
uuuuagaguccgcgugugug

SEQ ID NO: 11700 - RNA, 20 nt, Artificial Sequence
  Synthetic
ggcgcagggaagaugaauug

SEQ ID NO: 11701 - RNA, 20 nt, Artificial Sequence
  Synthetic
gcugggguuugccuugcuug

SEQ ID NO: 11702 - RNA, 20 nt, Artificial Sequence
  Synthetic
gacagagacacacaaaacau

SEQ ID NO: 11703 - RNA, 20 nt, Artificial Sequence
  Synthetic
ccccuccccgcacuggccau

SEQ ID NO: 11704 - RNA, 20 nt, Artificial Sequence
  Synthetic
acacggcaaugguuccagau

SEQ ID NO: 11705 - RNA, 20 nt, Artificial Sequence
  Synthetic
auaauuauuauuacuauuau

SEQ ID NO: 11706 - RNA, 20 nt, Artificial Sequence
  Synthetic
gccccagcgcccccuccccu

SEQ ID NO: 11707 - RNA, 20 nt, Artificial Sequence
  Synthetic
ggccgaggggagggggcgcu

SEQ ID NO: 11708 - RNA, 20 nt, Artificial Sequence
  Synthetic
uucccguuugcuuaagugcu

SEQ ID NO: 11709 - RNA, 20 nt, Artificial Sequence
  Synthetic
caggggugggaggaaagggu

SEQ ID NO: 11710 - RNA, 20 nt, Artificial Sequence
  Synthetic
aagaaagggguggcaggggu

SEQ ID NO: 11711 - RNA, 20 nt, Artificial Sequence
  Synthetic
gcgcagggaagaugaauugu

SEQ ID NO: 11712 - RNA, 20 nt, Artificial Sequence
  Synthetic
uaauuauuauuacuauuauu

SEQ ID NO: 11713 - RNA, 20 nt, Artificial Sequence
  Synthetic
guauuauuucuaauuuauuu

SEQ ID NO: 11714 - RNA, 17 nt, Artificial Sequence
  Synthetic
cacucaccguaagaaaa

SEQ ID NO: 11715 - RNA, 17 nt, Artificial Sequence
  Synthetic
ccucuggccggaacaaa

SEQ ID NO: 11716 - RNA, 17 nt, Artificial Sequence
  Synthetic
cgaggagccggcacaaa

SEQ ID NO: 11717 - RNA, 17 nt, Artificial Sequence
  Synthetic
uauuucucuuuucgaaa

SEQ ID NO: 11718 - RNA, 17 nt, Artificial Sequence
  Synthetic
gggagcugguggggaaa

SEQ ID NO: 11719 - RNA, 17 nt, Artificial Sequence
  Synthetic
aaguggcacuguggaaa

SEQ ID NO: 11720 - RNA, 17 nt, Artificial Sequence
  Synthetic
gggcugcggguccggaa

SEQ ID NO: 11721 - RNA, 17 nt, Artificial Sequence
  Synthetic
gaaauaaagcggcggaa

SEQ ID NO: 11722 - RNA, 17 nt, Artificial Sequence
  Synthetic
ugggagcugguggggaa

SEQ ID NO: 11723 - RNA, 17 nt, Artificial Sequence
  Synthetic
aaaguggcacuguggaa

SEQ ID NO: 11724 - RNA, 17 nt, Artificial Sequence
  Synthetic
gcccgagggcgccccca

SEQ ID NO: 11725 - RNA, 17 nt, Artificial Sequence
  Synthetic
cguccuucccgguccca

SEQ ID NO: 11726 - RNA, 17 nt, Artificial Sequence
  Synthetic
cccccaaggccgagcca

SEQ ID NO: 11727 - RNA, 17 nt, Artificial Sequence
  Synthetic
cccgcguguggacgcca

SEQ ID NO: 11728 - RNA, 17 nt, Artificial Sequence
  Synthetic
gugugugggggggagca

SEQ ID NO: 11729 - RNA, 17 nt, Artificial Sequence
  Synthetic
aggugggagggagcgca

SEQ ID NO: 11730 - RNA, 17 nt, Artificial Sequence
  Synthetic
ggacaccagcgcgcuca

SEQ ID NO: 11731 - RNA, 17 nt, Artificial Sequence
  Synthetic
cgcgcggccuggaaaga

SEQ ID NO: 11732 - RNA, 17 nt, Artificial Sequence
  Synthetic
uccgcggagucgggaga

SEQ ID NO: 11733 - RNA, 17 nt, Artificial Sequence
  Synthetic
cgcaggccggggcccga

SEQ ID NO: 11734 - RNA, 17 nt, Artificial Sequence
  Synthetic
gagaggggccgcggcga

SEQ ID NO: 11735 - RNA, 17 nt, Artificial Sequence
  Synthetic
agcuccgcagcgggcga

SEQ ID NO: 11736 - RNA, 17 nt, Artificial Sequence
  Synthetic
cgugggaccgggaagga

SEQ ID NO: 11737 - RNA, 17 nt, Artificial Sequence
  Synthetic
ggugugcguacggagga

SEQ ID NO: 11738 - RNA, 17 nt, Artificial Sequence
  Synthetic
agggcugcggguccgga

SEQ ID NO: 11739 - RNA, 17 nt, Artificial Sequence
  Synthetic
ggggaagcgcgggcgga

SEQ ID NO: 11740 - RNA, 17 nt, Artificial Sequence
  Synthetic
aaauggggggguaggga

SEQ ID NO: 11741 - RNA, 17 nt, Artificial Sequence
  Synthetic
gagccgugggaccggga

SEQ ID NO: 11742 - RNA, 17 nt, Artificial Sequence
  Synthetic
cgcggcggcggcgggga

SEQ ID NO: 11743 - RNA, 17 nt, Artificial Sequence
  Synthetic
ggcgaggggagguggga

SEQ ID NO: 11744 - RNA, 17 nt, Artificial Sequence
  Synthetic
uccagccuaaguuugga

SEQ ID NO: 11745 - RNA, 17 nt, Artificial Sequence
  Synthetic
aauaaugaacaaugcua

SEQ ID NO: 11746 - RNA, 17 nt, Artificial Sequence
  Synthetic
ggaagugggugugcgua

SEQ ID NO: 11747 - RNA, 17 nt, Artificial Sequence
  Synthetic
aagaaaaugggggggua

SEQ ID NO: 11748 - RNA, 17 nt, Artificial Sequence
  Synthetic
acccccccauuuucuua

SEQ ID NO: 11749 - RNA, 17 nt, Artificial Sequence
  Synthetic
ucauuauuuugcaaaac

SEQ ID NO: 11750 - RNA, 17 nt, Artificial Sequence
  Synthetic
auagagcgagagugcac

SEQ ID NO: 11751 - RNA, 17 nt, Artificial Sequence
  Synthetic
gagaaaagaggugagac

SEQ ID NO: 11752 - RNA, 17 nt, Artificial Sequence
  Synthetic
agaggggccgcggcgac

SEQ ID NO: 11753 - RNA, 17 nt, Artificial Sequence
  Synthetic
gugggaccgggaaggac

SEQ ID NO: 11754 - RNA, 17 nt, Artificial Sequence
  Synthetic
aaggccgagccagggac

SEQ ID NO: 11755 - RNA, 17 nt, Artificial Sequence
  Synthetic
gccuggaaagaggggac

SEQ ID NO: 11756 - RNA, 17 nt, Artificial Sequence
  Synthetic
ggggagagccgugggac

SEQ ID NO: 11757 - RNA, 17 nt, Artificial Sequence
  Synthetic
caacucacaugcaaacc

SEQ ID NO: 11758 - RNA, 17 nt, Artificial Sequence
  Synthetic
uagagcgagagugcacc

SEQ ID NO: 11759 - RNA, 17 nt, Artificial Sequence
  Synthetic
aggccgagccagggacc

SEQ ID NO: 11760 - RNA, 17 nt, Artificial Sequence
  Synthetic
ccuggaaagaggggacc

SEQ ID NO: 11761 - RNA, 17 nt, Artificial Sequence
  Synthetic
gggagagccgugggacc

SEQ ID NO: 11762 - RNA, 17 nt, Artificial Sequence
  Synthetic
ccgggagcaacucuacc

SEQ ID NO: 11763 - RNA, 17 nt, Artificial Sequence
  Synthetic
caccagcucccaccccc

SEQ ID NO: 11764 - RNA, 17 nt, Artificial Sequence
  Synthetic
cgggaggcugcagcccc

SEQ ID NO: 11765 - RNA, 17 nt, Artificial Sequence
  Synthetic
gcuuuuacuucggcccc

SEQ ID NO: 11766 - RNA, 17 nt, Artificial Sequence
  Synthetic
cuguggaaaggggcccc

SEQ ID NO: 11767 - RNA, 17 nt, Artificial Sequence
  Synthetic
ucaccucuuuucucccc

SEQ ID NO: 11768 - RNA, 17 nt, Artificial Sequence
  Synthetic
ccgcgcuuccccagccc

SEQ ID NO: 11769 - RNA, 17 nt, Artificial Sequence
  Synthetic
ccgggaggcugcagccc

SEQ ID NO: 11770 - RNA, 17 nt, Artificial Sequence
  Synthetic
ggggcgcccucgggccc

SEQ ID NO: 11771 - RNA, 17 nt, Artificial Sequence
  Synthetic
cgccgccugccucuccc

SEQ ID NO: 11772 - RNA, 17 nt, Artificial Sequence
  Synthetic
cucaccucuuuucuccc

SEQ ID NO: 11773 - RNA, 17 nt, Artificial Sequence
  Synthetic
ucuaaaaaacgauuccc

SEQ ID NO: 11774 - RNA, 17 nt, Artificial Sequence
  Synthetic
gcgggcggagggaagcc

SEQ ID NO: 11775 - RNA, 17 nt, Artificial Sequence
  Synthetic
cccgcgcuuccccagcc

SEQ ID NO: 11776 - RNA, 17 nt, Artificial Sequence
  Synthetic
gcccccaaggccgagcc

SEQ ID NO: 11777 - RNA, 17 nt, Artificial Sequence
  Synthetic
ccccgcguguggacgcc

SEQ ID NO: 11778 - RNA, 17 nt, Artificial Sequence
  Synthetic
gcggacucaggagcgcc

SEQ ID NO: 11779 - RNA, 17 nt, Artificial Sequence
  Synthetic
ggcaggcggcgcaggcc

SEQ ID NO: 11780 - RNA, 17 nt, Artificial Sequence
  Synthetic
caggagcccgcgcggcc

SEQ ID NO: 11781 - RNA, 17 nt, Artificial Sequence
  Synthetic
ccggggcugcagccucc

SEQ ID NO: 11782 - RNA, 17 nt, Artificial Sequence
  Synthetic
caggccgcgcgggcucc

SEQ ID NO: 11783 - RNA, 17 nt, Artificial Sequence
  Synthetic
ccagguagaguugcucc

SEQ ID NO: 11784 - RNA, 17 nt, Artificial Sequence
  Synthetic
gcagcgcccaagucucc

SEQ ID NO: 11785 - RNA, 17 nt, Artificial Sequence
  Synthetic
uacggaggagggugucc

SEQ ID NO: 11786 - RNA, 17 nt, Artificial Sequence
  Synthetic
gucuaaaaaacgauucc

SEQ ID NO: 11787 - RNA, 17 nt, Artificial Sequence
  Synthetic
gcgucucccguccuucc

SEQ ID NO: 11788 - RNA, 17 nt, Artificial Sequence
  Synthetic
cccgguccccucuuucc

SEQ ID NO: 11789 - RNA, 17 nt, Artificial Sequence
  Synthetic
aguuacagcuccgcagc

SEQ ID NO: 11790 - RNA, 17 nt, Artificial Sequence
  Synthetic
ccggcacaaaaggcagc

SEQ ID NO: 11791 - RNA, 17 nt, Artificial Sequence
  Synthetic
acggucaagugugcagc

SEQ ID NO: 11792 - RNA, 17 nt, Artificial Sequence
  Synthetic
gggcaagcgcgaggagc

SEQ ID NO: 11793 - RNA, 17 nt, Artificial Sequence
  Synthetic
cgugugugggggggagc

SEQ ID NO: 11794 - RNA, 17 nt, Artificial Sequence
  Synthetic
aaccugggggugggagc

SEQ ID NO: 11795 - RNA, 17 nt, Artificial Sequence
  Synthetic
cccuggcguccacacgc

SEQ ID NO: 11796 - RNA, 17 nt, Artificial Sequence
  Synthetic
uucccgagcgcagccgc

SEQ ID NO: 11797 - RNA, 17 nt, Artificial Sequence
  Synthetic
ccgggcuggggaagcgc

SEQ ID NO: 11798 - RNA, 17 nt, Artificial Sequence
  Synthetic
cgcggacucaggagcgc

SEQ ID NO: 11799 - RNA, 17 nt, Artificial Sequence
  Synthetic
cucuuuccaggccgcgc

SEQ ID NO: 11800 - RNA, 17 nt, Artificial Sequence
  Synthetic
cuugaccgugagcgcgc

SEQ ID NO: 11801 - RNA, 17 nt, Artificial Sequence
  Synthetic
ggagaggcaggcggcgc

SEQ ID NO: 11802 - RNA, 17 nt, Artificial Sequence
  Synthetic
aggcaggcggcgcaggc

SEQ ID NO: 11803 - RNA, 17 nt, Artificial Sequence
  Synthetic
ggggaccggggagaggc

SEQ ID NO: 11804 - RNA, 17 nt, Artificial Sequence
  Synthetic
gcccuccaaacuuaggc

SEQ ID NO: 11805 - RNA, 17 nt, Artificial Sequence
  Synthetic
aggacgggagacgcggc

SEQ ID NO: 11806 - RNA, 17 nt, Artificial Sequence
  Synthetic
gcgagcgcggcggcggc

SEQ ID NO: 11807 - RNA, 17 nt, Artificial Sequence
  Synthetic
aggcugcagccccgggc

SEQ ID NO: 11808 - RNA, 17 nt, Artificial Sequence
  Synthetic
ugcaaaacuggcggggc

SEQ ID NO: 11809 - RNA, 17 nt, Artificial Sequence
  Synthetic
uauuuugcaaaacuggc

SEQ ID NO: 11810 - RNA, 17 nt, Artificial Sequence
  Synthetic
aaacacccaccucuggc

SEQ ID NO: 11811 - RNA, 17 nt, Artificial Sequence
  Synthetic
uaaguuuggagggcugc

SEQ ID NO: 11812 - RNA, 17 nt, Artificial Sequence
  Synthetic
acaaaaggcggcagugc

SEQ ID NO: 11813 - RNA, 17 nt, Artificial Sequence
  Synthetic
cccgcugccuuuugugc

SEQ ID NO: 11814 - RNA, 17 nt, Artificial Sequence
  Synthetic
cccgacuccgcggacuc

SEQ ID NO: 11815 - RNA, 17 nt, Artificial Sequence
  Synthetic
ggacaaacacccaccuc

SEQ ID NO: 11816 - RNA, 17 nt, Artificial Sequence
  Synthetic
gccuugggggcgcccuc

SEQ ID NO: 11817 - RNA, 17 nt, Artificial Sequence
  Synthetic
uuugcuguccucuccuc

SEQ ID NO: 11818 - RNA, 17 nt, Artificial Sequence
  Synthetic
agcccgcggcugcgcuc

SEQ ID NO: 11819 - RNA, 17 nt, Artificial Sequence
  Synthetic
agcgcagccgcgggcuc

SEQ ID NO: 11820 - RNA, 17 nt, Artificial Sequence
  Synthetic
ccugaguccgcggaguc

SEQ ID NO: 11821 - RNA, 17 nt, Artificial Sequence
  Synthetic
uuggagggcugcggguc

SEQ ID NO: 11822 - RNA, 17 nt, Artificial Sequence
  Synthetic
guacggaggaggguguc

SEQ ID NO: 11823 - RNA, 17 nt, Artificial Sequence
  Synthetic
gcucagcucucaacuuc

SEQ ID NO: 11824 - RNA, 17 nt, Artificial Sequence
  Synthetic
cuugggcgcugcccuuc

SEQ ID NO: 11825 - RNA, 17 nt, Artificial Sequence
  Synthetic
acugccgccuuuuguuc

SEQ ID NO: 11826 - RNA, 17 nt, Artificial Sequence
  Synthetic
auucccggggagaaaag

SEQ ID NO: 11827 - RNA, 17 nt, Artificial Sequence
  Synthetic
ccacaauagugagaaag

SEQ ID NO: 11828 - RNA, 17 nt, Artificial Sequence
  Synthetic
ggcggaaaggaggaaag

SEQ ID NO: 11829 - RNA, 17 nt, Artificial Sequence
  Synthetic
ccgcgcggccuggaaag

SEQ ID NO: 11830 - RNA, 17 nt, Artificial Sequence
  Synthetic
aguggcacuguggaaag

SEQ ID NO: 11831 - RNA, 17 nt, Artificial Sequence
  Synthetic
cgaaaagagaaauaaag

SEQ ID NO: 11832 - RNA, 17 nt, Artificial Sequence
  Synthetic
gcggcggggaggggaag

SEQ ID NO: 11833 - RNA, 17 nt, Artificial Sequence
  Synthetic
ccgcguguggacgccag

SEQ ID NO: 11834 - RNA, 17 nt, Artificial Sequence
  Synthetic
ccuuuuguuccggccag

SEQ ID NO: 11835 - RNA, 17 nt, Artificial Sequence
  Synthetic
aaguuacagcuccgcag

SEQ ID NO: 11836 - RNA, 17 nt, Artificial Sequence
  Synthetic
gccggcacaaaaggcag

SEQ ID NO: 11837 - RNA, 17 nt, Artificial Sequence
  Synthetic
cacggucaagugugcag

SEQ ID NO: 11838 - RNA, 17 nt, Artificial Sequence
  Synthetic
gcgcggccuggaaagag

SEQ ID NO: 11839 - RNA, 17 nt, Artificial Sequence
  Synthetic
ccgcggagucgggagag

SEQ ID NO: 11840 - RNA, 17 nt, Artificial Sequence
  Synthetic
gcuccgcagcgggcgag

SEQ ID NO: 11841 - RNA, 17 nt, Artificial Sequence
  Synthetic
aaacuuugcccgaggag

SEQ ID NO: 11842 - RNA, 17 nt, Artificial Sequence
  Synthetic
guccgcggagucgggag

SEQ ID NO: 11843 - RNA, 17 nt, Artificial Sequence
  Synthetic
aagaggggaccggggag

SEQ ID NO: 11844 - RNA, 17 nt, Artificial Sequence
  Synthetic
gcggcggcggcggggag

SEQ ID NO: 11845 - RNA, 17 nt, Artificial Sequence
  Synthetic
gcggggcggggggggag

SEQ ID NO: 11846 - RNA, 17 nt, Artificial Sequence
  Synthetic
cauuuucuuacggugag

SEQ ID NO: 11847 - RNA, 17 nt, Artificial Sequence
  Synthetic
gggagcgcacggcaacg

SEQ ID NO: 11848 - RNA, 17 nt, Artificial Sequence
  Synthetic
gcucccccccacacacg

SEQ ID NO: 11849 - RNA, 17 nt, Artificial Sequence
  Synthetic
ccccuggcguccacacg

SEQ ID NO: 11850 - RNA, 17 nt, Artificial Sequence
  Synthetic
gggaaggacgggagacg

SEQ ID NO: 11851 - RNA, 17 nt, Artificial Sequence
  Synthetic
gaggggccgcggcgacg

SEQ ID NO: 11852 - RNA, 17 nt, Artificial Sequence
  Synthetic
cuggaaagaggggaccg

SEQ ID NO: 11853 - RNA, 17 nt, Artificial Sequence
  Synthetic
cgcgcuuccccagcccg

SEQ ID NO: 11854 - RNA, 17 nt, Artificial Sequence
  Synthetic
uaaaagccccgagcccg

SEQ ID NO: 11855 - RNA, 17 nt, Artificial Sequence
  Synthetic
gcgcaggccggggcccg

SEQ ID NO: 11856 - RNA, 17 nt, Artificial Sequence
  Synthetic
ucgggaaacuuugcccg

SEQ ID NO: 11857 - RNA, 17 nt, Artificial Sequence
  Synthetic
cuaaaaaacgauucccg

SEQ ID NO: 11858 - RNA, 17 nt, Artificial Sequence
  Synthetic
uuucccgagcgcagccg

SEQ ID NO: 11859 - RNA, 17 nt, Artificial Sequence
  Synthetic
ggcgacggggagagccg

SEQ ID NO: 11860 - RNA, 17 nt, Artificial Sequence
  Synthetic
cggacucaggagcgccg

SEQ ID NO: 11861 - RNA, 17 nt, Artificial Sequence
  Synthetic
ggcucuccccgucgccg

SEQ ID NO: 11862 - RNA, 17 nt, Artificial Sequence
  Synthetic
gcaggcggcgcaggccg

SEQ ID NO: 11863 - RNA, 17 nt, Artificial Sequence
  Synthetic
agucgggagaggggccg

SEQ ID NO: 11864 - RNA, 17 nt, Artificial Sequence
  Synthetic
ccccucucccgacuccg

SEQ ID NO: 11865 - RNA, 17 nt, Artificial Sequence
  Synthetic
cggcgcuccugaguccg

SEQ ID NO: 11866 - RNA, 17 nt, Artificial Sequence
  Synthetic
cccgggcuggggaagcg

SEQ ID NO: 11867 - RNA, 17 nt, Artificial Sequence
  Synthetic
cacgcggggagcgagcg

SEQ ID NO: 11868 - RNA, 17 nt, Artificial Sequence
  Synthetic
ccuggcguccacacgcg

SEQ ID NO: 11869 - RNA, 17 nt, Artificial Sequence
  Synthetic
gucuccaggagcccgcg

SEQ ID NO: 11870 - RNA, 17 nt, Artificial Sequence
  Synthetic
ccucuuuccaggccgcg

SEQ ID NO: 11871 - RNA, 17 nt, Artificial Sequence
  Synthetic
gcgggagggcaagcgcg

SEQ ID NO: 11872 - RNA, 17 nt, Artificial Sequence
  Synthetic
cgagcgcggcggcggcg

SEQ ID NO: 11873 - RNA, 17 nt, Artificial Sequence
  Synthetic
cagcuccgcagcgggcg

SEQ ID NO: 11874 - RNA, 17 nt, Artificial Sequence
  Synthetic
gcaaaacuggcggggcg

SEQ ID NO: 11875 - RNA, 17 nt, Artificial Sequence
  Synthetic
auuuugcaaaacuggcg

SEQ ID NO: 11876 - RNA, 17 nt, Artificial Sequence
  Synthetic
gcgcagccgcgggcucg

SEQ ID NO: 11877 - RNA, 17 nt, Artificial Sequence
  Synthetic
cuggccggaacaaaagg

SEQ ID NO: 11878 - RNA, 17 nt, Artificial Sequence
  Synthetic
auaaagcggcggaaagg

SEQ ID NO: 11879 - RNA, 17 nt, Artificial Sequence
  Synthetic
gaccggggagaggcagg

SEQ ID NO: 11880 - RNA, 17 nt, Artificial Sequence
  Synthetic
ggaaaggaggaaagagg

SEQ ID NO: 11881 - RNA, 17 nt, Artificial Sequence
  Synthetic
uuuguuccggccagagg

SEQ ID NO: 11882 - RNA, 17 nt, Artificial Sequence
  Synthetic
gggugugcguacggagg

SEQ ID NO: 11883 - RNA, 17 nt, Artificial Sequence
  Synthetic
cagcgggcgaggggagg

SEQ ID NO: 11884 - RNA, 17 nt, Artificial Sequence
  Synthetic
agugggugugcguacgg

SEQ ID NO: 11885 - RNA, 17 nt, Artificial Sequence
  Synthetic
ggacucaggagcgccgg

SEQ ID NO: 11886 - RNA, 17 nt, Artificial Sequence
  Synthetic
aaagagaaauaaagcgg

SEQ ID NO: 11887 - RNA, 17 nt, Artificial Sequence
  Synthetic
gcggggagcgagcgcgg

SEQ ID NO: 11888 - RNA, 17 nt, Artificial Sequence
  Synthetic
gggagcgagcgcggcgg

SEQ ID NO: 11889 - RNA, 17 nt, Artificial Sequence
  Synthetic
agcgagcgcggcggcgg

SEQ ID NO: 11890 - RNA, 17 nt, Artificial Sequence
  Synthetic
uggggaagcgcgggcgg

SEQ ID NO: 11891 - RNA, 17 nt, Artificial Sequence
  Synthetic
caaaacuggcggggcgg

SEQ ID NO: 11892 - RNA, 17 nt, Artificial Sequence
  Synthetic
agcugguggggaaaggg

SEQ ID NO: 11893 - RNA, 17 nt, Artificial Sequence
  Synthetic
aaaauggggggguaggg

SEQ ID NO: 11894 - RNA, 17 nt, Artificial Sequence
  Synthetic
agcgagagugcaccggg

SEQ ID NO: 11895 - RNA, 17 nt, Artificial Sequence
  Synthetic
gucaagugugcagcggg

SEQ ID NO: 11896 - RNA, 17 nt, Artificial Sequence
  Synthetic
ggcuggggaagcgcggg

SEQ ID NO: 11897 - RNA, 17 nt, Artificial Sequence
  Synthetic
aaaacuggcggggcggg

SEQ ID NO: 11898 - RNA, 17 nt, Artificial Sequence
  Synthetic
ccgcagcgggcgagggg

SEQ ID NO: 11899 - RNA, 17 nt, Artificial Sequence
  Synthetic
gcgcggcggcggcgggg

SEQ ID NO: 11900 - RNA, 17 nt, Artificial Sequence
  Synthetic
aaacuggcggggcgggg

SEQ ID NO: 11901 - RNA, 17 nt, Artificial Sequence
  Synthetic
uugcaaaacuggcgggg

SEQ ID NO: 11902 - RNA, 17 nt, Artificial Sequence
  Synthetic
aacuggcggggcggggg

SEQ ID NO: 11903 - RNA, 17 nt, Artificial Sequence
  Synthetic
acaugcaaaccuggggg

SEQ ID NO: 11904 - RNA, 17 nt, Artificial Sequence
  Synthetic
accguaagaaaaugggg

SEQ ID NO: 11905 - RNA, 17 nt, Artificial Sequence
  Synthetic
aguccgcgugugugggg

SEQ ID NO: 11906 - RNA, 17 nt, Artificial Sequence
  Synthetic
caccguaagaaaauggg

SEQ ID NO: 11907 - RNA, 17 nt, Artificial Sequence
  Synthetic
gggcgaggggagguggg

SEQ ID NO: 11908 - RNA, 17 nt, Artificial Sequence
  Synthetic
gaguccgcguguguggg

SEQ ID NO: 11909 - RNA, 17 nt, Artificial Sequence
  Synthetic
ucaccguaagaaaaugg

SEQ ID NO: 11910 - RNA, 17 nt, Artificial Sequence
  Synthetic
uuauuuugcaaaacugg

SEQ ID NO: 11911 - RNA, 17 nt, Artificial Sequence
  Synthetic
cucacaugcaaaccugg

SEQ ID NO: 11912 - RNA, 17 nt, Artificial Sequence
  Synthetic
cugggggugggagcugg

SEQ ID NO: 11913 - RNA, 17 nt, Artificial Sequence
  Synthetic
agaguccgcgugugugg

SEQ ID NO: 11914 - RNA, 17 nt, Artificial Sequence
  Synthetic
gcggagcuguaacuugg

SEQ ID NO: 11915 - RNA, 17 nt, Artificial Sequence
  Synthetic
cccuggcucggccuugg

SEQ ID NO: 11916 - RNA, 17 nt, Artificial Sequence
  Synthetic
auccagccuaaguuugg

SEQ ID NO: 11917 - RNA, 17 nt, Artificial Sequence
  Synthetic
cucaccguaagaaaaug

SEQ ID NO: 11918 - RNA, 17 nt, Artificial Sequence
  Synthetic
gugagaaaguggcacug

SEQ ID NO: 11919 - RNA, 17 nt, Artificial Sequence
  Synthetic
acucacaugcaaaccug

SEQ ID NO: 11920 - RNA, 17 nt, Artificial Sequence
  Synthetic
ccuccccucgcccgcug

SEQ ID NO: 11921 - RNA, 17 nt, Artificial Sequence
  Synthetic
cuaaguuuggagggcug

SEQ ID NO: 11922 - RNA, 17 nt, Artificial Sequence
  Synthetic
gcugcagccccgggcug

SEQ ID NO: 11923 - RNA, 17 nt, Artificial Sequence
  Synthetic
cgcucgcuccccgcgug

SEQ ID NO: 11924 - RNA, 17 nt, Artificial Sequence
  Synthetic
gggggugggagcuggug

SEQ ID NO: 11925 - RNA, 17 nt, Artificial Sequence
  Synthetic
uuuagaguccgcgugug

SEQ ID NO: 11926 - RNA, 17 nt, Artificial Sequence
  Synthetic
uagaguccgcgugugug

SEQ ID NO: 11927 - RNA, 17 nt, Artificial Sequence
  Synthetic
acuuucucacuauugug

SEQ ID NO: 11928 - RNA, 17 nt, Artificial Sequence
  Synthetic
ccacuuucucacuauug

SEQ ID NO: 11929 - RNA, 17 nt, Artificial Sequence
  Synthetic
ucccuggcucggccuug

SEQ ID NO: 11930 - RNA, 17 nt, Artificial Sequence
  Synthetic
acucaccguaagaaaau

SEQ ID NO: 11931 - RNA, 17 nt, Artificial Sequence
  Synthetic
gcugcggagcuguaacu

SEQ ID NO: 11932 - RNA, 17 nt, Artificial Sequence
  Synthetic
gcgggcuccuggagacu

SEQ ID NO: 11933 - RNA, 17 nt, Artificial Sequence
  Synthetic
aacucacaugcaaaccu

SEQ ID NO: 11934 - RNA, 17 nt, Artificial Sequence
  Synthetic
ggccuugggggcgcccu

SEQ ID NO: 11935 - RNA, 17 nt, Artificial Sequence
  Synthetic
ggucccuggcucggccu

SEQ ID NO: 11936 - RNA, 17 nt, Artificial Sequence
  Synthetic
cuuugcuguccucuccu

SEQ ID NO: 11937 - RNA, 17 nt, Artificial Sequence
  Synthetic
gagcccgcggcugcgcu

SEQ ID NO: 11938 - RNA, 17 nt, Artificial Sequence
  Synthetic
ggcugcagccccgggcu

SEQ ID NO: 11939 - RNA, 17 nt, Artificial Sequence
  Synthetic
gagcgcagccgcgggcu

SEQ ID NO: 11940 - RNA, 17 nt, Artificial Sequence
  Synthetic
cggcggggaggggaagu

SEQ ID NO: 11941 - RNA, 17 nt, Artificial Sequence
  Synthetic
uccugaguccgcggagu

SEQ ID NO: 11942 - RNA, 17 nt, Artificial Sequence
  Synthetic
auuuucuuacggugagu

SEQ ID NO: 11943 - RNA, 17 nt, Artificial Sequence
  Synthetic
gcgacggggagagccgu

SEQ ID NO: 11944 - RNA, 17 nt, Artificial Sequence
  Synthetic
uuguuccggccagaggu

SEQ ID NO: 11945 - RNA, 17 nt, Artificial Sequence
  Synthetic
agcgggcgaggggaggu

SEQ ID NO: 11946 - RNA, 17 nt, Artificial Sequence
  Synthetic
uaagaaaaugggggggu

SEQ ID NO: 11947 - RNA, 17 nt, Artificial Sequence
  Synthetic
caugcaaaccugggggu

SEQ ID NO: 11948 - RNA, 17 nt, Artificial Sequence
  Synthetic
ugggggugggagcuggu

SEQ ID NO: 11949 - RNA, 17 nt, Artificial Sequence
  Synthetic
uuagaguccgcgugugu

SEQ ID NO: 11950 - RNA, 17 nt, Artificial Sequence
  Synthetic
cacuuucucacuauugu

SEQ ID NO: 11951 - RNA, 17 nt, Artificial Sequence
  Synthetic
cgcagcccuccaaacuu

SEQ ID NO: 11952 - RNA, 17 nt, Artificial Sequence
  Synthetic
ggcucagcucucaacuu

SEQ ID NO: 11953 - RNA, 17 nt, Artificial Sequence
  Synthetic
cgggcuccuggagacuu

SEQ ID NO: 11954 - RNA, 17 nt, Artificial Sequence
  Synthetic
gcucggggcuuuuacuu

SEQ ID NO: 11955 - RNA, 17 nt, Artificial Sequence
  Synthetic
gucccuggcucggccuu

SEQ ID NO: 11956 - RNA, 17 nt, Artificial Sequence
  Synthetic
ggaauccagccuaaguu

SEQ ID NO: 11957 - RNA, 17 nt, Artificial Sequence
  Synthetic
gaggugagacuggcuuu

SEQ ID NO: 11958 - RNA, 20 nt, Artificial Sequence
  Synthetic
ucccacucaccguaagaaaa

SEQ ID NO: 11959 - RNA, 20 nt, Artificial Sequence
  Synthetic
ccaccucuggccggaacaaa

SEQ ID NO: 11960 - RNA, 20 nt, Artificial Sequence
  Synthetic
gcgcgaggagccggcacaaa

SEQ ID NO: 11961 - RNA, 20 nt, Artificial Sequence
  Synthetic
cuuuauuucucuuuucgaaa

SEQ ID NO: 11962 - RNA, 20 nt, Artificial Sequence
  Synthetic
ggugggagcugguggggaaa

SEQ ID NO: 11963 - RNA, 20 nt, Artificial Sequence
  Synthetic
agaaaguggcacuguggaaa

SEQ ID NO: 11964 - RNA, 20 nt, Artificial Sequence
  Synthetic
ggagggcugcggguccggaa

SEQ ID NO: 11965 - RNA, 20 nt, Artificial Sequence
  Synthetic
agagaaauaaagcggcggaa

SEQ ID NO: 11966 - RNA, 20 nt, Artificial Sequence
  Synthetic
gggugggagcugguggggaa

SEQ ID NO: 11967 - RNA, 20 nt, Artificial Sequence
  Synthetic
gagaaaguggcacuguggaa

SEQ ID NO: 11968 - RNA, 20 nt, Artificial Sequence
  Synthetic
ggggcccgagggcgccccca

SEQ ID NO: 11969 - RNA, 20 nt, Artificial Sequence
  Synthetic
ucccguccuucccgguccca

SEQ ID NO: 11970 - RNA, 20 nt, Artificial Sequence
  Synthetic
gcgcccccaaggccgagcca

SEQ ID NO: 11971 - RNA, 20 nt, Artificial Sequence
  Synthetic
cuccccgcguguggacgcca

SEQ ID NO: 11972 - RNA, 20 nt, Artificial Sequence
  Synthetic
cgcgugugugggggggagca

SEQ ID NO: 11973 - RNA, 20 nt, Artificial Sequence
  Synthetic
gggaggugggagggagcgca

SEQ ID NO: 11974 - RNA, 20 nt, Artificial Sequence
  Synthetic
uuuggacaccagcgcgcuca

SEQ ID NO: 11975 - RNA, 20 nt, Artificial Sequence
  Synthetic
gcccgcgcggccuggaaaga

SEQ ID NO: 11976 - RNA, 20 nt, Artificial Sequence
  Synthetic
gaguccgcggagucgggaga

SEQ ID NO: 11977 - RNA, 20 nt, Artificial Sequence
  Synthetic
cggcgcaggccggggcccga

SEQ ID NO: 11978 - RNA, 20 nt, Artificial Sequence
  Synthetic
cgggagaggggccgcggcga

SEQ ID NO: 11979 - RNA, 20 nt, Artificial Sequence
  Synthetic
uacagcuccgcagcgggcga

SEQ ID NO: 11980 - RNA, 20 nt, Artificial Sequence
  Synthetic
agccgugggaccgggaagga

SEQ ID NO: 11981 - RNA, 20 nt, Artificial Sequence
  Synthetic
gugggugugcguacggagga

SEQ ID NO: 11982 - RNA, 20 nt, Artificial Sequence
  Synthetic
uggagggcugcggguccgga

SEQ ID NO: 11983 - RNA, 20 nt, Artificial Sequence
  Synthetic
gcuggggaagcgcgggcgga

SEQ ID NO: 11984 - RNA, 20 nt, Artificial Sequence
  Synthetic
agaaaauggggggguaggga

SEQ ID NO: 11985 - RNA, 20 nt, Artificial Sequence
  Synthetic
ggagagccgugggaccggga

SEQ ID NO: 11986 - RNA, 20 nt, Artificial Sequence
  Synthetic
gagcgcggcggcggcgggga

SEQ ID NO: 11987 - RNA, 20 nt, Artificial Sequence
  Synthetic
gcgggcgaggggagguggga

SEQ ID NO: 11988 - RNA, 20 nt, Artificial Sequence
  Synthetic
gaauccagccuaaguuugga

SEQ ID NO: 11989 - RNA, 20 nt, Artificial Sequence
  Synthetic
caaaauaaugaacaaugcua

SEQ ID NO: 11990 - RNA, 20 nt, Artificial Sequence
  Synthetic
aggggaagugggugugcgua

SEQ ID NO: 11991 - RNA, 20 nt, Artificial Sequence
  Synthetic
cguaagaaaaugggggggua

SEQ ID NO: 11992 - RNA, 20 nt, Artificial Sequence
  Synthetic
ccuacccccccauuuucuua

SEQ ID NO: 11993 - RNA, 20 nt, Artificial Sequence
  Synthetic
uguucauuauuuugcaaaac

SEQ ID NO: 11994 - RNA, 20 nt, Artificial Sequence
  Synthetic
aaaauagagcgagagugcac

SEQ ID NO: 11995 - RNA, 20 nt, Artificial Sequence
  Synthetic
ggggagaaaagaggugagac

SEQ ID NO: 11996 - RNA, 20 nt, Artificial Sequence
  Synthetic
gggagaggggccgcggcgac

SEQ ID NO: 11997 - RNA, 20 nt, Artificial Sequence
  Synthetic
gccgugggaccgggaaggac

SEQ ID NO: 11998 - RNA, 20 nt, Artificial Sequence
  Synthetic
cccaaggccgagccagggac

SEQ ID NO: 11999 - RNA, 20 nt, Artificial Sequence
  Synthetic
gcggccuggaaagaggggac

SEQ ID NO: 12000 - RNA, 20 nt, Artificial Sequence
  Synthetic
gacggggagagccgugggac

SEQ ID NO: 12001 - RNA, 20 nt, Artificial Sequence
  Synthetic
gaacaacucacaugcaaacc

SEQ ID NO: 12002 - RNA, 20 nt, Artificial Sequence
  Synthetic
aaauagagcgagagugcacc

SEQ ID NO: 12003 - RNA, 20 nt, Artificial Sequence
  Synthetic
ccaaggccgagccagggacc

SEQ ID NO: 12004 - RNA, 20 nt, Artificial Sequence
  Synthetic
cggccuggaaagaggggacc

SEQ ID NO: 12005 - RNA, 20 nt, Artificial Sequence
  Synthetic
acggggagagccgugggacc

SEQ ID NO: 12006 - RNA, 20 nt, Artificial Sequence
  Synthetic
uguccgggagcaacucuacc

SEQ ID NO: 12007 - RNA, 20 nt, Artificial Sequence
  Synthetic
ccccaccagcucccaccccc

SEQ ID NO: 12008 - RNA, 20 nt, Artificial Sequence
  Synthetic
caccgggaggcugcagcccc

SEQ ID NO: 12009 - RNA, 20 nt, Artificial Sequence
  Synthetic
ggggcuuuuacuucggcccc

SEQ ID NO: 12010 - RNA, 20 nt, Artificial Sequence
  Synthetic
gcacuguggaaaggggcccc

SEQ ID NO: 12011 - RNA, 20 nt, Artificial Sequence
  Synthetic
gucucaccucuuuucucccc

SEQ ID NO: 12012 - RNA, 20 nt, Artificial Sequence
  Synthetic
cgcccgcgcuuccccagccc

SEQ ID NO: 12013 - RNA, 20 nt, Artificial Sequence
  Synthetic
gcaccgggaggcugcagccc

SEQ ID NO: 12014 - RNA, 20 nt, Artificial Sequence
  Synthetic
uugggggcgcccucgggccc

SEQ ID NO: 12015 - RNA, 20 nt, Artificial Sequence
  Synthetic
cugcgccgccugccucuccc

SEQ ID NO: 12016 - RNA, 20 nt, Artificial Sequence
  Synthetic
agucucaccucuuuucuccc

SEQ ID NO: 12017 - RNA, 20 nt, Artificial Sequence
  Synthetic
aagucuaaaaaacgauuccc

SEQ ID NO: 12018 - RNA, 20 nt, Artificial Sequence
  Synthetic
agcgcgggcggagggaagcc

SEQ ID NO: 12019 - RNA, 20 nt, Artificial Sequence
  Synthetic
ccgcccgcgcuuccccagcc

SEQ ID NO: 12020 - RNA, 20 nt, Artificial Sequence
  Synthetic
ggcgcccccaaggccgagcc

SEQ ID NO: 12021 - RNA, 20 nt, Artificial Sequence
  Synthetic
gcuccccgcguguggacgcc

SEQ ID NO: 12022 - RNA, 20 nt, Artificial Sequence
  Synthetic
uccgcggacucaggagcgcc

SEQ ID NO: 12023 - RNA, 20 nt, Artificial Sequence
  Synthetic
agaggcaggcggcgcaggcc

SEQ ID NO: 12024 - RNA, 20 nt, Artificial Sequence
  Synthetic
cuccaggagcccgcgcggcc

SEQ ID NO: 12025 - RNA, 20 nt, Artificial Sequence
  Synthetic
agcccggggcugcagccucc

SEQ ID NO: 12026 - RNA, 20 nt, Artificial Sequence
  Synthetic
uuccaggccgcgcgggcucc

SEQ ID NO: 12027 - RNA, 20 nt, Artificial Sequence
  Synthetic
aagccagguagaguugcucc

SEQ ID NO: 12028 - RNA, 20 nt, Artificial Sequence
  Synthetic
agggcagcgcccaagucucc

SEQ ID NO: 12029 - RNA, 20 nt, Artificial Sequence
  Synthetic
gcguacggaggagggugucc

SEQ ID NO: 12030 - RNA, 20 nt, Artificial Sequence
  Synthetic
caagucuaaaaaacgauucc

SEQ ID NO: 12031 - RNA, 20 nt, Artificial Sequence
  Synthetic
gccgcgucucccguccuucc

SEQ ID NO: 12032 - RNA, 20 nt, Artificial Sequence
  Synthetic
cuccccgguccccucuuucc

SEQ ID NO: 12033 - RNA, 20 nt, Artificial Sequence
  Synthetic
ccaaguuacagcuccgcagc

SEQ ID NO: 12034 - RNA, 20 nt, Artificial Sequence
  Synthetic
gagccggcacaaaaggcagc

SEQ ID NO: 12035 - RNA, 20 nt, Artificial Sequence
  Synthetic
cucacggucaagugugcagc

SEQ ID NO: 12036 - RNA, 20 nt, Artificial Sequence
  Synthetic
ggagggcaagcgcgaggagc

SEQ ID NO: 12037 - RNA, 20 nt, Artificial Sequence
  Synthetic
ccgcgugugugggggggagc

SEQ ID NO: 12038 - RNA, 20 nt, Artificial Sequence
  Synthetic
gcaaaccugggggugggagc

SEQ ID NO: 12039 - RNA, 20 nt, Artificial Sequence
  Synthetic
ggccccuggcguccacacgc

SEQ ID NO: 12040 - RNA, 20 nt, Artificial Sequence
  Synthetic
aguuucccgagcgcagccgc

SEQ ID NO: 12041 - RNA, 20 nt, Artificial Sequence
  Synthetic
gccccgggcuggggaagcgc

SEQ ID NO: 12042 - RNA, 20 nt, Artificial Sequence
  Synthetic
cuccgcggacucaggagcgc

SEQ ID NO: 12043 - RNA, 20 nt, Artificial Sequence
  Synthetic
ccccucuuuccaggccgcgc

SEQ ID NO: 12044 - RNA, 20 nt, Artificial Sequence
  Synthetic
acacuugaccgugagcgcgc

SEQ ID NO: 12045 - RNA, 20 nt, Artificial Sequence
  Synthetic
cggggagaggcaggcggcgc

SEQ ID NO: 12046 - RNA, 20 nt, Artificial Sequence
  Synthetic
gagaggcaggcggcgcaggc

SEQ ID NO: 12047 - RNA, 20 nt, Artificial Sequence
  Synthetic
agaggggaccggggagaggc

SEQ ID NO: 12048 - RNA, 20 nt, Artificial Sequence
  Synthetic
gcagcccuccaaacuuaggc

SEQ ID NO: 12049 - RNA, 20 nt, Artificial Sequence
  Synthetic
ggaaggacgggagacgcggc

SEQ ID NO: 12050 - RNA, 20 nt, Artificial Sequence
  Synthetic
ggagcgagcgcggcggcggc

SEQ ID NO: 12051 - RNA, 20 nt, Artificial Sequence
  Synthetic
gggaggcugcagccccgggc

SEQ ID NO: 12052 - RNA, 20 nt, Artificial Sequence
  Synthetic
uuuugcaaaacuggcggggc

SEQ ID NO: 12053 - RNA, 20 nt, Artificial Sequence
  Synthetic
cauuauuuugcaaaacuggc

SEQ ID NO: 12054 - RNA, 20 nt, Artificial Sequence
  Synthetic
gacaaacacccaccucuggc

SEQ ID NO: 12055 - RNA, 20 nt, Artificial Sequence
  Synthetic
gccuaaguuuggagggcugc

SEQ ID NO: 12056 - RNA, 20 nt, Artificial Sequence
  Synthetic
ggaacaaaaggcggcagugc

SEQ ID NO: 12057 - RNA, 20 nt, Artificial Sequence
  Synthetic
ugucccgcugccuuuugugc

SEQ ID NO: 12058 - RNA, 20 nt, Artificial Sequence
  Synthetic
ucucccgacuccgcggacuc

SEQ ID NO: 12059 - RNA, 20 nt, Artificial Sequence
  Synthetic
gcgggacaaacacccaccuc

SEQ ID NO: 12060 - RNA, 20 nt, Artificial Sequence
  Synthetic
ucggccuugggggcgcccuc

SEQ ID NO: 12061 - RNA, 20 nt, Artificial Sequence
  Synthetic
uucuuugcuguccucuccuc

SEQ ID NO: 12062 - RNA, 20 nt, Artificial Sequence
  Synthetic
ccgagcccgcggcugcgcuc

SEQ ID NO: 12063 - RNA, 20 nt, Artificial Sequence
  Synthetic
ccgagcgcagccgcgggcuc

SEQ ID NO: 12064 - RNA, 20 nt, Artificial Sequence
  Synthetic
gcuccugaguccgcggaguc

SEQ ID NO: 12065 - RNA, 20 nt, Artificial Sequence
  Synthetic
aguuuggagggcugcggguc

SEQ ID NO: 12066 - RNA, 20 nt, Artificial Sequence
  Synthetic
ugcguacggaggaggguguc

SEQ ID NO: 12067 - RNA, 20 nt, Artificial Sequence
  Synthetic
gaggcucagcucucaacuuc

SEQ ID NO: 12068 - RNA, 20 nt, Artificial Sequence
  Synthetic
agacuugggcgcugcccuuc

SEQ ID NO: 12069 - RNA, 20 nt, Artificial Sequence
  Synthetic
ggcacugccgccuuuuguuc

SEQ ID NO: 12070 - RNA, 20 nt, Artificial Sequence
  Synthetic
acgauucccggggagaaaag

SEQ ID NO: 12071 - RNA, 20 nt, Artificial Sequence
  Synthetic
uccccacaauagugagaaag

SEQ ID NO: 12072 - RNA, 20 nt, Artificial Sequence
  Synthetic
agcggcggaaaggaggaaag

SEQ ID NO: 12073 - RNA, 20 nt, Artificial Sequence
  Synthetic
agcccgcgcggccuggaaag

SEQ ID NO: 12074 - RNA, 20 nt, Artificial Sequence
  Synthetic
gaaaguggcacuguggaaag

SEQ ID NO: 12075 - RNA, 20 nt, Artificial Sequence
  Synthetic
uuucgaaaagagaaauaaag

SEQ ID NO: 12076 - RNA, 20 nt, Artificial Sequence
  Synthetic
gcggcggcggggaggggaag

SEQ ID NO: 12077 - RNA, 20 nt, Artificial Sequence
  Synthetic
uccccgcguguggacgccag

SEQ ID NO: 12078 - RNA, 20 nt, Artificial Sequence
  Synthetic
ccgccuuuuguuccggccag

SEQ ID NO: 12079 - RNA, 20 nt, Artificial Sequence
  Synthetic
uccaaguuacagcuccgcag

SEQ ID NO: 12080 - RNA, 20 nt, Artificial Sequence
  Synthetic
ggagccggcacaaaaggcag

SEQ ID NO: 12081 - RNA, 20 nt, Artificial Sequence
  Synthetic
gcucacggucaagugugcag

SEQ ID NO: 12082 - RNA, 20 nt, Artificial Sequence
  Synthetic
cccgcgcggccuggaaagag

SEQ ID NO: 12083 - RNA, 20 nt, Artificial Sequence
  Synthetic
aguccgcggagucgggagag

SEQ ID NO: 12084 - RNA, 20 nt, Artificial Sequence
  Synthetic
acagcuccgcagcgggcgag

SEQ ID NO: 12085 - RNA, 20 nt, Artificial Sequence
  Synthetic
gggaaacuuugcccgaggag

SEQ ID NO: 12086 - RNA, 20 nt, Artificial Sequence
  Synthetic
ugaguccgcggagucgggag

SEQ ID NO: 12087 - RNA, 20 nt, Artificial Sequence
  Synthetic
ggaaagaggggaccggggag

SEQ ID NO: 12088 - RNA, 20 nt, Artificial Sequence
  Synthetic
agcgcggcggcggcggggag

SEQ ID NO: 12089 - RNA, 20 nt, Artificial Sequence
  Synthetic
cuggcggggcggggggggag

SEQ ID NO: 12090 - RNA, 20 nt, Artificial Sequence
  Synthetic
ccccauuuucuuacggugag

SEQ ID NO: 12091 - RNA, 20 nt, Artificial Sequence
  Synthetic
ggagggagcgcacggcaacg

SEQ ID NO: 12092 - RNA, 20 nt, Artificial Sequence
  Synthetic
ccugcucccccccacacacg

SEQ ID NO: 12093 - RNA, 20 nt, Artificial Sequence
  Synthetic
cggccccuggcguccacacg

SEQ ID NO: 12094 - RNA, 20 nt, Artificial Sequence
  Synthetic
accgggaaggacgggagacg

SEQ ID NO: 12095 - RNA, 20 nt, Artificial Sequence
  Synthetic
ggagaggggccgcggcgacg

SEQ ID NO: 12096 - RNA, 20 nt, Artificial Sequence
  Synthetic
ggccuggaaagaggggaccg

SEQ ID NO: 12097 - RNA, 20 nt, Artificial Sequence
  Synthetic
gcccgcgcuuccccagcccg

SEQ ID NO: 12098 - RNA, 20 nt, Artificial Sequence
  Synthetic
aaguaaaagccccgagcccg

SEQ ID NO: 12099 - RNA, 20 nt, Artificial Sequence
  Synthetic
gcggcgcaggccggggcccg

SEQ ID NO: 12100 - RNA, 20 nt, Artificial Sequence
  Synthetic
cgcucgggaaacuuugcccg

SEQ ID NO: 12101 - RNA, 20 nt, Artificial Sequence
  Synthetic
agucuaaaaaacgauucccg

SEQ ID NO: 12102 - RNA, 20 nt, Artificial Sequence
  Synthetic
aaguuucccgagcgcagccg

SEQ ID NO: 12103 - RNA, 20 nt, Artificial Sequence
  Synthetic
cgcggcgacggggagagccg

SEQ ID NO: 12104 - RNA, 20 nt, Artificial Sequence
  Synthetic
ccgcggacucaggagcgccg

SEQ ID NO: 12105 - RNA, 20 nt, Artificial Sequence
  Synthetic
cacggcucuccccgucgccg

SEQ ID NO: 12106 - RNA, 20 nt, Artificial Sequence
  Synthetic
gaggcaggcggcgcaggccg

SEQ ID NO: 12107 - RNA, 20 nt, Artificial Sequence
  Synthetic
cggagucgggagaggggccg

SEQ ID NO: 12108 - RNA, 20 nt, Artificial Sequence
  Synthetic
cggccccucucccgacuccg

SEQ ID NO: 12109 - RNA, 20 nt, Artificial Sequence
  Synthetic
ccccggcgcuccugaguccg

SEQ ID NO: 12110 - RNA, 20 nt, Artificial Sequence
  Synthetic
agccccgggcuggggaagcg

SEQ ID NO: 12111 - RNA, 20 nt, Artificial Sequence
  Synthetic
ccacacgcggggagcgagcg

SEQ ID NO: 12112 - RNA, 20 nt, Artificial Sequence
  Synthetic
gccccuggcguccacacgcg

SEQ ID NO: 12113 - RNA, 20 nt, Artificial Sequence
  Synthetic
caagucuccaggagcccgcg

SEQ ID NO: 12114 - RNA, 20 nt, Artificial Sequence
  Synthetic
uccccucuuuccaggccgcg

SEQ ID NO: 12115 - RNA, 20 nt, Artificial Sequence
  Synthetic
ggcgcgggagggcaagcgcg

SEQ ID NO: 12116 - RNA, 20 nt, Artificial Sequence
  Synthetic
gagcgagcgcggcggcggcg

SEQ ID NO: 12117 - RNA, 20 nt, Artificial Sequence
  Synthetic
uuacagcuccgcagcgggcg

SEQ ID NO: 12118 - RNA, 20 nt, Artificial Sequence
  Synthetic
uuugcaaaacuggcggggcg

SEQ ID NO: 12119 - RNA, 20 nt, Artificial Sequence
  Synthetic
auuauuuugcaaaacuggcg

SEQ ID NO: 12120 - RNA, 20 nt, Artificial Sequence
  Synthetic
cgagcgcagccgcgggcucg

SEQ ID NO: 12121 - RNA, 20 nt, Artificial Sequence
  Synthetic
ccucuggccggaacaaaagg

SEQ ID NO: 12122 - RNA, 20 nt, Artificial Sequence
  Synthetic
gaaauaaagcggcggaaagg

SEQ ID NO: 12123 - RNA, 20 nt, Artificial Sequence
  Synthetic
ggggaccggggagaggcagg

SEQ ID NO: 12124 - RNA, 20 nt, Artificial Sequence
  Synthetic
ggcggaaaggaggaaagagg

SEQ ID NO: 12125 - RNA, 20 nt, Artificial Sequence
  Synthetic
ccuuuuguuccggccagagg

SEQ ID NO: 12126 - RNA, 20 nt, Artificial Sequence
  Synthetic
agugggugugcguacggagg

SEQ ID NO: 12127 - RNA, 20 nt, Artificial Sequence
  Synthetic
ccgcagcgggcgaggggagg

SEQ ID NO: 12128 - RNA, 20 nt, Artificial Sequence
  Synthetic
ggaagugggugugcguacgg

SEQ ID NO: 12129 - RNA, 20 nt, Artificial Sequence
  Synthetic
cgcggacucaggagcgccgg

SEQ ID NO: 12130 - RNA, 20 nt, Artificial Sequence
  Synthetic
cgaaaagagaaauaaagcgg

SEQ ID NO: 12131 - RNA, 20 nt, Artificial Sequence
  Synthetic
cacgcggggagcgagcgcgg

SEQ ID NO: 12132 - RNA, 20 nt, Artificial Sequence
  Synthetic
gcggggagcgagcgcggcgg

SEQ ID NO: 12133 - RNA, 20 nt, Artificial Sequence
  Synthetic
gggagcgagcgcggcggcgg

SEQ ID NO: 12134 - RNA, 20 nt, Artificial Sequence
  Synthetic
ggcuggggaagcgcgggcgg

SEQ ID NO: 12135 - RNA, 20 nt, Artificial Sequence
  Synthetic
uugcaaaacuggcggggcgg

SEQ ID NO: 12136 - RNA, 20 nt, Artificial Sequence
  Synthetic
gggagcugguggggaaaggg

SEQ ID NO: 12137 - RNA, 20 nt, Artificial Sequence
  Synthetic
aagaaaauggggggguaggg

SEQ ID NO: 12138 - RNA, 20 nt, Artificial Sequence
  Synthetic
uagagcgagagugcaccggg

SEQ ID NO: 12139 - RNA, 20 nt, Artificial Sequence
  Synthetic
acggucaagugugcagcggg

SEQ ID NO: 12140 - RNA, 20 nt, Artificial Sequence
  Synthetic
ccgggcuggggaagcgcggg

SEQ ID NO: 12141 - RNA, 20 nt, Artificial Sequence
  Synthetic
ugcaaaacuggcggggcggg

SEQ ID NO: 12142 - RNA, 20 nt, Artificial Sequence
  Synthetic
gcuccgcagcgggcgagggg

SEQ ID NO: 12143 - RNA, 20 nt, Artificial Sequence
  Synthetic
cgagcgcggcggcggcgggg

SEQ ID NO: 12144 - RNA, 20 nt, Artificial Sequence
  Synthetic
gcaaaacuggcggggcgggg

SEQ ID NO: 12145 - RNA, 20 nt, Artificial Sequence
  Synthetic
auuuugcaaaacuggcgggg

SEQ ID NO: 12146 - RNA, 20 nt, Artificial Sequence
  Synthetic
caaaacuggcggggcggggg

SEQ ID NO: 12147 - RNA, 20 nt, Artificial Sequence
  Synthetic
cucacaugcaaaccuggggg

SEQ ID NO: 12148 - RNA, 20 nt, Artificial Sequence
  Synthetic
cucaccguaagaaaaugggg

SEQ ID NO: 12149 - RNA, 20 nt, Artificial Sequence
  Synthetic
uagaguccgcgugugugggg

SEQ ID NO: 12150 - RNA, 20 nt, Artificial Sequence
  Synthetic
acucaccguaagaaaauggg

SEQ ID NO: 12151 - RNA, 20 nt, Artificial Sequence
  Synthetic
agcgggcgaggggagguggg

SEQ ID NO: 12152 - RNA, 20 nt, Artificial Sequence
  Synthetic
uuagaguccgcguguguggg

SEQ ID NO: 12153 - RNA, 20 nt, Artificial Sequence
  Synthetic
cacucaccguaagaaaaugg

SEQ ID NO: 12154 - RNA, 20 nt, Artificial Sequence
  Synthetic
ucauuauuuugcaaaacugg

SEQ ID NO: 12155 - RNA, 20 nt, Artificial Sequence
  Synthetic
caacucacaugcaaaccugg

SEQ ID NO: 12156 - RNA, 20 nt, Artificial Sequence
  Synthetic
aaccugggggugggagcugg

SEQ ID NO: 12157 - RNA, 20 nt, Artificial Sequence
  Synthetic
uuuagaguccgcgugugugg

SEQ ID NO: 12158 - RNA, 20 nt, Artificial Sequence
  Synthetic
gcugcggagcuguaacuugg

SEQ ID NO: 12159 - RNA, 20 nt, Artificial Sequence
  Synthetic
ggucccuggcucggccuugg

SEQ ID NO: 12160 - RNA, 20 nt, Artificial Sequence
  Synthetic
ggaauccagccuaaguuugg

SEQ ID NO: 12161 - RNA, 20 nt, Artificial Sequence
  Synthetic
ccacucaccguaagaaaaug

SEQ ID NO: 12162 - RNA, 20 nt, Artificial Sequence
  Synthetic
auagugagaaaguggcacug

SEQ ID NO: 12163 - RNA, 20 nt, Artificial Sequence
  Synthetic
acaacucacaugcaaaccug

SEQ ID NO: 12164 - RNA, 20 nt, Artificial Sequence
  Synthetic
ccaccuccccucgcccgcug

SEQ ID NO: 12165 - RNA, 20 nt, Artificial Sequence
  Synthetic
agccuaaguuuggagggcug

SEQ ID NO: 12166 - RNA, 20 nt, Artificial Sequence
  Synthetic
gaggcugcagccccgggcug

SEQ ID NO: 12167 - RNA, 20 nt, Artificial Sequence
  Synthetic
ccgcgcucgcuccccgcgug

SEQ ID NO: 12168 - RNA, 20 nt, Artificial Sequence
  Synthetic
ccugggggugggagcuggug

SEQ ID NO: 12169 - RNA, 20 nt, Artificial Sequence
  Synthetic
cauuuuagaguccgcgugug

SEQ ID NO: 12170 - RNA, 20 nt, Artificial Sequence
  Synthetic
uuuuagaguccgcgugugug

SEQ ID NO: 12171 - RNA, 20 nt, Artificial Sequence
  Synthetic
gccacuuucucacuauugug

SEQ ID NO: 12172 - RNA, 20 nt, Artificial Sequence
  Synthetic
gugccacuuucucacuauug

SEQ ID NO: 12173 - RNA, 20 nt, Artificial Sequence
  Synthetic
cggucccuggcucggccuug

SEQ ID NO: 12174 - RNA, 20 nt, Artificial Sequence
  Synthetic
cccacucaccguaagaaaau

SEQ ID NO: 12175 - RNA, 20 nt, Artificial Sequence
  Synthetic
cccgcugcggagcuguaacu

SEQ ID NO: 12176 - RNA, 20 nt, Artificial Sequence
  Synthetic
cgcgcgggcuccuggagacu

SEQ ID NO: 12177 - RNA, 20 nt, Artificial Sequence
  Synthetic
aacaacucacaugcaaaccu

SEQ ID NO: 12178 - RNA, 20 nt, Artificial Sequence
  Synthetic
cucggccuugggggcgcccu

SEQ ID NO: 12179 - RNA, 20 nt, Artificial Sequence
  Synthetic
cccggucccuggcucggccu

SEQ ID NO: 12180 - RNA, 20 nt, Artificial Sequence
  Synthetic
uuucuuugcuguccucuccu

SEQ ID NO: 12181 - RNA, 20 nt, Artificial Sequence
  Synthetic
cccgagcccgcggcugcgcu

SEQ ID NO: 12182 - RNA, 20 nt, Artificial Sequence
  Synthetic
ggaggcugcagccccgggcu

SEQ ID NO: 12183 - RNA, 20 nt, Artificial Sequence
  Synthetic
cccgagcgcagccgcgggcu

SEQ ID NO: 12184 - RNA, 20 nt, Artificial Sequence
  Synthetic
cggcggcggggaggggaagu

SEQ ID NO: 12185 - RNA, 20 nt, Artificial Sequence
  Synthetic
cgcuccugaguccgcggagu

SEQ ID NO: 12186 - RNA, 20 nt, Artificial Sequence
  Synthetic
cccauuuucuuacggugagu

SEQ ID NO: 12187 - RNA, 20 nt, Artificial Sequence
  Synthetic
gcggcgacggggagagccgu

SEQ ID NO: 12188 - RNA, 20 nt, Artificial Sequence
  Synthetic
cuuuuguuccggccagaggu

SEQ ID NO: 12189 - RNA, 20 nt, Artificial Sequence
  Synthetic
cgcagcgggcgaggggaggu

SEQ ID NO: 12190 - RNA, 20 nt, Artificial Sequence
  Synthetic
ccguaagaaaaugggggggu

SEQ ID NO: 12191 - RNA, 20 nt, Artificial Sequence
  Synthetic
ucacaugcaaaccugggggu

SEQ ID NO: 12192 - RNA, 20 nt, Artificial Sequence
  Synthetic
accugggggugggagcuggu

SEQ ID NO: 12193 - RNA, 20 nt, Artificial Sequence
  Synthetic
auuuuagaguccgcgugugu

SEQ ID NO: 12194 - RNA, 20 nt, Artificial Sequence
  Synthetic
ugccacuuucucacuauugu

SEQ ID NO: 12195 - RNA, 20 nt, Artificial Sequence
  Synthetic
acccgcagcccuccaaacuu

SEQ ID NO: 12196 - RNA, 20 nt, Artificial Sequence
  Synthetic
ggaggcucagcucucaacuu

SEQ ID NO: 12197 - RNA, 20 nt, Artificial Sequence
  Synthetic
gcgcgggcuccuggagacuu

SEQ ID NO: 12198 - RNA, 20 nt, Artificial Sequence
  Synthetic
cgggcucggggcuuuuacuu

SEQ ID NO: 12199 - RNA, 20 nt, Artificial Sequence
  Synthetic
ccggucccuggcucggccuu

SEQ ID NO: 12200 - RNA, 20 nt, Artificial Sequence
  Synthetic
cgcggaauccagccuaaguu

SEQ ID NO: 12201 - RNA, 20 nt, Artificial Sequence
  Synthetic
aaagaggugagacuggcuuu

SEQ ID NO: 12202 - RNA, 21 nt, Artificial Sequence
  Synthetic
ggcguggccgggagagaagaa

SEQ ID NO: 12203 - RNA, 22 nt, Artificial Sequence
  Synthetic
uggcguggccgggagagaagaa

SEQ ID NO: 12204 - RNA, 23 nt, Artificial Sequence
  Synthetic
guggcguggccgggagagaagaa

SEQ ID NO: 12205 - RNA, 24 nt, Artificial Sequence
  Synthetic
gguggcguggccgggagagaagaa

SEQ ID NO: 12206 - RNA, 18 nt, Artificial Sequence
  Synthetic
cacggcaaugguuccaga

SEQ ID NO: 12207 - RNA, 19 nt, Artificial Sequence
  Synthetic
acacggcaaugguuccaga

SEQ ID NO: 12208 - RNA, 20 nt, Artificial Sequence
  Synthetic
uacacggcaaugguuccaga

SEQ ID NO: 12209 - RNA, 21 nt, Artificial Sequence
  Synthetic
auacacggcaaugguuccaga

SEQ ID NO: 12210 - RNA, 22 nt, Artificial Sequence
  Synthetic
cauacacggcaaugguuccaga

SEQ ID NO: 12211 - RNA, 23 nt, Artificial Sequence
  Synthetic
gcauacacggcaaugguuccaga

SEQ ID NO: 12212 - RNA, 24 nt, Artificial Sequence
  Synthetic
ugcauacacggcaaugguuccaga

SEQ ID NO: 12213 - RNA, 18 nt, Artificial Sequence
  Synthetic
uuauuggguuacuuacgc

SEQ ID NO: 12214 - RNA, 19 nt, Artificial Sequence
  Synthetic
auuauuggguuacuuacgc

SEQ ID NO: 12215 - RNA, 20 nt, Artificial Sequence
  Synthetic
uauuauuggguuacuuacgc

SEQ ID NO: 12216 - RNA, 21 nt, Artificial Sequence
  Synthetic
cuauuauuggguuacuuacgc

SEQ ID NO: 12217 - RNA, 22 nt, Artificial Sequence
  Synthetic
acuauuauuggguuacuuacgc

SEQ ID NO: 12218 - RNA, 23 nt, Artificial Sequence
  Synthetic
uacuauuauuggguuacuuacgc

SEQ ID NO: 12219 - RNA, 24 nt, Artificial Sequence
  Synthetic
uuacuauuauuggguuacuuacgc

SEQ ID NO: 12220 - RNA, 21 nt, Artificial Sequence
  Synthetic
gggagagaagaaagggguggc

SEQ ID NO: 12221 - RNA, 22 nt, Artificial Sequence
  Synthetic
cgggagagaagaaagggguggc

SEQ ID NO: 12222 - RNA, 23 nt, Artificial Sequence
  Synthetic
ccgggagagaagaaagggguggc

SEQ ID NO: 12223 - RNA, 24 nt, Artificial Sequence
  Synthetic
gccgggagagaagaaagggguggc

SEQ ID NO: 12224 - RNA, 18 nt, Artificial Sequence
  Synthetic
ucccguuugcuuaagugc

SEQ ID NO: 12225 - RNA, 19 nt, Artificial Sequence
  Synthetic
uucccguuugcuuaagugc

SEQ ID NO: 12226 - RNA, 20 nt, Artificial Sequence
  Synthetic
auucccguuugcuuaagugc

SEQ ID NO: 12227 - RNA, 21 nt, Artificial Sequence
  Synthetic
aauucccguuugcuuaagugc

SEQ ID NO: 12228 - RNA, 22 nt, Artificial Sequence
  Synthetic
gaauucccguuugcuuaagugc

SEQ ID NO: 12229 - RNA, 23 nt, Artificial Sequence
  Synthetic
agaauucccguuugcuuaagugc

SEQ ID NO: 12230 - RNA, 24 nt, Artificial Sequence
  Synthetic
gagaauucccguuugcuuaagugc

SEQ ID NO: 12231 - RNA, 18 nt, Artificial Sequence
  Synthetic
ccugcgaacuugaacguc

SEQ ID NO: 12232 - RNA, 19 nt, Artificial Sequence
  Synthetic
cccugcgaacuugaacguc

SEQ ID NO: 12233 - RNA, 20 nt, Artificial Sequence
  Synthetic
ucccugcgaacuugaacguc

SEQ ID NO: 12234 - RNA, 21 nt, Artificial Sequence
  Synthetic
gucccugcgaacuugaacguc

SEQ ID NO: 12235 - RNA, 22 nt, Artificial Sequence
  Synthetic
cgucccugcgaacuugaacguc

SEQ ID NO: 12236 - RNA, 23 nt, Artificial Sequence
  Synthetic
acgucccugcgaacuugaacguc

SEQ ID NO: 12237 - RNA, 24 nt, Artificial Sequence
  Synthetic
gacgucccugcgaacuugaacguc

SEQ ID NO: 12238 - RNA, 21 nt, Artificial Sequence
  Synthetic
uacaaagauggcgcagggaag

SEQ ID NO: 12239 - RNA, 22 nt, Artificial Sequence
  Synthetic
auacaaagauggcgcagggaag

SEQ ID NO: 12240 - RNA, 23 nt, Artificial Sequence
  Synthetic
aauacaaagauggcgcagggaag

SEQ ID NO: 12241 - RNA, 24 nt, Artificial Sequence
  Synthetic
uaauacaaagauggcgcagggaag

SEQ ID NO: 12242 - RNA, 18 nt, Artificial Sequence
  Synthetic
cgguucacaucgggagag

SEQ ID NO: 12243 - RNA, 19 nt, Artificial Sequence
  Synthetic
ucgguucacaucgggagag

SEQ ID NO: 12244 - RNA, 20 nt, Artificial Sequence
  Synthetic
cucgguucacaucgggagag

SEQ ID NO: 12245 - RNA, 21 nt, Artificial Sequence
  Synthetic
gcucgguucacaucgggagag

SEQ ID NO: 12246 - RNA, 22 nt, Artificial Sequence
  Synthetic
ggcucgguucacaucgggagag

SEQ ID NO: 12247 - RNA, 23 nt, Artificial Sequence
  Synthetic
cggcucgguucacaucgggagag

SEQ ID NO: 12248 - RNA, 24 nt, Artificial Sequence
  Synthetic
acggcucgguucacaucgggagag

SEQ ID NO: 12249 - RNA, 18 nt, Artificial Sequence
  Synthetic
aaugguuccagaugggau

SEQ ID NO: 12250 - RNA, 19 nt, Artificial Sequence
  Synthetic
caaugguuccagaugggau

SEQ ID NO: 12251 - RNA, 20 nt, Artificial Sequence
  Synthetic
gcaaugguuccagaugggau

SEQ ID NO: 12252 - RNA, 21 nt, Artificial Sequence
  Synthetic
ggcaaugguuccagaugggau

SEQ ID NO: 12253 - RNA, 22 nt, Artificial Sequence
  Synthetic
cggcaaugguuccagaugggau

SEQ ID NO: 12254 - RNA, 23 nt, Artificial Sequence
  Synthetic
acggcaaugguuccagaugggau

SEQ ID NO: 12255 - RNA, 24 nt, Artificial Sequence
  Synthetic
cacggcaaugguuccagaugggau

SEQ ID NO: 12256 - RNA, 18 nt, Artificial Sequence
  Synthetic
aacuugaacgucaggagu

SEQ ID NO: 12257 - RNA, 19 nt, Artificial Sequence
  Synthetic
gaacuugaacgucaggagu

SEQ ID NO: 12258 - RNA, 20 nt, Artificial Sequence
  Synthetic
cgaacuugaacgucaggagu

SEQ ID NO: 12259 - RNA, 21 nt, Artificial Sequence
  Synthetic
gcgaacuugaacgucaggagu

SEQ ID NO: 12260 - RNA, 22 nt, Artificial Sequence
  Synthetic
ugcgaacuugaacgucaggagu

SEQ ID NO: 12261 - RNA, 23 nt, Artificial Sequence
  Synthetic
cugcgaacuugaacgucaggagu

SEQ ID NO: 12262 - RNA, 24 nt, Artificial Sequence
  Synthetic
ccugcgaacuugaacgucaggagu

SEQ ID NO: 12263 - RNA, 21 nt, Artificial Sequence
  Synthetic
aaccccagcacuuaagcaaac

SEQ ID NO: 12264 - RNA, 22 nt, Artificial Sequence
  Synthetic
aaaccccagcacuuaagcaaac

SEQ ID NO: 12265 - RNA, 23 nt, Artificial Sequence
  Synthetic
caaaccccagcacuuaagcaaac

SEQ ID NO: 12266 - RNA, 24 nt, Artificial Sequence
  Synthetic
gcaaaccccagcacuuaagcaaac

SEQ ID NO: 12267 - RNA, 21 nt, Artificial Sequence
  Synthetic
aagcaaaagcgagggggagag

SEQ ID NO: 12268 - RNA, 22 nt, Artificial Sequence
  Synthetic
gaagcaaaagcgagggggagag

SEQ ID NO: 12269 - RNA, 23 nt, Artificial Sequence
  Synthetic
agaagcaaaagcgagggggagag

SEQ ID NO: 12270 - RNA, 24 nt, Artificial Sequence
  Synthetic
uagaagcaaaagcgagggggagag

SEQ ID NO: 12271 - RNA, 18 nt, Artificial Sequence
  Synthetic
guggccgggagagaagaa

SEQ ID NO: 12272 - RNA, 19 nt, Artificial Sequence
  Synthetic
cguggccgggagagaagaa

SEQ ID NO: 12273 - RNA, 20 nt, Artificial Sequence
  Synthetic
gcguggccgggagagaagaa

SEQ ID NO: 12274 - RNA, 18 nt, Artificial Sequence
  Synthetic
guggcaggggugggagga

SEQ ID NO: 12275 - RNA, 19 nt, Artificial Sequence
  Synthetic
gguggcaggggugggagga

SEQ ID NO: 12276 - RNA, 20 nt, Artificial Sequence
  Synthetic
ggguggcaggggugggagga

SEQ ID NO: 12277 - RNA, 21 nt, Artificial Sequence
  Synthetic
gggguggcaggggugggagga

SEQ ID NO: 12278 - RNA, 22 nt, Artificial Sequence
  Synthetic
agggguggcaggggugggagga

SEQ ID NO: 12279 - RNA, 23 nt, Artificial Sequence
  Synthetic
aagggguggcaggggugggagga

SEQ ID NO: 12280 - RNA, 24 nt, Artificial Sequence
  Synthetic
aaagggguggcaggggugggagga

SEQ ID NO: 12281 - RNA, 18 nt, Artificial Sequence
  Synthetic
uaauuauuauuacuauua

SEQ ID NO: 12282 - RNA, 19 nt, Artificial Sequence
  Synthetic
auaauuauuauuacuauua

SEQ ID NO: 12283 - RNA, 20 nt, Artificial Sequence
  Synthetic
aauaauuauuauuacuauua

SEQ ID NO: 12284 - RNA, 21 nt, Artificial Sequence
  Synthetic
uaauaauuauuauuacuauua

SEQ ID NO: 12285 - RNA, 22 nt, Artificial Sequence
  Synthetic
uuaauaauuauuauuacuauua

SEQ ID NO: 12286 - RNA, 23 nt, Artificial Sequence
  Synthetic
auuaauaauuauuauuacuauua

SEQ ID NO: 12287 - RNA, 24 nt, Artificial Sequence
  Synthetic
uauuaauaauuauuauuacuauua

SEQ ID NO: 12288 - RNA, 18 nt, Artificial Sequence
  Synthetic
agagaagaaagggguggc

SEQ ID NO: 12289 - RNA, 19 nt, Artificial Sequence
  Synthetic
gagagaagaaagggguggc

SEQ ID NO: 12290 - RNA, 20 nt, Artificial Sequence
  Synthetic
ggagagaagaaagggguggc

SEQ ID NO: 12291 - RNA, 18 nt, Artificial Sequence
  Synthetic
aaagauggcgcagggaag

SEQ ID NO: 12292 - RNA, 19 nt, Artificial Sequence
  Synthetic
caaagauggcgcagggaag

SEQ ID NO: 12293 - RNA, 20 nt, Artificial Sequence
  Synthetic
acaaagauggcgcagggaag

SEQ ID NO: 12294 - RNA, 18 nt, Artificial Sequence
  Synthetic
cccagcacuuaagcaaac

SEQ ID NO: 12295 - RNA, 19 nt, Artificial Sequence
  Synthetic
ccccagcacuuaagcaaac

SEQ ID NO: 12296 - RNA, 20 nt, Artificial Sequence
  Synthetic
accccagcacuuaagcaaac

SEQ ID NO: 12297 - RNA, 18 nt, Artificial Sequence
  Synthetic
uucacgagaaaaaccucc

SEQ ID NO: 12298 - RNA, 19 nt, Artificial Sequence
  Synthetic
uuucacgagaaaaaccucc

SEQ ID NO: 12299 - RNA, 20 nt, Artificial Sequence
  Synthetic
uuuucacgagaaaaaccucc

SEQ ID NO: 12300 - RNA, 21 nt, Artificial Sequence
  Synthetic
uuuuucacgagaaaaaccucc

SEQ ID NO: 12301 - RNA, 22 nt, Artificial Sequence
  Synthetic
auuuuucacgagaaaaaccucc

SEQ ID NO: 12302 - RNA, 23 nt, Artificial Sequence
  Synthetic
aauuuuucacgagaaaaaccucc

SEQ ID NO: 12303 - RNA, 24 nt, Artificial Sequence
  Synthetic
aaauuuuucacgagaaaaaccucc

SEQ ID NO: 12304 - RNA, 18 nt, Artificial Sequence
  Synthetic
ugaugaagauauuuucuc

SEQ ID NO: 12305 - RNA, 19 nt, Artificial Sequence
  Synthetic
cugaugaagauauuuucuc

SEQ ID NO: 12306 - RNA, 20 nt, Artificial Sequence
  Synthetic
acugaugaagauauuuucuc

SEQ ID NO: 12307 - RNA, 21 nt, Artificial Sequence
  Synthetic
cacugaugaagauauuuucuc

SEQ ID NO: 12308 - RNA, 22 nt, Artificial Sequence
  Synthetic
gcacugaugaagauauuuucuc

SEQ ID NO: 12309 - RNA, 23 nt, Artificial Sequence
  Synthetic
ggcacugaugaagauauuuucuc

SEQ ID NO: 12310 - RNA, 24 nt, Artificial Sequence
  Synthetic
aggcacugaugaagauauuuucuc

SEQ ID NO: 12311 - RNA, 18 nt, Artificial Sequence
  Synthetic
caaaagcgagggggagag

SEQ ID NO: 12312 - RNA, 19 nt, Artificial Sequence
  Synthetic
gcaaaagcgagggggagag

SEQ ID NO: 12313 - RNA, 20 nt, Artificial Sequence
  Synthetic
agcaaaagcgagggggagag

SEQ ID NO: 12314 - RNA, 18 nt, Artificial Sequence
  Synthetic
uauuauuucuaauuuauu

SEQ ID NO: 12315 - RNA, 19 nt, Artificial Sequence
  Synthetic
guauuauuucuaauuuauu

SEQ ID NO: 12316 - RNA, 20 nt, Artificial Sequence
  Synthetic
uguauuauuucuaauuuauu

SEQ ID NO: 12317 - RNA, 21 nt, Artificial Sequence
  Synthetic
uuguauuauuucuaauuuauu

SEQ ID NO: 12318 - RNA, 22 nt, Artificial Sequence
  Synthetic
uuuguauuauuucuaauuuauu

SEQ ID NO: 12319 - RNA, 23 nt, Artificial Sequence
  Synthetic
cuuuguauuauuucuaauuuauu

SEQ ID NO: 12320 - RNA, 24 nt, Artificial Sequence
  Synthetic
ucuuuguauuauuucuaauuuauu

SEQ ID NO: 12321 - RNA, 18 nt, Artificial Sequence
  Synthetic
uugaauaaucuuucauuu

SEQ ID NO: 12322 - RNA, 19 nt, Artificial Sequence
  Synthetic
uuugaauaaucuuucauuu

SEQ ID NO: 12323 - RNA, 20 nt, Artificial Sequence
  Synthetic
uuuugaauaaucuuucauuu

SEQ ID NO: 12324 - RNA, 21 nt, Artificial Sequence
  Synthetic
uuuuugaauaaucuuucauuu

SEQ ID NO: 12325 - RNA, 22 nt, Artificial Sequence
  Synthetic
uuuuuugaauaaucuuucauuu

SEQ ID NO: 12326 - RNA, 23 nt, Artificial Sequence
  Synthetic
cuuuuuugaauaaucuuucauuu

SEQ ID NO: 12327 - RNA, 24 nt, Artificial Sequence
  Synthetic
ucuuuuuugaauaaucuuucauuu

SEQ ID NO: 12328 - RNA, 18 nt, Artificial Sequence
  Synthetic
aaaaaaaaaaaaaaaaaa

SEQ ID NO: 12329 - RNA, 19 nt, Artificial Sequence
  Synthetic
aaaaaaaaaaaaaaaaaaa

SEQ ID NO: 12330 - RNA, 20 nt, Artificial Sequence
  Synthetic
aaaaaaaaaaaaaaaaaaaa

SEQ ID NO: 12331 - RNA, 21 nt, Artificial Sequence
  Synthetic
aaaaaaaaaaaaaaaaaaaaa

SEQ ID NO: 12332 - RNA, 22 nt, Artificial Sequence
  Synthetic
aaaaaaaaaaaaaaaaaaaaaa

SEQ ID NO: 12333 - RNA, 23 nt, Artificial Sequence
  Synthetic
aaaaaaaaaaaaaaaaaaaaaaa

SEQ ID NO: 12334 - RNA, 24 nt, Artificial Sequence
  Synthetic
aaaaaaaaaaaaaaaaaaaaaaaa

SEQ ID NO: 12335 - RNA, 18 nt, Artificial Sequence
  Synthetic
caggggcuggacaugaaa

SEQ ID NO: 12336 - RNA, 19 nt, Artificial Sequence
  Synthetic
ucaggggcuggacaugaaa

SEQ ID NO: 12337 - RNA, 20 nt, Artificial Sequence
  Synthetic
aucaggggcuggacaugaaa

SEQ ID NO: 12338 - RNA, 21 nt, Artificial Sequence
  Synthetic
caucaggggcuggacaugaaa

SEQ ID NO: 12339 - RNA, 22 nt, Artificial Sequence
  Synthetic
acaucaggggcuggacaugaaa

SEQ ID NO: 12340 - RNA, 23 nt, Artificial Sequence
  Synthetic
cacaucaggggcuggacaugaaa

SEQ ID NO: 12341 - RNA, 24 nt, Artificial Sequence
  Synthetic
acacaucaggggcuggacaugaaa

SEQ ID NO: 12342 - RNA, 18 nt, Artificial Sequence
  Synthetic
acacacgcggacucuaaa

SEQ ID NO: 12343 - RNA, 19 nt, Artificial Sequence
  Synthetic
cacacacgcggacucuaaa

SEQ ID NO: 12344 - RNA, 20 nt, Artificial Sequence
  Synthetic
ccacacacgcggacucuaaa

SEQ ID NO: 12345 - RNA, 21 nt, Artificial Sequence
  Synthetic
cccacacacgcggacucuaaa

SEQ ID NO: 12346 - RNA, 22 nt, Artificial Sequence
  Synthetic
ccccacacacgcggacucuaaa

SEQ ID NO: 12347 - RNA, 23 nt, Artificial Sequence
  Synthetic
cccccacacacgcggacucuaaa

SEQ ID NO: 12348 - RNA, 24 nt, Artificial Sequence
  Synthetic
ccccccacacacgcggacucuaaa

SEQ ID NO: 12349 - RNA, 18 nt, Artificial Sequence
  Synthetic
agagggagagagagagaa

SEQ ID NO: 12350 - RNA, 19 nt, Artificial Sequence
  Synthetic
aagagggagagagagagaa

SEQ ID NO: 12351 - RNA, 20 nt, Artificial Sequence
  Synthetic
aaagagggagagagagagaa

SEQ ID NO: 12352 - RNA, 21 nt, Artificial Sequence
  Synthetic
aaaagagggagagagagagaa

SEQ ID NO: 12353 - RNA, 22 nt, Artificial Sequence
  Synthetic
aaaaagagggagagagagagaa

SEQ ID NO: 12354 - RNA, 23 nt, Artificial Sequence
  Synthetic
aaaaaagagggagagagagagaa

SEQ ID NO: 12355 - RNA, 24 nt, Artificial Sequence
  Synthetic
aaaaaaagagggagagagagagaa

SEQ ID NO: 12356 - RNA, 18 nt, Artificial Sequence
  Synthetic
agggcgagcaggagagaa

SEQ ID NO: 12357 - RNA, 19 nt, Artificial Sequence
  Synthetic
cagggcgagcaggagagaa

SEQ ID NO: 12358 - RNA, 20 nt, Artificial Sequence
  Synthetic
gcagggcgagcaggagagaa

SEQ ID NO: 12359 - RNA, 21 nt, Artificial Sequence
  Synthetic
ggcagggcgagcaggagagaa

SEQ ID NO: 12360 - RNA, 22 nt, Artificial Sequence
  Synthetic
gggcagggcgagcaggagagaa

SEQ ID NO: 12361 - RNA, 23 nt, Artificial Sequence
  Synthetic
ugggcagggcgagcaggagagaa

SEQ ID NO: 12362 - RNA, 24 nt, Artificial Sequence
  Synthetic
augggcagggcgagcaggagagaa

SEQ ID NO: 12363 - RNA, 18 nt, Artificial Sequence
  Synthetic
gagaaggggaggagggaa

SEQ ID NO: 12364 - RNA, 19 nt, Artificial Sequence
  Synthetic
agagaaggggaggagggaa

SEQ ID NO: 12365 - RNA, 20 nt, Artificial Sequence
  Synthetic
gagagaaggggaggagggaa

SEQ ID NO: 12366 - RNA, 21 nt, Artificial Sequence
  Synthetic
ggagagaaggggaggagggaa

SEQ ID NO: 12367 - RNA, 22 nt, Artificial Sequence
  Synthetic
aggagagaaggggaggagggaa

SEQ ID NO: 12368 - RNA, 23 nt, Artificial Sequence
  Synthetic
caggagagaaggggaggagggaa

SEQ ID NO: 12369 - RNA, 24 nt, Artificial Sequence
  Synthetic
gcaggagagaaggggaggagggaa

SEQ ID NO: 12370 - RNA, 18 nt, Artificial Sequence
  Synthetic
acgacggcucgguucaca

SEQ ID NO: 12371 - RNA, 19 nt, Artificial Sequence
  Synthetic
gacgacggcucgguucaca

SEQ ID NO: 12372 - RNA, 20 nt, Artificial Sequence
  Synthetic
ggacgacggcucgguucaca

SEQ ID NO: 12373 - RNA, 21 nt, Artificial Sequence
  Synthetic
cggacgacggcucgguucaca

SEQ ID NO: 12374 - RNA, 22 nt, Artificial Sequence
  Synthetic
gcggacgacggcucgguucaca

SEQ ID NO: 12375 - RNA, 23 nt, Artificial Sequence
  Synthetic
ggcggacgacggcucgguucaca

SEQ ID NO: 12376 - RNA, 24 nt, Artificial Sequence
  Synthetic
gggcggacgacggcucgguucaca

SEQ ID NO: 12377 - RNA, 18 nt, Artificial Sequence
  Synthetic
aaggggaagcucacacca

SEQ ID NO: 12378 - RNA, 19 nt, Artificial Sequence
  Synthetic
gaaggggaagcucacacca

SEQ ID NO: 12379 - RNA, 20 nt, Artificial Sequence
  Synthetic
ggaaggggaagcucacacca

SEQ ID NO: 12380 - RNA, 21 nt, Artificial Sequence
  Synthetic
gggaaggggaagcucacacca

SEQ ID NO: 12381 - RNA, 22 nt, Artificial Sequence
  Synthetic
agggaaggggaagcucacacca

SEQ ID NO: 12382 - RNA, 23 nt, Artificial Sequence
  Synthetic
gagggaaggggaagcucacacca

SEQ ID NO: 12383 - RNA, 24 nt, Artificial Sequence
  Synthetic
ggagggaaggggaagcucacacca

SEQ ID NO: 12384 - RNA, 18 nt, Artificial Sequence
  Synthetic
agaaagaaggagacucca

SEQ ID NO: 12385 - RNA, 19 nt, Artificial Sequence
  Synthetic
uagaaagaaggagacucca

SEQ ID NO: 12386 - RNA, 20 nt, Artificial Sequence
  Synthetic
uuagaaagaaggagacucca

SEQ ID NO: 12387 - RNA, 21 nt, Artificial Sequence
  Synthetic
guuagaaagaaggagacucca

SEQ ID NO: 12388 - RNA, 22 nt, Artificial Sequence
  Synthetic
gguuagaaagaaggagacucca

SEQ ID NO: 12389 - RNA, 23 nt, Artificial Sequence
  Synthetic
ggguuagaaagaaggagacucca

SEQ ID NO: 12390 - RNA, 24 nt, Artificial Sequence
  Synthetic
cggguuagaaagaaggagacucca

SEQ ID NO: 12391 - RNA, 18 nt, Artificial Sequence
  Synthetic
ggcucaccaguggccgca

SEQ ID NO: 12392 - RNA, 19 nt, Artificial Sequence
  Synthetic
gggcucaccaguggccgca

SEQ ID NO: 12393 - RNA, 20 nt, Artificial Sequence
  Synthetic
cgggcucaccaguggccgca

SEQ ID NO: 12394 - RNA, 21 nt, Artificial Sequence
  Synthetic
gcgggcucaccaguggccgca

SEQ ID NO: 12395 - RNA, 22 nt, Artificial Sequence
  Synthetic
cgcgggcucaccaguggccgca

SEQ ID NO: 12396 - RNA, 23 nt, Artificial Sequence
  Synthetic
ccgcgggcucaccaguggccgca

SEQ ID NO: 12397 - RNA, 24 nt, Artificial Sequence
  Synthetic
gccgcgggcucaccaguggccgca

SEQ ID NO: 12398 - RNA, 18 nt, Artificial Sequence
  Synthetic
uaauacaaagauggcgca

SEQ ID NO: 12399 - RNA, 19 nt, Artificial Sequence
  Synthetic
auaauacaaagauggcgca

SEQ ID NO: 12400 - RNA, 20 nt, Artificial Sequence
  Synthetic
aauaauacaaagauggcgca

SEQ ID NO: 12401 - RNA, 21 nt, Artificial Sequence
  Synthetic
aaauaauacaaagauggcgca

SEQ ID NO: 12402 - RNA, 22 nt, Artificial Sequence
  Synthetic
gaaauaauacaaagauggcgca

SEQ ID NO: 12403 - RNA, 23 nt, Artificial Sequence
  Synthetic
agaaauaauacaaagauggcgca

SEQ ID NO: 12404 - RNA, 24 nt, Artificial Sequence
  Synthetic
uagaaauaauacaaagauggcgca

SEQ ID NO: 12405 - RNA, 18 nt, Artificial Sequence
  Synthetic
aaaaaaaaaaaaaaaaga

SEQ ID NO: 12406 - RNA, 19 nt, Artificial Sequence
  Synthetic
aaaaaaaaaaaaaaaaaga

SEQ ID NO: 12407 - RNA, 20 nt, Artificial Sequence
  Synthetic
aaaaaaaaaaaaaaaaaaga

SEQ ID NO: 12408 - RNA, 21 nt, Artificial Sequence
  Synthetic
aaaaaaaaaaaaaaaaaaaga

SEQ ID NO: 12409 - RNA, 22 nt, Artificial Sequence
  Synthetic
aaaaaaaaaaaaaaaaaaaaga

SEQ ID NO: 12410 - RNA, 23 nt, Artificial Sequence
  Synthetic
aaaaaaaaaaaaaaaaaaaaaga

SEQ ID NO: 12411 - RNA, 24 nt, Artificial Sequence
  Synthetic
aaaaaaaaaaaaaaaaaaaaaaga

SEQ ID NO: 12412 - RNA, 18 nt, Artificial Sequence
  Synthetic
agagccggguuagaaaga

SEQ ID NO: 12413 - RNA, 19 nt, Artificial Sequence
  Synthetic
gagagccggguuagaaaga

SEQ ID NO: 12414 - RNA, 20 nt, Artificial Sequence
  Synthetic
ggagagccggguuagaaaga

SEQ ID NO: 12415 - RNA, 21 nt, Artificial Sequence
  Synthetic
gggagagccggguuagaaaga

SEQ ID NO: 12416 - RNA, 22 nt, Artificial Sequence
  Synthetic
cgggagagccggguuagaaaga

SEQ ID NO: 12417 - RNA, 23 nt, Artificial Sequence
  Synthetic
ucgggagagccggguuagaaaga

SEQ ID NO: 12418 - RNA, 24 nt, Artificial Sequence
  Synthetic
aucgggagagccggguuagaaaga

SEQ ID NO: 12419 - RNA, 18 nt, Artificial Sequence
  Synthetic
cguggccgggagagaaga

SEQ ID NO: 12420 - RNA, 19 nt, Artificial Sequence
  Synthetic
gcguggccgggagagaaga

SEQ ID NO: 12421 - RNA, 20 nt, Artificial Sequence
  Synthetic
ggcguggccgggagagaaga

SEQ ID NO: 12422 - RNA, 21 nt, Artificial Sequence
  Synthetic
uggcguggccgggagagaaga

SEQ ID NO: 12423 - RNA, 22 nt, Artificial Sequence
  Synthetic
guggcguggccgggagagaaga

SEQ ID NO: 12424 - RNA, 23 nt, Artificial Sequence
  Synthetic
gguggcguggccgggagagaaga

SEQ ID NO: 12425 - RNA, 24 nt, Artificial Sequence
  Synthetic
cgguggcguggccgggagagaaga

SEQ ID NO: 12426 - RNA, 18 nt, Artificial Sequence
  Synthetic
agagagagagaagagaga

SEQ ID NO: 12427 - RNA, 19 nt, Artificial Sequence
  Synthetic
gagagagagagaagagaga

SEQ ID NO: 12428 - RNA, 20 nt, Artificial Sequence
  Synthetic
ggagagagagagaagagaga

SEQ ID NO: 12429 - RNA, 21 nt, Artificial Sequence
  Synthetic
gggagagagagagaagagaga

SEQ ID NO: 12430 - RNA, 22 nt, Artificial Sequence
  Synthetic
agggagagagagagaagagaga

SEQ ID NO: 12431 - RNA, 23 nt, Artificial Sequence
  Synthetic
gagggagagagagagaagagaga

SEQ ID NO: 12432 - RNA, 24 nt, Artificial Sequence
  Synthetic
agagggagagagagagaagagaga

SEQ ID NO: 12433 - RNA, 18 nt, Artificial Sequence
  Synthetic
uagagggagagagagaga

SEQ ID NO: 12434 - RNA, 19 nt, Artificial Sequence
  Synthetic
auagagggagagagagaga

SEQ ID NO: 12435 - RNA, 20 nt, Artificial Sequence
  Synthetic
gauagagggagagagagaga

SEQ ID NO: 12436 - RNA, 21 nt, Artificial Sequence
  Synthetic
agauagagggagagagagaga

SEQ ID NO: 12437 - RNA, 22 nt, Artificial Sequence
  Synthetic
gagauagagggagagagagaga

SEQ ID NO: 12438 - RNA, 23 nt, Artificial Sequence
  Synthetic
agagauagagggagagagagaga

SEQ ID NO: 12439 - RNA, 24 nt, Artificial Sequence
  Synthetic
gagagauagagggagagagagaga

SEQ ID NO: 12440 - RNA, 18 nt, Artificial Sequence
  Synthetic
gauagagggagagagaga

SEQ ID NO: 12441 - RNA, 19 nt, Artificial Sequence
  Synthetic
agauagagggagagagaga

SEQ ID NO: 12442 - RNA, 20 nt, Artificial Sequence
  Synthetic
gagauagagggagagagaga

SEQ ID NO: 12443 - RNA, 21 nt, Artificial Sequence
  Synthetic
agagauagagggagagagaga

SEQ ID NO: 12444 - RNA, 22 nt, Artificial Sequence
  Synthetic
gagagauagagggagagagaga

SEQ ID NO: 12445 - RNA, 23 nt, Artificial Sequence
  Synthetic
agagagauagagggagagagaga

SEQ ID NO: 12446 - RNA, 24 nt, Artificial Sequence
  Synthetic
aagagagauagagggagagagaga

SEQ ID NO: 12447 - RNA, 18 nt, Artificial Sequence
  Synthetic
aaaaaagagggagagaga

SEQ ID NO: 12448 - RNA, 19 nt, Artificial Sequence
  Synthetic
aaaaaaagagggagagaga

SEQ ID NO: 12449 - RNA, 20 nt, Artificial Sequence
  Synthetic
aaaaaaaagagggagagaga

SEQ ID NO: 12450 - RNA, 21 nt, Artificial Sequence
  Synthetic
aaaaaaaaagagggagagaga

SEQ ID NO: 12451 - RNA, 22 nt, Artificial Sequence
  Synthetic
aaaaaaaaaagagggagagaga

SEQ ID NO: 12452 - RNA, 23 nt, Artificial Sequence
  Synthetic
aaaaaaaaaaagagggagagaga

SEQ ID NO: 12453 - RNA, 24 nt, Artificial Sequence
  Synthetic
aaaaaaaaaaaagagggagagaga

SEQ ID NO: 12454 - RNA, 18 nt, Artificial Sequence
  Synthetic
gagauagagggagagaga

SEQ ID NO: 12455 - RNA, 19 nt, Artificial Sequence
  Synthetic
agagauagagggagagaga

SEQ ID NO: 12456 - RNA, 20 nt, Artificial Sequence
  Synthetic
gagagauagagggagagaga

SEQ ID NO: 12457 - RNA, 21 nt, Artificial Sequence
  Synthetic
agagagauagagggagagaga

SEQ ID NO: 12458 - RNA, 22 nt, Artificial Sequence
  Synthetic
aagagagauagagggagagaga

SEQ ID NO: 12459 - RNA, 23 nt, Artificial Sequence
  Synthetic
gaagagagauagagggagagaga

SEQ ID NO: 12460 - RNA, 24 nt, Artificial Sequence
  Synthetic
agaagagagauagagggagagaga

SEQ ID NO: 12461 - RNA, 18 nt, Artificial Sequence
  Synthetic
cagggcgagcaggagaga

SEQ ID NO: 12462 - RNA, 19 nt, Artificial Sequence
  Synthetic
gcagggcgagcaggagaga

SEQ ID NO: 12463 - RNA, 20 nt, Artificial Sequence
  Synthetic
ggcagggcgagcaggagaga

SEQ ID NO: 12464 - RNA, 21 nt, Artificial Sequence
  Synthetic
gggcagggcgagcaggagaga

SEQ ID NO: 12465 - RNA, 22 nt, Artificial Sequence
  Synthetic
ugggcagggcgagcaggagaga

SEQ ID NO: 12466 - RNA, 23 nt, Artificial Sequence
  Synthetic
augggcagggcgagcaggagaga

SEQ ID NO: 12467 - RNA, 24 nt, Artificial Sequence
  Synthetic
caugggcagggcgagcaggagaga

SEQ ID NO: 12468 - RNA, 18 nt, Artificial Sequence
  Synthetic
aaaaaaaagagggagaga

SEQ ID NO: 12469 - RNA, 19 nt, Artificial Sequence
  Synthetic
aaaaaaaaagagggagaga

SEQ ID NO: 12470 - RNA, 20 nt, Artificial Sequence
  Synthetic
aaaaaaaaaagagggagaga

SEQ ID NO: 12471 - RNA, 21 nt, Artificial Sequence
  Synthetic
aaaaaaaaaaagagggagaga

SEQ ID NO: 12472 - RNA, 22 nt, Artificial Sequence
  Synthetic
aaaaaaaaaaaagagggagaga

SEQ ID NO: 12473 - RNA, 23 nt, Artificial Sequence
  Synthetic
aaaaaaaaaaaaagagggagaga

SEQ ID NO: 12474 - RNA, 24 nt, Artificial Sequence
  Synthetic
aaaaaaaaaaaaaagagggagaga

SEQ ID NO: 12475 - RNA, 18 nt, Artificial Sequence
  Synthetic
gagagauagagggagaga

SEQ ID NO: 12476 - RNA, 19 nt, Artificial Sequence
  Synthetic
agagagauagagggagaga

SEQ ID NO: 12477 - RNA, 20 nt, Artificial Sequence
  Synthetic
aagagagauagagggagaga

SEQ ID NO: 12478 - RNA, 21 nt, Artificial Sequence
  Synthetic
gaagagagauagagggagaga

SEQ ID NO: 12479 - RNA, 22 nt, Artificial Sequence
  Synthetic
agaagagagauagagggagaga

SEQ ID NO: 12480 - RNA, 23 nt, Artificial Sequence
  Synthetic
gagaagagagauagagggagaga

SEQ ID NO: 12481 - RNA, 24 nt, Artificial Sequence
  Synthetic
agagaagagagauagagggagaga

SEQ ID NO: 12482 - RNA, 18 nt, Artificial Sequence
  Synthetic
aaaaaaaaaagagggaga

SEQ ID NO: 12483 - RNA, 19 nt, Artificial Sequence
  Synthetic
aaaaaaaaaaagagggaga

SEQ ID NO: 12484 - RNA, 20 nt, Artificial Sequence
  Synthetic
aaaaaaaaaaaagagggaga

SEQ ID NO: 12485 - RNA, 21 nt, Artificial Sequence
  Synthetic
aaaaaaaaaaaaagagggaga

SEQ ID NO: 12486 - RNA, 22 nt, Artificial Sequence
  Synthetic
aaaaaaaaaaaaaagagggaga

SEQ ID NO: 12487 - RNA, 23 nt, Artificial Sequence
  Synthetic
aaaaaaaaaaaaaaagagggaga

SEQ ID NO: 12488 - RNA, 24 nt, Artificial Sequence
  Synthetic
aaaaaaaaaaaaaaaagagggaga

SEQ ID NO: 12489 - RNA, 18 nt, Artificial Sequence
  Synthetic
aagagagauagagggaga

SEQ ID NO: 12490 - RNA, 19 nt, Artificial Sequence
  Synthetic
gaagagagauagagggaga

SEQ ID NO: 12491 - RNA, 20 nt, Artificial Sequence
  Synthetic
agaagagagauagagggaga

SEQ ID NO: 12492 - RNA, 21 nt, Artificial Sequence
  Synthetic
gagaagagagauagagggaga

SEQ ID NO: 12493 - RNA, 22 nt, Artificial Sequence
  Synthetic
agagaagagagauagagggaga

SEQ ID NO: 12494 - RNA, 23 nt, Artificial Sequence
  Synthetic
gagagaagagagauagagggaga

SEQ ID NO: 12495 - RNA, 24 nt, Artificial Sequence
  Synthetic
agagagaagagagauagagggaga

SEQ ID NO: 12496 - RNA, 18 nt, Artificial Sequence
  Synthetic
agagagaagagagauaga

SEQ ID NO: 12497 - RNA, 19 nt, Artificial Sequence
  Synthetic
gagagagaagagagauaga

SEQ ID NO: 12498 - RNA, 20 nt, Artificial Sequence
  Synthetic
agagagagaagagagauaga

SEQ ID NO: 12499 - RNA, 21 nt, Artificial Sequence
  Synthetic
gagagagagaagagagauaga

SEQ ID NO: 12500 - RNA, 22 nt, Artificial Sequence
  Synthetic
agagagagagaagagagauaga

SEQ ID NO: 12501 - RNA, 23 nt, Artificial Sequence
  Synthetic
gagagagagagaagagagauaga

SEQ ID NO: 12502 - RNA, 24 nt, Artificial Sequence
  Synthetic
ggagagagagagaagagagauaga

SEQ ID NO: 12503 - RNA, 18 nt, Artificial Sequence
  Synthetic
cgggagagccggguuaga

SEQ ID NO: 12504 - RNA, 19 nt, Artificial Sequence
  Synthetic
ucgggagagccggguuaga

SEQ ID NO: 12505 - RNA, 20 nt, Artificial Sequence
  Synthetic
aucgggagagccggguuaga

SEQ ID NO: 12506 - RNA, 21 nt, Artificial Sequence
  Synthetic
caucgggagagccggguuaga

SEQ ID NO: 12507 - RNA, 22 nt, Artificial Sequence
  Synthetic
acaucgggagagccggguuaga

SEQ ID NO: 12508 - RNA, 23 nt, Artificial Sequence
  Synthetic
cacaucgggagagccggguuaga

SEQ ID NO: 12509 - RNA, 24 nt, Artificial Sequence
  Synthetic
ucacaucgggagagccggguuaga

SEQ ID NO: 12510 - RNA, 18 nt, Artificial Sequence
  Synthetic
gggggaggggcgggccga

SEQ ID NO: 12511 - RNA, 19 nt, Artificial Sequence
  Synthetic
cgggggaggggcgggccga

SEQ ID NO: 12512 - RNA, 20 nt, Artificial Sequence
  Synthetic
ccgggggaggggcgggccga

SEQ ID NO: 12513 - RNA, 21 nt, Artificial Sequence
  Synthetic
cccgggggaggggcgggccga

SEQ ID NO: 12514 - RNA, 22 nt, Artificial Sequence
  Synthetic
ccccgggggaggggcgggccga

SEQ ID NO: 12515 - RNA, 23 nt, Artificial Sequence
  Synthetic
cccccgggggaggggcgggccga

SEQ ID NO: 12516 - RNA, 24 nt, Artificial Sequence
  Synthetic
gcccccgggggaggggcgggccga

SEQ ID NO: 12517 - RNA, 18 nt, Artificial Sequence
  Synthetic
ugggcagggcgagcagga

SEQ ID NO: 12518 - RNA, 19 nt, Artificial Sequence
  Synthetic
augggcagggcgagcagga

SEQ ID NO: 12519 - RNA, 20 nt, Artificial Sequence
  Synthetic
caugggcagggcgagcagga

SEQ ID NO: 12520 - RNA, 21 nt, Artificial Sequence
  Synthetic
acaugggcagggcgagcagga

SEQ ID NO: 12521 - RNA, 22 nt, Artificial Sequence
  Synthetic
aacaugggcagggcgagcagga

SEQ ID NO: 12522 - RNA, 23 nt, Artificial Sequence
  Synthetic
aaacaugggcagggcgagcagga

SEQ ID NO: 12523 - RNA, 24 nt, Artificial Sequence
  Synthetic
aaaacaugggcagggcgagcagga

SEQ ID NO: 12524 - RNA, 18 nt, Artificial Sequence
  Synthetic
caggagagaaggggagga

SEQ ID NO: 12525 - RNA, 19 nt, Artificial Sequence
  Synthetic
gcaggagagaaggggagga

SEQ ID NO: 12526 - RNA, 20 nt, Artificial Sequence
  Synthetic
agcaggagagaaggggagga

SEQ ID NO: 12527 - RNA, 21 nt, Artificial Sequence
  Synthetic
gagcaggagagaaggggagga

SEQ ID NO: 12528 - RNA, 22 nt, Artificial Sequence
  Synthetic
cgagcaggagagaaggggagga

SEQ ID NO: 12529 - RNA, 23 nt, Artificial Sequence
  Synthetic
gcgagcaggagagaaggggagga

SEQ ID NO: 12530 - RNA, 24 nt, Artificial Sequence
  Synthetic
ggcgagcaggagagaaggggagga

SEQ ID NO: 12531 - RNA, 18 nt, Artificial Sequence
  Synthetic
aaaaaaaaaaaagaggga

SEQ ID NO: 12532 - RNA, 19 nt, Artificial Sequence
  Synthetic
aaaaaaaaaaaaagaggga

SEQ ID NO: 12533 - RNA, 20 nt, Artificial Sequence
  Synthetic
aaaaaaaaaaaaaagaggga

SEQ ID NO: 12534 - RNA, 21 nt, Artificial Sequence
  Synthetic
aaaaaaaaaaaaaaagaggga

SEQ ID NO: 12535 - RNA, 22 nt, Artificial Sequence
  Synthetic
aaaaaaaaaaaaaaaagaggga

SEQ ID NO: 12536 - RNA, 23 nt, Artificial Sequence
  Synthetic
aaaaaaaaaaaaaaaaagaggga

SEQ ID NO: 12537 - RNA, 24 nt, Artificial Sequence
  Synthetic
aaaaaaaaaaaaaaaaaagaggga

SEQ ID NO: 12538 - RNA, 18 nt, Artificial Sequence
  Synthetic
agaagagagauagaggga

SEQ ID NO: 12539 - RNA, 19 nt, Artificial Sequence
  Synthetic
gagaagagagauagaggga

SEQ ID NO: 12540 - RNA, 20 nt, Artificial Sequence
  Synthetic
agagaagagagauagaggga

SEQ ID NO: 12541 - RNA, 21 nt, Artificial Sequence
  Synthetic
gagagaagagagauagaggga

SEQ ID NO: 12542 - RNA, 22 nt, Artificial Sequence
  Synthetic
agagagaagagagauagaggga

SEQ ID NO: 12543 - RNA, 23 nt, Artificial Sequence
  Synthetic
gagagagaagagagauagaggga

SEQ ID NO: 12544 - RNA, 24 nt, Artificial Sequence
  Synthetic
agagagagaagagagauagaggga

SEQ ID NO: 12545 - RNA, 18 nt, Artificial Sequence
  Synthetic
agagaaggggaggaggga

SEQ ID NO: 12546 - RNA, 19 nt, Artificial Sequence
  Synthetic
gagagaaggggaggaggga

SEQ ID NO: 12547 - RNA, 20 nt, Artificial Sequence
  Synthetic
ggagagaaggggaggaggga

SEQ ID NO: 12548 - RNA, 21 nt, Artificial Sequence
  Synthetic
aggagagaaggggaggaggga

SEQ ID NO: 12549 - RNA, 22 nt, Artificial Sequence
  Synthetic
caggagagaaggggaggaggga

SEQ ID NO: 12550 - RNA, 23 nt, Artificial Sequence
  Synthetic
gcaggagagaaggggaggaggga

SEQ ID NO: 12551 - RNA, 24 nt, Artificial Sequence
  Synthetic
agcaggagagaaggggaggaggga

SEQ ID NO: 12552 - RNA, 18 nt, Artificial Sequence
  Synthetic
gcgguggcguggccggga

SEQ ID NO: 12553 - RNA, 19 nt, Artificial Sequence
  Synthetic
ggcgguggcguggccggga

SEQ ID NO: 12554 - RNA, 20 nt, Artificial Sequence
  Synthetic
cggcgguggcguggccggga

SEQ ID NO: 12555 - RNA, 21 nt, Artificial Sequence
  Synthetic
gcggcgguggcguggccggga

SEQ ID NO: 12556 - RNA, 22 nt, Artificial Sequence
  Synthetic
cgcggcgguggcguggccggga

SEQ ID NO: 12557 - RNA, 23 nt, Artificial Sequence
  Synthetic
ccgcggcgguggcguggccggga

SEQ ID NO: 12558 - RNA, 24 nt, Artificial Sequence
  Synthetic
gccgcggcgguggcguggccggga

SEQ ID NO: 12559 - RNA, 18 nt, Artificial Sequence
  Synthetic
aggggcgggccgagggga

SEQ ID NO: 12560 - RNA, 19 nt, Artificial Sequence
  Synthetic
gaggggcgggccgagggga

SEQ ID NO: 12561 - RNA, 20 nt, Artificial Sequence
  Synthetic
ggaggggcgggccgagggga

SEQ ID NO: 12562 - RNA, 21 nt, Artificial Sequence
  Synthetic
gggaggggcgggccgagggga

SEQ ID NO: 12563 - RNA, 22 nt, Artificial Sequence
  Synthetic
ggggaggggcgggccgagggga

SEQ ID NO: 12564 - RNA, 23 nt, Artificial Sequence
  Synthetic
gggggaggggcgggccgagggga

SEQ ID NO: 12565 - RNA, 24 nt, Artificial Sequence
  Synthetic
cgggggaggggcgggccgagggga

SEQ ID NO: 12566 - RNA, 18 nt, Artificial Sequence
  Synthetic
caauggccagugcgggga

SEQ ID NO: 12567 - RNA, 19 nt, Artificial Sequence
  Synthetic
ccaauggccagugcgggga

SEQ ID NO: 12568 - RNA, 20 nt, Artificial Sequence
  Synthetic
gccaauggccagugcgggga

SEQ ID NO: 12569 - RNA, 21 nt, Artificial Sequence
  Synthetic
agccaauggccagugcgggga

SEQ ID NO: 12570 - RNA, 22 nt, Artificial Sequence
  Synthetic
aagccaauggccagugcgggga

SEQ ID NO: 12571 - RNA, 23 nt, Artificial Sequence
  Synthetic
caagccaauggccagugcgggga

SEQ ID NO: 12572 - RNA, 24 nt, Artificial Sequence
  Synthetic
acaagccaauggccagugcgggga

SEQ ID NO: 12573 - RNA, 18 nt, Artificial Sequence
  Synthetic
gucaggagucuggaugga

SEQ ID NO: 12574 - RNA, 19 nt, Artificial Sequence
  Synthetic
cgucaggagucuggaugga

SEQ ID NO: 12575 - RNA, 20 nt, Artificial Sequence
  Synthetic
acgucaggagucuggaugga

SEQ ID NO: 12576 - RNA, 21 nt, Artificial Sequence
  Synthetic
aacgucaggagucuggaugga

SEQ ID NO: 12577 - RNA, 22 nt, Artificial Sequence
  Synthetic
gaacgucaggagucuggaugga

SEQ ID NO: 12578 - RNA, 23 nt, Artificial Sequence
  Synthetic
ugaacgucaggagucuggaugga

SEQ ID NO: 12579 - RNA, 24 nt, Artificial Sequence
  Synthetic
uugaacgucaggagucuggaugga

SEQ ID NO: 12580 - RNA, 18 nt, Artificial Sequence
  Synthetic
agagagagaagagagaua

SEQ ID NO: 12581 - RNA, 19 nt, Artificial Sequence
  Synthetic
gagagagagaagagagaua

SEQ ID NO: 12582 - RNA, 20 nt, Artificial Sequence
  Synthetic
agagagagagaagagagaua

SEQ ID NO: 12583 - RNA, 21 nt, Artificial Sequence
  Synthetic
gagagagagagaagagagaua

SEQ ID NO: 12584 - RNA, 22 nt, Artificial Sequence
  Synthetic
ggagagagagagaagagagaua

SEQ ID NO: 12585 - RNA, 23 nt, Artificial Sequence
  Synthetic
gggagagagagagaagagagaua

SEQ ID NO: 12586 - RNA, 24 nt, Artificial Sequence
  Synthetic
agggagagagagagaagagagaua

SEQ ID NO: 12587 - RNA, 18 nt, Artificial Sequence
  Synthetic
gacagagacacacaaaac

SEQ ID NO: 12588 - RNA, 19 nt, Artificial Sequence
  Synthetic
ggacagagacacacaaaac

SEQ ID NO: 12589 - RNA, 20 nt, Artificial Sequence
  Synthetic
uggacagagacacacaaaac

SEQ ID NO: 12590 - RNA, 21 nt, Artificial Sequence
  Synthetic
auggacagagacacacaaaac

SEQ ID NO: 12591 - RNA, 22 nt, Artificial Sequence
  Synthetic
gauggacagagacacacaaaac

SEQ ID NO: 12592 - RNA, 23 nt, Artificial Sequence
  Synthetic
ggauggacagagacacacaaaac

SEQ ID NO: 12593 - RNA, 24 nt, Artificial Sequence
  Synthetic
uggauggacagagacacacaaaac

SEQ ID NO: 12594 - RNA, 18 nt, Artificial Sequence
  Synthetic
cgugacgucccugcgaac

SEQ ID NO: 12595 - RNA, 19 nt, Artificial Sequence
  Synthetic
acgugacgucccugcgaac

SEQ ID NO: 12596 - RNA, 20 nt, Artificial Sequence
  Synthetic
gacgugacgucccugcgaac

SEQ ID NO: 12597 - RNA, 21 nt, Artificial Sequence
  Synthetic
ggacgugacgucccugcgaac

SEQ ID NO: 12598 - RNA, 22 nt, Artificial Sequence
  Synthetic
cggacgugacgucccugcgaac

SEQ ID NO: 12599 - RNA, 23 nt, Artificial Sequence
  Synthetic
gcggacgugacgucccugcgaac

SEQ ID NO: 12600 - RNA, 24 nt, Artificial Sequence
  Synthetic
ugcggacgugacgucccugcgaac

SEQ ID NO: 12601 - RNA, 18 nt, Artificial Sequence
  Synthetic
cugcucccccccacacac

SEQ ID NO: 12602 - RNA, 19 nt, Artificial Sequence
  Synthetic
ccugcucccccccacacac

SEQ ID NO: 12603 - RNA, 20 nt, Artificial Sequence
  Synthetic
cccugcucccccccacacac

SEQ ID NO: 12604 - RNA, 21 nt, Artificial Sequence
  Synthetic
gcccugcucccccccacacac

SEQ ID NO: 12605 - RNA, 22 nt, Artificial Sequence
  Synthetic
cgcccugcucccccccacacac

SEQ ID NO: 12606 - RNA, 23 nt, Artificial Sequence
  Synthetic
gcgcccugcucccccccacacac

SEQ ID NO: 12607 - RNA, 24 nt, Artificial Sequence
  Synthetic
ugcgcccugcucccccccacacac

SEQ ID NO: 12608 - RNA, 18 nt, Artificial Sequence
  Synthetic
uggacaugaaaaagagac

SEQ ID NO: 12609 - RNA, 19 nt, Artificial Sequence
  Synthetic
cuggacaugaaaaagagac

SEQ ID NO: 12610 - RNA, 20 nt, Artificial Sequence
  Synthetic
gcuggacaugaaaaagagac

SEQ ID NO: 12611 - RNA, 21 nt, Artificial Sequence
  Synthetic
ggcuggacaugaaaaagagac

SEQ ID NO: 12612 - RNA, 22 nt, Artificial Sequence
  Synthetic
gggcuggacaugaaaaagagac

SEQ ID NO: 12613 - RNA, 23 nt, Artificial Sequence
  Synthetic
ggggcuggacaugaaaaagagac

SEQ ID NO: 12614 - RNA, 24 nt, Artificial Sequence
  Synthetic
aggggcuggacaugaaaaagagac

SEQ ID NO: 12615 - RNA, 18 nt, Artificial Sequence
  Synthetic
acacaucaggggcuggac

SEQ ID NO: 12616 - RNA, 19 nt, Artificial Sequence
  Synthetic
cacacaucaggggcuggac

SEQ ID NO: 12617 - RNA, 20 nt, Artificial Sequence
  Synthetic
acacacaucaggggcuggac

SEQ ID NO: 12618 - RNA, 21 nt, Artificial Sequence
  Synthetic
gacacacaucaggggcuggac

SEQ ID NO: 12619 - RNA, 22 nt, Artificial Sequence
  Synthetic
ggacacacaucaggggcuggac

SEQ ID NO: 12620 - RNA, 23 nt, Artificial Sequence
  Synthetic
uggacacacaucaggggcuggac

SEQ ID NO: 12621 - RNA, 24 nt, Artificial Sequence
  Synthetic
auggacacacaucaggggcuggac

SEQ ID NO: 12622 - RNA, 18 nt, Artificial Sequence
  Synthetic
uauuauuggguuacuuac

SEQ ID NO: 12623 - RNA, 19 nt, Artificial Sequence
  Synthetic
cuauuauuggguuacuuac

SEQ ID NO: 12624 - RNA, 20 nt, Artificial Sequence
  Synthetic
acuauuauuggguuacuuac

SEQ ID NO: 12625 - RNA, 21 nt, Artificial Sequence
  Synthetic
uacuauuauuggguuacuuac

SEQ ID NO: 12626 - RNA, 22 nt, Artificial Sequence
  Synthetic
uuacuauuauuggguuacuuac

SEQ ID NO: 12627 - RNA, 23 nt, Artificial Sequence
  Synthetic
auuacuauuauuggguuacuuac

SEQ ID NO: 12628 - RNA, 24 nt, Artificial Sequence
  Synthetic
uauuacuauuauuggguuacuuac

SEQ ID NO: 12629 - RNA, 18 nt, Artificial Sequence
  Synthetic
aaaauggcaaaagccccc

SEQ ID NO: 12630 - RNA, 19 nt, Artificial Sequence
  Synthetic
aaaaauggcaaaagccccc

SEQ ID NO: 12631 - RNA, 20 nt, Artificial Sequence
  Synthetic
aaaaaauggcaaaagccccc

SEQ ID NO: 12632 - RNA, 21 nt, Artificial Sequence
  Synthetic
aaaaaaauggcaaaagccccc

SEQ ID NO: 12633 - RNA, 22 nt, Artificial Sequence
  Synthetic
gaaaaaaauggcaaaagccccc

SEQ ID NO: 12634 - RNA, 23 nt, Artificial Sequence
  Synthetic
ugaaaaaaauggcaaaagccccc

SEQ ID NO: 12635 - RNA, 24 nt, Artificial Sequence
  Synthetic
augaaaaaaauggcaaaagccccc

SEQ ID NO: 12636 - RNA, 18 nt, Artificial Sequence
  Synthetic
acgccagacgcggccccc

SEQ ID NO: 12637 - RNA, 19 nt, Artificial Sequence
  Synthetic
gacgccagacgcggccccc

SEQ ID NO: 12638 - RNA, 20 nt, Artificial Sequence
  Synthetic
ggacgccagacgcggccccc

SEQ ID NO: 12639 - RNA, 21 nt, Artificial Sequence
  Synthetic
cggacgccagacgcggccccc

SEQ ID NO: 12640 - RNA, 22 nt, Artificial Sequence
  Synthetic
gcggacgccagacgcggccccc

SEQ ID NO: 12641 - RNA, 23 nt, Artificial Sequence
  Synthetic
cgcggacgccagacgcggccccc

SEQ ID NO: 12642 - RNA, 24 nt, Artificial Sequence
  Synthetic
ccgcggacgccagacgcggccccc

SEQ ID NO: 12643 - RNA, 18 nt, Artificial Sequence
  Synthetic
gacgccagacgcggcccc

SEQ ID NO: 12644 - RNA, 19 nt, Artificial Sequence
  Synthetic
ggacgccagacgcggcccc

SEQ ID NO: 12645 - RNA, 20 nt, Artificial Sequence
  Synthetic
cggacgccagacgcggcccc

SEQ ID NO: 12646 - RNA, 21 nt, Artificial Sequence
  Synthetic
gcggacgccagacgcggcccc

SEQ ID NO: 12647 - RNA, 22 nt, Artificial Sequence
  Synthetic
cgcggacgccagacgcggcccc

SEQ ID NO: 12648 - RNA, 23 nt, Artificial Sequence
  Synthetic
ccgcggacgccagacgcggcccc

SEQ ID NO: 12649 - RNA, 24 nt, Artificial Sequence
  Synthetic
uccgcggacgccagacgcggcccc

SEQ ID NO: 12650 - RNA, 18 nt, Artificial Sequence
  Synthetic
ggacgccagacgcggccc

SEQ ID NO: 12651 - RNA, 19 nt, Artificial Sequence
  Synthetic
cggacgccagacgcggccc

SEQ ID NO: 12652 - RNA, 20 nt, Artificial Sequence
  Synthetic
gcggacgccagacgcggccc

SEQ ID NO: 12653 - RNA, 21 nt, Artificial Sequence
  Synthetic
cgcggacgccagacgcggccc

SEQ ID NO: 12654 - RNA, 22 nt, Artificial Sequence
  Synthetic
ccgcggacgccagacgcggccc

SEQ ID NO: 12655 - RNA, 23 nt, Artificial Sequence
  Synthetic
uccgcggacgccagacgcggccc

SEQ ID NO: 12656 - RNA, 24 nt, Artificial Sequence
  Synthetic
cuccgcggacgccagacgcggccc

SEQ ID NO: 12657 - RNA, 18 nt, Artificial Sequence
  Synthetic
ccgggggaggggcgggcc

SEQ ID NO: 12658 - RNA, 19 nt, Artificial Sequence
  Synthetic
cccgggggaggggcgggcc

SEQ ID NO: 12659 - RNA, 20 nt, Artificial Sequence
  Synthetic
ccccgggggaggggcgggcc

SEQ ID NO: 12660 - RNA, 21 nt, Artificial Sequence
  Synthetic
cccccgggggaggggcgggcc

SEQ ID NO: 12661 - RNA, 22 nt, Artificial Sequence
  Synthetic
gcccccgggggaggggcgggcc

SEQ ID NO: 12662 - RNA, 23 nt, Artificial Sequence
  Synthetic
ggcccccgggggaggggcgggcc

SEQ ID NO: 12663 - RNA, 24 nt, Artificial Sequence
  Synthetic
cggcccccgggggaggggcgggcc

SEQ ID NO: 12664 - RNA, 18 nt, Artificial Sequence
  Synthetic
ggagggggcgcuggggcc

SEQ ID NO: 12665 - RNA, 19 nt, Artificial Sequence
  Synthetic
gggagggggcgcuggggcc

SEQ ID NO: 12666 - RNA, 20 nt, Artificial Sequence
  Synthetic
ggggagggggcgcuggggcc

SEQ ID NO: 12667 - RNA, 21 nt, Artificial Sequence
  Synthetic
aggggagggggcgcuggggcc

SEQ ID NO: 12668 - RNA, 22 nt, Artificial Sequence
  Synthetic
gaggggagggggcgcuggggcc

SEQ ID NO: 12669 - RNA, 23 nt, Artificial Sequence
  Synthetic
cgaggggagggggcgcuggggcc

SEQ ID NO: 12670 - RNA, 24 nt, Artificial Sequence
  Synthetic
ccgaggggagggggcgcuggggcc

SEQ ID NO: 12671 - RNA, 18 nt, Artificial Sequence
  Synthetic
cgcggcgguggcguggcc

SEQ ID NO: 12672 - RNA, 19 nt, Artificial Sequence
  Synthetic
ccgcggcgguggcguggcc

SEQ ID NO: 12673 - RNA, 20 nt, Artificial Sequence
  Synthetic
gccgcggcgguggcguggcc

SEQ ID NO: 12674 - RNA, 21 nt, Artificial Sequence
  Synthetic
cgccgcggcgguggcguggcc

SEQ ID NO: 12675 - RNA, 22 nt, Artificial Sequence
  Synthetic
gcgccgcggcgguggcguggcc

SEQ ID NO: 12676 - RNA, 23 nt, Artificial Sequence
  Synthetic
agcgccgcggcgguggcguggcc

SEQ ID NO: 12677 - RNA, 24 nt, Artificial Sequence
  Synthetic
gagcgccgcggcgguggcguggcc

SEQ ID NO: 12678 - RNA, 18 nt, Artificial Sequence
  Synthetic
ugcggggcggggggcucc

SEQ ID NO: 12679 - RNA, 19 nt, Artificial Sequence
  Synthetic
gugcggggcggggggcucc

SEQ ID NO: 12680 - RNA, 20 nt, Artificial Sequence
  Synthetic
ggugcggggcggggggcucc

SEQ ID NO: 12681 - RNA, 21 nt, Artificial Sequence
  Synthetic
aggugcggggcggggggcucc

SEQ ID NO: 12682 - RNA, 22 nt, Artificial Sequence
  Synthetic
gaggugcggggcggggggcucc

SEQ ID NO: 12683 - RNA, 23 nt, Artificial Sequence
  Synthetic
ggaggugcggggcggggggcucc

SEQ ID NO: 12684 - RNA, 24 nt, Artificial Sequence
  Synthetic
gggaggugcggggcggggggcucc

SEQ ID NO: 12685 - RNA, 18 nt, Artificial Sequence
  Synthetic
aacaugggcagggcgagc

SEQ ID NO: 12686 - RNA, 19 nt, Artificial Sequence
  Synthetic
aaacaugggcagggcgagc

SEQ ID NO: 12687 - RNA, 20 nt, Artificial Sequence
  Synthetic
aaaacaugggcagggcgagc

SEQ ID NO: 12688 - RNA, 21 nt, Artificial Sequence
  Synthetic
caaaacaugggcagggcgagc

SEQ ID NO: 12689 - RNA, 22 nt, Artificial Sequence
  Synthetic
acaaaacaugggcagggcgagc

SEQ ID NO: 12690 - RNA, 23 nt, Artificial Sequence
  Synthetic
cacaaaacaugggcagggcgagc

SEQ ID NO: 12691 - RNA, 24 nt, Artificial Sequence
  Synthetic
acacaaaacaugggcagggcgagc

SEQ ID NO: 12692 - RNA, 18 nt, Artificial Sequence
  Synthetic
gccgaggggagggggcgc

SEQ ID NO: 12693 - RNA, 19 nt, Artificial Sequence
  Synthetic
ggccgaggggagggggcgc

SEQ ID NO: 12694 - RNA, 20 nt, Artificial Sequence
  Synthetic
gggccgaggggagggggcgc

SEQ ID NO: 12695 - RNA, 21 nt, Artificial Sequence
  Synthetic
cgggccgaggggagggggcgc

SEQ ID NO: 12696 - RNA, 22 nt, Artificial Sequence
  Synthetic
gcgggccgaggggagggggcgc

SEQ ID NO: 12697 - RNA, 23 nt, Artificial Sequence
  Synthetic
ggcgggccgaggggagggggcgc

SEQ ID NO: 12698 - RNA, 24 nt, Artificial Sequence
  Synthetic
gggcgggccgaggggagggggcgc

SEQ ID NO: 12699 - RNA, 18 nt, Artificial Sequence
  Synthetic
auaauacaaagauggcgc

SEQ ID NO: 12700 - RNA, 19 nt, Artificial Sequence
  Synthetic
aauaauacaaagauggcgc

SEQ ID NO: 12701 - RNA, 20 nt, Artificial Sequence
  Synthetic
aaauaauacaaagauggcgc

SEQ ID NO: 12702 - RNA, 21 nt, Artificial Sequence
  Synthetic
gaaauaauacaaagauggcgc

SEQ ID NO: 12703 - RNA, 22 nt, Artificial Sequence
  Synthetic
agaaauaauacaaagauggcgc

SEQ ID NO: 12704 - RNA, 23 nt, Artificial Sequence
  Synthetic
uagaaauaauacaaagauggcgc

SEQ ID NO: 12705 - RNA, 24 nt, Artificial Sequence
  Synthetic
uuagaaauaauacaaagauggcgc

SEQ ID NO: 12706 - RNA, 18 nt, Artificial Sequence
  Synthetic
gagggggaggugcggggc

SEQ ID NO: 12707 - RNA, 19 nt, Artificial Sequence
  Synthetic
ggagggggaggugcggggc

SEQ ID NO: 12708 - RNA, 20 nt, Artificial Sequence
  Synthetic
gggagggggaggugcggggc

SEQ ID NO: 12709 - RNA, 21 nt, Artificial Sequence
  Synthetic
ggggagggggaggugcggggc

SEQ ID NO: 12710 - RNA, 22 nt, Artificial Sequence
  Synthetic
cggggagggggaggugcggggc

SEQ ID NO: 12711 - RNA, 23 nt, Artificial Sequence
  Synthetic
gcggggagggggaggugcggggc

SEQ ID NO: 12712 - RNA, 24 nt, Artificial Sequence
  Synthetic
ugcggggagggggaggugcggggc

SEQ ID NO: 12713 - RNA, 18 nt, Artificial Sequence
  Synthetic
ccgcggcgguggcguggc

SEQ ID NO: 12714 - RNA, 19 nt, Artificial Sequence
  Synthetic
gccgcggcgguggcguggc

SEQ ID NO: 12715 - RNA, 20 nt, Artificial Sequence
  Synthetic
cgccgcggcgguggcguggc

SEQ ID NO: 12716 - RNA, 21 nt, Artificial Sequence
  Synthetic
gcgccgcggcgguggcguggc

SEQ ID NO: 12717 - RNA, 22 nt, Artificial Sequence
  Synthetic
agcgccgcggcgguggcguggc

SEQ ID NO: 12718 - RNA, 23 nt, Artificial Sequence
  Synthetic
gagcgccgcggcgguggcguggc

SEQ ID NO: 12719 - RNA, 24 nt, Artificial Sequence
  Synthetic
cgagcgccgcggcgguggcguggc

SEQ ID NO: 12720 - RNA, 18 nt, Artificial Sequence
  Synthetic
caagccaauggccagugc

SEQ ID NO: 12721 - RNA, 19 nt, Artificial Sequence
  Synthetic
acaagccaauggccagugc

SEQ ID NO: 12722 - RNA, 20 nt, Artificial Sequence
  Synthetic
gacaagccaauggccagugc

SEQ ID NO: 12723 - RNA, 21 nt, Artificial Sequence
  Synthetic
ggacaagccaauggccagugc

SEQ ID NO: 12724 - RNA, 22 nt, Artificial Sequence
  Synthetic
aggacaagccaauggccagugc

SEQ ID NO: 12725 - RNA, 23 nt, Artificial Sequence
  Synthetic
caggacaagccaauggccagugc

SEQ ID NO: 12726 - RNA, 24 nt, Artificial Sequence
  Synthetic
ccaggacaagccaauggccagugc

SEQ ID NO: 12727 - RNA, 18 nt, Artificial Sequence
  Synthetic
caccaauggacacacauc

SEQ ID NO: 12728 - RNA, 19 nt, Artificial Sequence
  Synthetic
acaccaauggacacacauc

SEQ ID NO: 12729 - RNA, 20 nt, Artificial Sequence
  Synthetic
cacaccaauggacacacauc

SEQ ID NO: 12730 - RNA, 21 nt, Artificial Sequence
  Synthetic
ucacaccaauggacacacauc

SEQ ID NO: 12731 - RNA, 22 nt, Artificial Sequence
  Synthetic
cucacaccaauggacacacauc

SEQ ID NO: 12732 - RNA, 23 nt, Artificial Sequence
  Synthetic
gcucacaccaauggacacacauc

SEQ ID NO: 12733 - RNA, 24 nt, Artificial Sequence
  Synthetic
agcucacaccaauggacacacauc

SEQ ID NO: 12734 - RNA, 18 nt, Artificial Sequence
  Synthetic
gacggcucgguucacauc

SEQ ID NO: 12735 - RNA, 19 nt, Artificial Sequence
  Synthetic
cgacggcucgguucacauc

SEQ ID NO: 12736 - RNA, 20 nt, Artificial Sequence
  Synthetic
acgacggcucgguucacauc

SEQ ID NO: 12737 - RNA, 21 nt, Artificial Sequence
  Synthetic
gacgacggcucgguucacauc

SEQ ID NO: 12738 - RNA, 22 nt, Artificial Sequence
  Synthetic
ggacgacggcucgguucacauc

SEQ ID NO: 12739 - RNA, 23 nt, Artificial Sequence
  Synthetic
cggacgacggcucgguucacauc

SEQ ID NO: 12740 - RNA, 24 nt, Artificial Sequence
  Synthetic
gcggacgacggcucgguucacauc

SEQ ID NO: 12741 - RNA, 18 nt, Artificial Sequence
  Synthetic
uuagaaagaaggagacuc

SEQ ID NO: 12742 - RNA, 19 nt, Artificial Sequence
  Synthetic
guuagaaagaaggagacuc

SEQ ID NO: 12743 - RNA, 20 nt, Artificial Sequence
  Synthetic
gguuagaaagaaggagacuc

SEQ ID NO: 12744 - RNA, 21 nt, Artificial Sequence
  Synthetic
ggguuagaaagaaggagacuc

SEQ ID NO: 12745 - RNA, 22 nt, Artificial Sequence
  Synthetic
cggguuagaaagaaggagacuc

SEQ ID NO: 12746 - RNA, 23 nt, Artificial Sequence
  Synthetic
ccggguuagaaagaaggagacuc

SEQ ID NO: 12747 - RNA, 24 nt, Artificial Sequence
  Synthetic
gccggguuagaaagaaggagacuc

SEQ ID NO: 12748 - RNA, 18 nt, Artificial Sequence
  Synthetic
ucucuuuuaccucgacuc

SEQ ID NO: 12749 - RNA, 19 nt, Artificial Sequence
  Synthetic
aucucuuuuaccucgacuc

SEQ ID NO: 12750 - RNA, 20 nt, Artificial Sequence
  Synthetic
uaucucuuuuaccucgacuc

SEQ ID NO: 12751 - RNA, 21 nt, Artificial Sequence
  Synthetic
uuaucucuuuuaccucgacuc

SEQ ID NO: 12752 - RNA, 22 nt, Artificial Sequence
  Synthetic
uuuaucucuuuuaccucgacuc

SEQ ID NO: 12753 - RNA, 23 nt, Artificial Sequence
  Synthetic
cuuuaucucuuuuaccucgacuc

SEQ ID NO: 12754 - RNA, 24 nt, Artificial Sequence
  Synthetic
ccuuuaucucuuuuaccucgacuc

SEQ ID NO: 12755 - RNA, 18 nt, Artificial Sequence
  Synthetic
cucucggagguuuuucuc

SEQ ID NO: 12756 - RNA, 19 nt, Artificial Sequence
  Synthetic
acucucggagguuuuucuc

SEQ ID NO: 12757 - RNA, 20 nt, Artificial Sequence
  Synthetic
gacucucggagguuuuucuc

SEQ ID NO: 12758 - RNA, 21 nt, Artificial Sequence
  Synthetic
cgacucucggagguuuuucuc

SEQ ID NO: 12759 - RNA, 22 nt, Artificial Sequence
  Synthetic
ucgacucucggagguuuuucuc

SEQ ID NO: 12760 - RNA, 23 nt, Artificial Sequence
  Synthetic
cucgacucucggagguuuuucuc

SEQ ID NO: 12761 - RNA, 24 nt, Artificial Sequence
  Synthetic
ccucgacucucggagguuuuucuc

SEQ ID NO: 12762 - RNA, 18 nt, Artificial Sequence
  Synthetic
aaaaaaaaaaaaaaaaag

SEQ ID NO: 12763 - RNA, 19 nt, Artificial Sequence
  Synthetic
aaaaaaaaaaaaaaaaaag

SEQ ID NO: 12764 - RNA, 20 nt, Artificial Sequence
  Synthetic
aaaaaaaaaaaaaaaaaaag

SEQ ID NO: 12765 - RNA, 21 nt, Artificial Sequence
  Synthetic
aaaaaaaaaaaaaaaaaaaag

SEQ ID NO: 12766 - RNA, 22 nt, Artificial Sequence
  Synthetic
aaaaaaaaaaaaaaaaaaaaag

SEQ ID NO: 12767 - RNA, 23 nt, Artificial Sequence
  Synthetic
aaaaaaaaaaaaaaaaaaaaaag

SEQ ID NO: 12768 - RNA, 24 nt, Artificial Sequence
  Synthetic
aaaaaaaaaaaaaaaaaaaaaaag

SEQ ID NO: 12769 - RNA, 18 nt, Artificial Sequence
  Synthetic
gagagccggguuagaaag

SEQ ID NO: 12770 - RNA, 19 nt, Artificial Sequence
  Synthetic
ggagagccggguuagaaag

SEQ ID NO: 12771 - RNA, 20 nt, Artificial Sequence
  Synthetic
gggagagccggguuagaaag

SEQ ID NO: 12772 - RNA, 21 nt, Artificial Sequence
  Synthetic
cgggagagccggguuagaaag

SEQ ID NO: 12773 - RNA, 22 nt, Artificial Sequence
  Synthetic
ucgggagagccggguuagaaag

SEQ ID NO: 12774 - RNA, 23 nt, Artificial Sequence
  Synthetic
aucgggagagccggguuagaaag

SEQ ID NO: 12775 - RNA, 24 nt, Artificial Sequence
  Synthetic
caucgggagagccggguuagaaag

SEQ ID NO: 12776 - RNA, 18 nt, Artificial Sequence
  Synthetic
gggcgagcaggagagaag

SEQ ID NO: 12777 - RNA, 19 nt, Artificial Sequence
  Synthetic
agggcgagcaggagagaag

SEQ ID NO: 12778 - RNA, 20 nt, Artificial Sequence
  Synthetic
cagggcgagcaggagagaag

SEQ ID NO: 12779 - RNA, 21 nt, Artificial Sequence
  Synthetic
gcagggcgagcaggagagaag

SEQ ID NO: 12780 - RNA, 22 nt, Artificial Sequence
  Synthetic
ggcagggcgagcaggagagaag

SEQ ID NO: 12781 - RNA, 23 nt, Artificial Sequence
  Synthetic
gggcagggcgagcaggagagaag

SEQ ID NO: 12782 - RNA, 24 nt, Artificial Sequence
  Synthetic
ugggcagggcgagcaggagagaag

SEQ ID NO: 12783 - RNA, 18 nt, Artificial Sequence
  Synthetic
agaaggggaggagggaag

SEQ ID NO: 12784 - RNA, 19 nt, Artificial Sequence
  Synthetic
gagaaggggaggagggaag

SEQ ID NO: 12785 - RNA, 20 nt, Artificial Sequence
  Synthetic
agagaaggggaggagggaag

SEQ ID NO: 12786 - RNA, 21 nt, Artificial Sequence
  Synthetic
gagagaaggggaggagggaag

SEQ ID NO: 12787 - RNA, 22 nt, Artificial Sequence
  Synthetic
ggagagaaggggaggagggaag

SEQ ID NO: 12788 - RNA, 23 nt, Artificial Sequence
  Synthetic
aggagagaaggggaggagggaag

SEQ ID NO: 12789 - RNA, 24 nt, Artificial Sequence
  Synthetic
caggagagaaggggaggagggaag

SEQ ID NO: 12790 - RNA, 18 nt, Artificial Sequence
  Synthetic
acacggcaaugguuccag

SEQ ID NO: 12791 - RNA, 19 nt, Artificial Sequence
  Synthetic
uacacggcaaugguuccag

SEQ ID NO: 12792 - RNA, 20 nt, Artificial Sequence
  Synthetic
auacacggcaaugguuccag

SEQ ID NO: 12793 - RNA, 21 nt, Artificial Sequence
  Synthetic
cauacacggcaaugguuccag

SEQ ID NO: 12794 - RNA, 22 nt, Artificial Sequence
  Synthetic
gcauacacggcaaugguuccag

SEQ ID NO: 12795 - RNA, 23 nt, Artificial Sequence
  Synthetic
ugcauacacggcaaugguuccag

SEQ ID NO: 12796 - RNA, 24 nt, Artificial Sequence
  Synthetic
gugcauacacggcaaugguuccag

SEQ ID NO: 12797 - RNA, 18 nt, Artificial Sequence
  Synthetic
caugggcagggcgagcag

SEQ ID NO: 12798 - RNA, 19 nt, Artificial Sequence
  Synthetic
acaugggcagggcgagcag

SEQ ID NO: 12799 - RNA, 20 nt, Artificial Sequence
  Synthetic
aacaugggcagggcgagcag

SEQ ID NO: 12800 - RNA, 21 nt, Artificial Sequence
  Synthetic
aaacaugggcagggcgagcag

SEQ ID NO: 12801 - RNA, 22 nt, Artificial Sequence
  Synthetic
aaaacaugggcagggcgagcag

SEQ ID NO: 12802 - RNA, 23 nt, Artificial Sequence
  Synthetic
caaaacaugggcagggcgagcag

SEQ ID NO: 12803 - RNA, 24 nt, Artificial Sequence
  Synthetic
acaaaacaugggcagggcgagcag

SEQ ID NO: 12804 - RNA, 18 nt, Artificial Sequence
  Synthetic
ggagagagagagagagag

SEQ ID NO: 12805 - RNA, 19 nt, Artificial Sequence
  Synthetic
gggagagagagagagagag

SEQ ID NO: 12806 - RNA, 20 nt, Artificial Sequence
  Synthetic
agggagagagagagagagag

SEQ ID NO: 12807 - RNA, 21 nt, Artificial Sequence
  Synthetic
gagggagagagagagagagag

SEQ ID NO: 12808 - RNA, 22 nt, Artificial Sequence
  Synthetic
agagggagagagagagagagag

SEQ ID NO: 12809 - RNA, 23 nt, Artificial Sequence
  Synthetic
uagagggagagagagagagagag

SEQ ID NO: 12810 - RNA, 24 nt, Artificial Sequence
  Synthetic
auagagggagagagagagagagag

SEQ ID NO: 12811 - RNA, 18 nt, Artificial Sequence
  Synthetic
aaagagggagagagagag

SEQ ID NO: 12812 - RNA, 19 nt, Artificial Sequence
  Synthetic
aaaagagggagagagagag

SEQ ID NO: 12813 - RNA, 20 nt, Artificial Sequence
  Synthetic
aaaaagagggagagagagag

SEQ ID NO: 12814 - RNA, 21 nt, Artificial Sequence
  Synthetic
aaaaaagagggagagagagag

SEQ ID NO: 12815 - RNA, 22 nt, Artificial Sequence
  Synthetic
aaaaaaagagggagagagagag

SEQ ID NO: 12816 - RNA, 23 nt, Artificial Sequence
  Synthetic
aaaaaaaagagggagagagagag

SEQ ID NO: 12817 - RNA, 24 nt, Artificial Sequence
  Synthetic
aaaaaaaaagagggagagagagag

SEQ ID NO: 12818 - RNA, 18 nt, Artificial Sequence
  Synthetic
gcagggcgagcaggagag

SEQ ID NO: 12819 - RNA, 19 nt, Artificial Sequence
  Synthetic
ggcagggcgagcaggagag

SEQ ID NO: 12820 - RNA, 20 nt, Artificial Sequence
  Synthetic
gggcagggcgagcaggagag

SEQ ID NO: 12821 - RNA, 21 nt, Artificial Sequence
  Synthetic
ugggcagggcgagcaggagag

SEQ ID NO: 12822 - RNA, 22 nt, Artificial Sequence
  Synthetic
augggcagggcgagcaggagag

SEQ ID NO: 12823 - RNA, 23 nt, Artificial Sequence
  Synthetic
caugggcagggcgagcaggagag

SEQ ID NO: 12824 - RNA, 24 nt, Artificial Sequence
  Synthetic
acaugggcagggcgagcaggagag

SEQ ID NO: 12825 - RNA, 18 nt, Artificial Sequence
  Synthetic
guggcguggccgggagag

SEQ ID NO: 12826 - RNA, 19 nt, Artificial Sequence
  Synthetic
gguggcguggccgggagag

SEQ ID NO: 12827 - RNA, 20 nt, Artificial Sequence
  Synthetic
cgguggcguggccgggagag

SEQ ID NO: 12828 - RNA, 21 nt, Artificial Sequence
  Synthetic
gcgguggcguggccgggagag

SEQ ID NO: 12829 - RNA, 22 nt, Artificial Sequence
  Synthetic
ggcgguggcguggccgggagag

SEQ ID NO: 12830 - RNA, 23 nt, Artificial Sequence
  Synthetic
cggcgguggcguggccgggagag

SEQ ID NO: 12831 - RNA, 24 nt, Artificial Sequence
  Synthetic
gcggcgguggcguggccgggagag

SEQ ID NO: 12832 - RNA, 18 nt, Artificial Sequence
  Synthetic
ggggaggggcgggccgag

SEQ ID NO: 12833 - RNA, 19 nt, Artificial Sequence
  Synthetic
gggggaggggcgggccgag

SEQ ID NO: 12834 - RNA, 20 nt, Artificial Sequence
  Synthetic
cgggggaggggcgggccgag

SEQ ID NO: 12835 - RNA, 21 nt, Artificial Sequence
  Synthetic
ccgggggaggggcgggccgag

SEQ ID NO: 12836 - RNA, 22 nt, Artificial Sequence
  Synthetic
cccgggggaggggcgggccgag

SEQ ID NO: 12837 - RNA, 23 nt, Artificial Sequence
  Synthetic
ccccgggggaggggcgggccgag

SEQ ID NO: 12838 - RNA, 24 nt, Artificial Sequence
  Synthetic
cccccgggggaggggcgggccgag

SEQ ID NO: 12839 - RNA, 18 nt, Artificial Sequence
  Synthetic
aaacaugggcagggcgag

SEQ ID NO: 12840 - RNA, 19 nt, Artificial Sequence
  Synthetic
aaaacaugggcagggcgag

SEQ ID NO: 12841 - RNA, 20 nt, Artificial Sequence
  Synthetic
caaaacaugggcagggcgag

SEQ ID NO: 12842 - RNA, 21 nt, Artificial Sequence
  Synthetic
acaaaacaugggcagggcgag

SEQ ID NO: 12843 - RNA, 22 nt, Artificial Sequence
  Synthetic
cacaaaacaugggcagggcgag

SEQ ID NO: 12844 - RNA, 23 nt, Artificial Sequence
  Synthetic
acacaaaacaugggcagggcgag

SEQ ID NO: 12845 - RNA, 24 nt, Artificial Sequence
  Synthetic
cacacaaaacaugggcagggcgag

SEQ ID NO: 12846 - RNA, 18 nt, Artificial Sequence
  Synthetic
agcaggagagaaggggag

SEQ ID NO: 12847 - RNA, 19 nt, Artificial Sequence
  Synthetic
gagcaggagagaaggggag

SEQ ID NO: 12848 - RNA, 20 nt, Artificial Sequence
  Synthetic
cgagcaggagagaaggggag

SEQ ID NO: 12849 - RNA, 21 nt, Artificial Sequence
  Synthetic
gcgagcaggagagaaggggag

SEQ ID NO: 12850 - RNA, 22 nt, Artificial Sequence
  Synthetic
ggcgagcaggagagaaggggag

SEQ ID NO: 12851 - RNA, 23 nt, Artificial Sequence
  Synthetic
gggcgagcaggagagaaggggag

SEQ ID NO: 12852 - RNA, 24 nt, Artificial Sequence
  Synthetic
agggcgagcaggagagaaggggag

SEQ ID NO: 12853 - RNA, 18 nt, Artificial Sequence
  Synthetic
aauggccagugcggggag

SEQ ID NO: 12854 - RNA, 19 nt, Artificial Sequence
  Synthetic
caauggccagugcggggag

SEQ ID NO: 12855 - RNA, 20 nt, Artificial Sequence
  Synthetic
ccaauggccagugcggggag

SEQ ID NO: 12856 - RNA, 21 nt, Artificial Sequence
  Synthetic
gccaauggccagugcggggag

SEQ ID NO: 12857 - RNA, 22 nt, Artificial Sequence
  Synthetic
agccaauggccagugcggggag

SEQ ID NO: 12858 - RNA, 23 nt, Artificial Sequence
  Synthetic
aagccaauggccagugcggggag

SEQ ID NO: 12859 - RNA, 24 nt, Artificial Sequence
  Synthetic
caagccaauggccagugcggggag

SEQ ID NO: 12860 - RNA, 18 nt, Artificial Sequence
  Synthetic
gagagagaagagagauag

SEQ ID NO: 12861 - RNA, 19 nt, Artificial Sequence
  Synthetic
agagagagaagagagauag

SEQ ID NO: 12862 - RNA, 20 nt, Artificial Sequence
  Synthetic
gagagagagaagagagauag

SEQ ID NO: 12863 - RNA, 21 nt, Artificial Sequence
  Synthetic
agagagagagaagagagauag

SEQ ID NO: 12864 - RNA, 22 nt, Artificial Sequence
  Synthetic
gagagagagagaagagagauag

SEQ ID NO: 12865 - RNA, 23 nt, Artificial Sequence
  Synthetic
ggagagagagagaagagagauag

SEQ ID NO: 12866 - RNA, 24 nt, Artificial Sequence
  Synthetic
gggagagagagagaagagagauag

SEQ ID NO: 12867 - RNA, 18 nt, Artificial Sequence
  Synthetic
cgccagacgcggcccccg

SEQ ID NO: 12868 - RNA, 19 nt, Artificial Sequence
  Synthetic
acgccagacgcggcccccg

SEQ ID NO: 12869 - RNA, 20 nt, Artificial Sequence
  Synthetic
gacgccagacgcggcccccg

SEQ ID NO: 12870 - RNA, 21 nt, Artificial Sequence
  Synthetic
ggacgccagacgcggcccccg

SEQ ID NO: 12871 - RNA, 22 nt, Artificial Sequence
  Synthetic
cggacgccagacgcggcccccg

SEQ ID NO: 12872 - RNA, 23 nt, Artificial Sequence
  Synthetic
gcggacgccagacgcggcccccg

SEQ ID NO: 12873 - RNA, 24 nt, Artificial Sequence
  Synthetic
cgcggacgccagacgcggcccccg

SEQ ID NO: 12874 - RNA, 18 nt, Artificial Sequence
  Synthetic
cgggggaggggcgggccg

SEQ ID NO: 12875 - RNA, 19 nt, Artificial Sequence
  Synthetic
ccgggggaggggcgggccg

SEQ ID NO: 12876 - RNA, 20 nt, Artificial Sequence
  Synthetic
cccgggggaggggcgggccg

SEQ ID NO: 12877 - RNA, 21 nt, Artificial Sequence
  Synthetic
ccccgggggaggggcgggccg

SEQ ID NO: 12878 - RNA, 22 nt, Artificial Sequence
  Synthetic
cccccgggggaggggcgggccg

SEQ ID NO: 12879 - RNA, 23 nt, Artificial Sequence
  Synthetic
gcccccgggggaggggcgggccg

SEQ ID NO: 12880 - RNA, 24 nt, Artificial Sequence
  Synthetic
ggcccccgggggaggggcgggccg

SEQ ID NO: 12881 - RNA, 18 nt, Artificial Sequence
  Synthetic
gcggcggcggcggcggcg

SEQ ID NO: 12882 - RNA, 19 nt, Artificial Sequence
  Synthetic
ggcggcggcggcggcggcg

SEQ ID NO: 12883 - RNA, 20 nt, Artificial Sequence
  Synthetic
cggcggcggcggcggcggcg

SEQ ID NO: 12884 - RNA, 21 nt, Artificial Sequence
  Synthetic
gcggcggcggcggcggcggcg

SEQ ID NO: 12885 - RNA, 22 nt, Artificial Sequence
  Synthetic
ggcggcggcggcggcggcggcg

SEQ ID NO: 12886 - RNA, 23 nt, Artificial Sequence
  Synthetic
cggcggcggcggcggcggcggcg

SEQ ID NO: 12887 - RNA, 24 nt, Artificial Sequence
  Synthetic
gcggcggcggcggcggcggcggcg

SEQ ID NO: 12888 - RNA, 18 nt, Artificial Sequence
  Synthetic
agggggaggugcggggcg

SEQ ID NO: 12889 - RNA, 19 nt, Artificial Sequence
  Synthetic
gagggggaggugcggggcg

SEQ ID NO: 12890 - RNA, 20 nt, Artificial Sequence
  Synthetic
ggagggggaggugcggggcg

SEQ ID NO: 12891 - RNA, 21 nt, Artificial Sequence
  Synthetic
gggagggggaggugcggggcg

SEQ ID NO: 12892 - RNA, 22 nt, Artificial Sequence
  Synthetic
ggggagggggaggugcggggcg

SEQ ID NO: 12893 - RNA, 23 nt, Artificial Sequence
  Synthetic
cggggagggggaggugcggggcg

SEQ ID NO: 12894 - RNA, 24 nt, Artificial Sequence
  Synthetic
gcggggagggggaggugcggggcg

SEQ ID NO: 12895 - RNA, 18 nt, Artificial Sequence
  Synthetic
ggccgaggggagggggcg

SEQ ID NO: 12896 - RNA, 19 nt, Artificial Sequence
  Synthetic
gggccgaggggagggggcg

SEQ ID NO: 12897 - RNA, 20 nt, Artificial Sequence
  Synthetic
cgggccgaggggagggggcg

SEQ ID NO: 12898 - RNA, 21 nt, Artificial Sequence
  Synthetic
gcgggccgaggggagggggcg

SEQ ID NO: 12899 - RNA, 22 nt, Artificial Sequence
  Synthetic
ggcgggccgaggggagggggcg

SEQ ID NO: 12900 - RNA, 23 nt, Artificial Sequence
  Synthetic
gggcgggccgaggggagggggcg

SEQ ID NO: 12901 - RNA, 24 nt, Artificial Sequence
  Synthetic
ggggcgggccgaggggagggggcg

SEQ ID NO: 12902 - RNA, 18 nt, Artificial Sequence
  Synthetic
aauaauacaaagauggcg

SEQ ID NO: 12903 - RNA, 19 nt, Artificial Sequence
  Synthetic
aaauaauacaaagauggcg

SEQ ID NO: 12904 - RNA, 20 nt, Artificial Sequence
  Synthetic
gaaauaauacaaagauggcg

SEQ ID NO: 12905 - RNA, 21 nt, Artificial Sequence
  Synthetic
agaaauaauacaaagauggcg

SEQ ID NO: 12906 - RNA, 22 nt, Artificial Sequence
  Synthetic
uagaaauaauacaaagauggcg

SEQ ID NO: 12907 - RNA, 23 nt, Artificial Sequence
  Synthetic
uuagaaauaauacaaagauggcg

SEQ ID NO: 12908 - RNA, 24 nt, Artificial Sequence
  Synthetic
auuagaaauaauacaaagauggcg

SEQ ID NO: 12909 - RNA, 18 nt, Artificial Sequence
  Synthetic
aagccaauggccagugcg

SEQ ID NO: 12910 - RNA, 19 nt, Artificial Sequence
  Synthetic
caagccaauggccagugcg

SEQ ID NO: 12911 - RNA, 20 nt, Artificial Sequence
  Synthetic
acaagccaauggccagugcg

SEQ ID NO: 12912 - RNA, 21 nt, Artificial Sequence
  Synthetic
gacaagccaauggccagugcg

SEQ ID NO: 12913 - RNA, 22 nt, Artificial Sequence
  Synthetic
ggacaagccaauggccagugcg

SEQ ID NO: 12914 - RNA, 23 nt, Artificial Sequence
  Synthetic
aggacaagccaauggccagugcg

SEQ ID NO: 12915 - RNA, 24 nt, Artificial Sequence
  Synthetic
caggacaagccaauggccagugcg

SEQ ID NO: 12916 - RNA, 18 nt, Artificial Sequence
  Synthetic
ggguuugccuugcuugcg

SEQ ID NO: 12917 - RNA, 19 nt, Artificial Sequence
  Synthetic
gggguuugccuugcuugcg

SEQ ID NO: 12918 - RNA, 20 nt, Artificial Sequence
  Synthetic
ugggguuugccuugcuugcg

SEQ ID NO: 12919 - RNA, 21 nt, Artificial Sequence
  Synthetic
cugggguuugccuugcuugcg

SEQ ID NO: 12920 - RNA, 22 nt, Artificial Sequence
  Synthetic
gcugggguuugccuugcuugcg

SEQ ID NO: 12921 - RNA, 23 nt, Artificial Sequence
  Synthetic
ugcugggguuugccuugcuugcg

SEQ ID NO: 12922 - RNA, 24 nt, Artificial Sequence
  Synthetic
gugcugggguuugccuugcuugcg

SEQ ID NO: 12923 - RNA, 18 nt, Artificial Sequence
  Synthetic
caggggugggaggaaagg

SEQ ID NO: 12924 - RNA, 19 nt, Artificial Sequence
  Synthetic
gcaggggugggaggaaagg

SEQ ID NO: 12925 - RNA, 20 nt, Artificial Sequence
  Synthetic
ggcaggggugggaggaaagg

SEQ ID NO: 12926 - RNA, 21 nt, Artificial Sequence
  Synthetic
uggcaggggugggaggaaagg

SEQ ID NO: 12927 - RNA, 22 nt, Artificial Sequence
  Synthetic
guggcaggggugggaggaaagg

SEQ ID NO: 12928 - RNA, 23 nt, Artificial Sequence
  Synthetic
gguggcaggggugggaggaaagg

SEQ ID NO: 12929 - RNA, 24 nt, Artificial Sequence
  Synthetic
ggguggcaggggugggaggaaagg

SEQ ID NO: 12930 - RNA, 18 nt, Artificial Sequence
  Synthetic
acacaaaacaugggcagg

SEQ ID NO: 12931 - RNA, 19 nt, Artificial Sequence
  Synthetic
cacacaaaacaugggcagg

SEQ ID NO: 12932 - RNA, 20 nt, Artificial Sequence
  Synthetic
acacacaaaacaugggcagg

SEQ ID NO: 12933 - RNA, 21 nt, Artificial Sequence
  Synthetic
gacacacaaaacaugggcagg

SEQ ID NO: 12934 - RNA, 22 nt, Artificial Sequence
  Synthetic
agacacacaaaacaugggcagg

SEQ ID NO: 12935 - RNA, 23 nt, Artificial Sequence
  Synthetic
gagacacacaaaacaugggcagg

SEQ ID NO: 12936 - RNA, 24 nt, Artificial Sequence
  Synthetic
agagacacacaaaacaugggcagg

SEQ ID NO: 12937 - RNA, 18 nt, Artificial Sequence
  Synthetic
aaaaaaaaaaaaaagagg

SEQ ID NO: 12938 - RNA, 19 nt, Artificial Sequence
  Synthetic
aaaaaaaaaaaaaaagagg

SEQ ID NO: 12939 - RNA, 20 nt, Artificial Sequence
  Synthetic
aaaaaaaaaaaaaaaagagg

SEQ ID NO: 12940 - RNA, 21 nt, Artificial Sequence
  Synthetic
aaaaaaaaaaaaaaaaagagg

SEQ ID NO: 12941 - RNA, 22 nt, Artificial Sequence
  Synthetic
aaaaaaaaaaaaaaaaaagagg

SEQ ID NO: 12942 - RNA, 23 nt, Artificial Sequence
  Synthetic
aaaaaaaaaaaaaaaaaaagagg

SEQ ID NO: 12943 - RNA, 24 nt, Artificial Sequence
  Synthetic
aaaaaaaaaaaaaaaaaaaagagg

SEQ ID NO: 12944 - RNA, 18 nt, Artificial Sequence
  Synthetic
agagaagagagauagagg

SEQ ID NO: 12945 - RNA, 19 nt, Artificial Sequence
  Synthetic
gagagaagagagauagagg

SEQ ID NO: 12946 - RNA, 20 nt, Artificial Sequence
  Synthetic
agagagaagagagauagagg

SEQ ID NO: 12947 - RNA, 21 nt, Artificial Sequence
  Synthetic
gagagagaagagagauagagg

SEQ ID NO: 12948 - RNA, 22 nt, Artificial Sequence
  Synthetic
agagagagaagagagauagagg

SEQ ID NO: 12949 - RNA, 23 nt, Artificial Sequence
  Synthetic
gagagagagaagagagauagagg

SEQ ID NO: 12950 - RNA, 24 nt, Artificial Sequence
  Synthetic
agagagagagaagagagauagagg

SEQ ID NO: 12951 - RNA, 18 nt, Artificial Sequence
  Synthetic
gcaggagagaaggggagg

SEQ ID NO: 12952 - RNA, 19 nt, Artificial Sequence
  Synthetic
agcaggagagaaggggagg

SEQ ID NO: 12953 - RNA, 20 nt, Artificial Sequence
  Synthetic
gagcaggagagaaggggagg

SEQ ID NO: 12954 - RNA, 21 nt, Artificial Sequence
  Synthetic
cgagcaggagagaaggggagg

SEQ ID NO: 12955 - RNA, 22 nt, Artificial Sequence
  Synthetic
gcgagcaggagagaaggggagg

SEQ ID NO: 12956 - RNA, 23 nt, Artificial Sequence
  Synthetic
ggcgagcaggagagaaggggagg

SEQ ID NO: 12957 - RNA, 24 nt, Artificial Sequence
  Synthetic
gggcgagcaggagagaaggggagg

SEQ ID NO: 12958 - RNA, 18 nt, Artificial Sequence
  Synthetic
auggccagugcggggagg

SEQ ID NO: 12959 - RNA, 19 nt, Artificial Sequence
  Synthetic
aauggccagugcggggagg

SEQ ID NO: 12960 - RNA, 20 nt, Artificial Sequence
  Synthetic
caauggccagugcggggagg

SEQ ID NO: 12961 - RNA, 21 nt, Artificial Sequence
  Synthetic
ccaauggccagugcggggagg

SEQ ID NO: 12962 - RNA, 22 nt, Artificial Sequence
  Synthetic
gccaauggccagugcggggagg

SEQ ID NO: 12963 - RNA, 23 nt, Artificial Sequence
  Synthetic
agccaauggccagugcggggagg

SEQ ID NO: 12964 - RNA, 24 nt, Artificial Sequence
  Synthetic
aagccaauggccagugcggggagg

SEQ ID NO: 12965 - RNA, 18 nt, Artificial Sequence
  Synthetic
gccagacgcggcccccgg

SEQ ID NO: 12966 - RNA, 19 nt, Artificial Sequence
  Synthetic
cgccagacgcggcccccgg

SEQ ID NO: 12967 - RNA, 20 nt, Artificial Sequence
  Synthetic
acgccagacgcggcccccgg

SEQ ID NO: 12968 - RNA, 21 nt, Artificial Sequence
  Synthetic
gacgccagacgcggcccccgg

SEQ ID NO: 12969 - RNA, 22 nt, Artificial Sequence
  Synthetic
ggacgccagacgcggcccccgg

SEQ ID NO: 12970 - RNA, 23 nt, Artificial Sequence
  Synthetic
cggacgccagacgcggcccccgg

SEQ ID NO: 12971 - RNA, 24 nt, Artificial Sequence
  Synthetic
gcggacgccagacgcggcccccgg

SEQ ID NO: 12972 - RNA, 18 nt, Artificial Sequence
  Synthetic
cggcgguggcguggccgg

SEQ ID NO: 12973 - RNA, 19 nt, Artificial Sequence
  Synthetic
gcggcgguggcguggccgg

SEQ ID NO: 12974 - RNA, 20 nt, Artificial Sequence
  Synthetic
cgcggcgguggcguggccgg

SEQ ID NO: 12975 - RNA, 21 nt, Artificial Sequence
  Synthetic
ccgcggcgguggcguggccgg

SEQ ID NO: 12976 - RNA, 22 nt, Artificial Sequence
  Synthetic
gccgcggcgguggcguggccgg

SEQ ID NO: 12977 - RNA, 23 nt, Artificial Sequence
  Synthetic
cgccgcggcgguggcguggccgg

SEQ ID NO: 12978 - RNA, 24 nt, Artificial Sequence
  Synthetic
gcgccgcggcgguggcguggccgg

SEQ ID NO: 12979 - RNA, 18 nt, Artificial Sequence
  Synthetic
cggcggcggcggcggcgg

SEQ ID NO: 12980 - RNA, 19 nt, Artificial Sequence
  Synthetic
gcggcggcggcggcggcgg

SEQ ID NO: 12981 - RNA, 20 nt, Artificial Sequence
  Synthetic
ggcggcggcggcggcggcgg

SEQ ID NO: 12982 - RNA, 21 nt, Artificial Sequence
  Synthetic
cggcggcggcggcggcggcgg

SEQ ID NO: 12983 - RNA, 22 nt, Artificial Sequence
  Synthetic
gcggcggcggcggcggcggcgg

SEQ ID NO: 12984 - RNA, 23 nt, Artificial Sequence
  Synthetic
ggcggcggcggcggcggcggcgg

SEQ ID NO: 12985 - RNA, 24 nt, Artificial Sequence
  Synthetic
cggcggcggcggcggcggcggcgg

SEQ ID NO: 12986 - RNA, 18 nt, Artificial Sequence
  Synthetic
cggcucgguucacaucgg

SEQ ID NO: 12987 - RNA, 19 nt, Artificial Sequence
  Synthetic
acggcucgguucacaucgg

SEQ ID NO: 12988 - RNA, 20 nt, Artificial Sequence
  Synthetic
gacggcucgguucacaucgg

SEQ ID NO: 12989 - RNA, 21 nt, Artificial Sequence
  Synthetic
cgacggcucgguucacaucgg

SEQ ID NO: 12990 - RNA, 22 nt, Artificial Sequence
  Synthetic
acgacggcucgguucacaucgg

SEQ ID NO: 12991 - RNA, 23 nt, Artificial Sequence
  Synthetic
gacgacggcucgguucacaucgg

SEQ ID NO: 12992 - RNA, 24 nt, Artificial Sequence
  Synthetic
ggacgacggcucgguucacaucgg

SEQ ID NO: 12993 - RNA, 18 nt, Artificial Sequence
  Synthetic
aggggugggaggaaaggg

SEQ ID NO: 12994 - RNA, 19 nt, Artificial Sequence
  Synthetic
caggggugggaggaaaggg

SEQ ID NO: 12995 - RNA, 20 nt, Artificial Sequence
  Synthetic
gcaggggugggaggaaaggg

SEQ ID NO: 12996 - RNA, 21 nt, Artificial Sequence
  Synthetic
ggcaggggugggaggaaaggg

SEQ ID NO: 12997 - RNA, 22 nt, Artificial Sequence
  Synthetic
uggcaggggugggaggaaaggg

SEQ ID NO: 12998 - RNA, 23 nt, Artificial Sequence
  Synthetic
guggcaggggugggaggaaaggg

SEQ ID NO: 12999 - RNA, 24 nt, Artificial Sequence
  Synthetic
gguggcaggggugggaggaaaggg

SEQ ID NO: 13000 - RNA, 18 nt, Artificial Sequence
  Synthetic
gcgagcaggagagaaggg

SEQ ID NO: 13001 - RNA, 19 nt, Artificial Sequence
  Synthetic
ggcgagcaggagagaaggg

SEQ ID NO: 13002 - RNA, 20 nt, Artificial Sequence
  Synthetic
gggcgagcaggagagaaggg

SEQ ID NO: 13003 - RNA, 21 nt, Artificial Sequence
  Synthetic
agggcgagcaggagagaaggg

SEQ ID NO: 13004 - RNA, 22 nt, Artificial Sequence
  Synthetic
cagggcgagcaggagagaaggg

SEQ ID NO: 13005 - RNA, 23 nt, Artificial Sequence
  Synthetic
gcagggcgagcaggagagaaggg

SEQ ID NO: 13006 - RNA, 24 nt, Artificial Sequence
  Synthetic
ggcagggcgagcaggagagaaggg

SEQ ID NO: 13007 - RNA, 18 nt, Artificial Sequence
  Synthetic
aagaaagggguggcaggg

SEQ ID NO: 13008 - RNA, 19 nt, Artificial Sequence
  Synthetic
gaagaaagggguggcaggg

SEQ ID NO: 13009 - RNA, 20 nt, Artificial Sequence
  Synthetic
agaagaaagggguggcaggg

SEQ ID NO: 13010 - RNA, 21 nt, Artificial Sequence
  Synthetic
gagaagaaagggguggcaggg

SEQ ID NO: 13011 - RNA, 22 nt, Artificial Sequence
  Synthetic
agagaagaaagggguggcaggg

SEQ ID NO: 13012 - RNA, 23 nt, Artificial Sequence
  Synthetic
gagagaagaaagggguggcaggg

SEQ ID NO: 13013 - RNA, 24 nt, Artificial Sequence
  Synthetic
ggagagaagaaagggguggcaggg

SEQ ID NO: 13014 - RNA, 18 nt, Artificial Sequence
  Synthetic
ggaggggcgggccgaggg

SEQ ID NO: 13015 - RNA, 19 nt, Artificial Sequence
  Synthetic
gggaggggcgggccgaggg

SEQ ID NO: 13016 - RNA, 20 nt, Artificial Sequence
  Synthetic
ggggaggggcgggccgaggg

SEQ ID NO: 13017 - RNA, 21 nt, Artificial Sequence
  Synthetic
gggggaggggcgggccgaggg

SEQ ID NO: 13018 - RNA, 22 nt, Artificial Sequence
  Synthetic
cgggggaggggcgggccgaggg

SEQ ID NO: 13019 - RNA, 23 nt, Artificial Sequence
  Synthetic
ccgggggaggggcgggccgaggg

SEQ ID NO: 13020 - RNA, 24 nt, Artificial Sequence
  Synthetic
cccgggggaggggcgggccgaggg

SEQ ID NO: 13021 - RNA, 18 nt, Artificial Sequence
  Synthetic
gagagaaggggaggaggg

SEQ ID NO: 13022 - RNA, 19 nt, Artificial Sequence
  Synthetic
ggagagaaggggaggaggg

SEQ ID NO: 13023 - RNA, 20 nt, Artificial Sequence
  Synthetic
aggagagaaggggaggaggg

SEQ ID NO: 13024 - RNA, 21 nt, Artificial Sequence
  Synthetic
caggagagaaggggaggaggg

SEQ ID NO: 13025 - RNA, 22 nt, Artificial Sequence
  Synthetic
gcaggagagaaggggaggaggg

SEQ ID NO: 13026 - RNA, 23 nt, Artificial Sequence
  Synthetic
agcaggagagaaggggaggaggg

SEQ ID NO: 13027 - RNA, 24 nt, Artificial Sequence
  Synthetic
gagcaggagagaaggggaggaggg

SEQ ID NO: 13028 - RNA, 18 nt, Artificial Sequence
  Synthetic
gcggcccccgggggaggg

SEQ ID NO: 13029 - RNA, 19 nt, Artificial Sequence
  Synthetic
cgcggcccccgggggaggg

SEQ ID NO: 13030 - RNA, 20 nt, Artificial Sequence
  Synthetic
acgcggcccccgggggaggg

SEQ ID NO: 13031 - RNA, 21 nt, Artificial Sequence
  Synthetic
gacgcggcccccgggggaggg

SEQ ID NO: 13032 - RNA, 22 nt, Artificial Sequence
  Synthetic
agacgcggcccccgggggaggg

SEQ ID NO: 13033 - RNA, 23 nt, Artificial Sequence
  Synthetic
cagacgcggcccccgggggaggg

SEQ ID NO: 13034 - RNA, 24 nt, Artificial Sequence
  Synthetic
ccagacgcggcccccgggggaggg

SEQ ID NO: 13035 - RNA, 18 nt, Artificial Sequence
  Synthetic
ccccgggggaggggcggg

SEQ ID NO: 13036 - RNA, 19 nt, Artificial Sequence
  Synthetic
cccccgggggaggggcggg

SEQ ID NO: 13037 - RNA, 20 nt, Artificial Sequence
  Synthetic
gcccccgggggaggggcggg

SEQ ID NO: 13038 - RNA, 21 nt, Artificial Sequence
  Synthetic
ggcccccgggggaggggcggg

SEQ ID NO: 13039 - RNA, 22 nt, Artificial Sequence
  Synthetic
cggcccccgggggaggggcggg

SEQ ID NO: 13040 - RNA, 23 nt, Artificial Sequence
  Synthetic
gcggcccccgggggaggggcggg

SEQ ID NO: 13041 - RNA, 24 nt, Artificial Sequence
  Synthetic
cgcggcccccgggggaggggcggg

SEQ ID NO: 13042 - RNA, 18 nt, Artificial Sequence
  Synthetic
gacauggugggcugcggg

SEQ ID NO: 13043 - RNA, 19 nt, Artificial Sequence
  Synthetic
agacauggugggcugcggg

SEQ ID NO: 13044 - RNA, 20 nt, Artificial Sequence
  Synthetic
gagacauggugggcugcggg

SEQ ID NO: 13045 - RNA, 21 nt, Artificial Sequence
  Synthetic
cgagacauggugggcugcggg

SEQ ID NO: 13046 - RNA, 22 nt, Artificial Sequence
  Synthetic
gcgagacauggugggcugcggg

SEQ ID NO: 13047 - RNA, 23 nt, Artificial Sequence
  Synthetic
ggcgagacauggugggcugcggg

SEQ ID NO: 13048 - RNA, 24 nt, Artificial Sequence
  Synthetic
cggcgagacauggugggcugcggg

SEQ ID NO: 13049 - RNA, 18 nt, Artificial Sequence
  Synthetic
gccaauggccagugcggg

SEQ ID NO: 13050 - RNA, 19 nt, Artificial Sequence
  Synthetic
agccaauggccagugcggg

SEQ ID NO: 13051 - RNA, 20 nt, Artificial Sequence
  Synthetic
aagccaauggccagugcggg

SEQ ID NO: 13052 - RNA, 21 nt, Artificial Sequence
  Synthetic
caagccaauggccagugcggg

SEQ ID NO: 13053 - RNA, 22 nt, Artificial Sequence
  Synthetic
acaagccaauggccagugcggg

SEQ ID NO: 13054 - RNA, 23 nt, Artificial Sequence
  Synthetic
gacaagccaauggccagugcggg

SEQ ID NO: 13055 - RNA, 24 nt, Artificial Sequence
  Synthetic
ggacaagccaauggccagugcggg

SEQ ID NO: 13056 - RNA, 18 nt, Artificial Sequence
  Synthetic
gggagggggaggugcggg

SEQ ID NO: 13057 - RNA, 19 nt, Artificial Sequence
  Synthetic
ggggagggggaggugcggg

SEQ ID NO: 13058 - RNA, 20 nt, Artificial Sequence
  Synthetic
cggggagggggaggugcggg

SEQ ID NO: 13059 - RNA, 21 nt, Artificial Sequence
  Synthetic
gcggggagggggaggugcggg

SEQ ID NO: 13060 - RNA, 22 nt, Artificial Sequence
  Synthetic
ugcggggagggggaggugcggg

SEQ ID NO: 13061 - RNA, 23 nt, Artificial Sequence
  Synthetic
gugcggggagggggaggugcggg

SEQ ID NO: 13062 - RNA, 24 nt, Artificial Sequence
  Synthetic
agugcggggagggggaggugcggg

(The sequence listing continues in the following parts.)

What is claimed is:

1. A method of altering a cell comprising contacting the cell with:
   (a) a first gRNA molecule comprising a first targeting domain which is complementary with a first target domain located within a BCL11A gene, wherein the first targeting domain is configured to provide a first cleavage event in a region of the BCL11A gene which is complementary to a sequence that is the same as, or differs by no more than 3 nucleotides from, a sequence selected from the group consisting of SEQ ID NOs: 16261 to 16279; and
   (b) a Cas9 molecule.

2. The method of claim 1, wherein the cell is from a subject having a mutation at an SCD target position in the HBB gene or from a subject which would benefit from having an alteration at an SCD target position in the BCL11A gene.

3. The method of claim 1, wherein the cell is selected from the group consisting of an erythroid cell, a bone marrow cell, and a stem cell.

4. The method of claim 2, wherein the contacting step is performed ex vivo.

5. The method of claim 4, wherein the contacted cell is returned to the subject's body.

6. The method of claim 1, wherein the contacting is performed in vivo.

7. The method of claim 1, wherein the cell is from a subject that has SCD.

8. The method of claim 1, further comprising contacting the cell with (c) a second gRNA molecule.

9. The method of claim 8, wherein the second gRNA molecule comprises a second targeting domain that is complementary with a second target domain located within the BCL11A gene, wherein the second targeting domain is configured to provide a second cleavage event in a region of the BCL11A gene which is complementary to a sequence that is the same as, or differs by no more than 3 nucleotides from, a sequence selected from the group consisting of SEQ ID NOs:16261 to 16279.

10. The method of claim 9, wherein the contacting step comprises contacting the cell with a nucleic acid that encodes at least one of (a) the first gRNA molecule, (b) the Cas9 molecule, and (c) the second gRNA molecule.

11. The method of claim 10, wherein the nucleic acid is an AAV vector.

12. A method of altering a cell comprising contacting the cell with:
   (a) a first gRNA molecule comprising a first targeting domain which is complementary with a first target domain located in a BCL11A gene, wherein the first targeting domain is configured to provide a first cleavage event in a region of the BCL11A gene, and wherein the first targeting domain comprises a sequence that is the same as, or differs by no more than 3 nucleotides from, a sequence selected from the group consisting of SEQ ID NOs:16261 to 16279; and
   (b) a Cas9 molecule.

13. The method of claim 12, wherein the cell is selected from the group consisting of an erythroid cell, a bone marrow cell, and a stem cell.

14. The method of claim 12, wherein the cell is from a subject having a mutation at an SCD target position in the HBB gene or from a subject which would benefit from having an alteration at an SCD target position in the BCL11A gene.

15. The method of claim 14, wherein the contacting step is performed ex vivo.

16. The method of claim 15, wherein the contacted cell is returned to the subject's body.

17. The method of claim 12, wherein the contacting is performed in vivo.

18. The method of claim 12, wherein the cell is from a subject that has SCD.

19. The method of claim 12, further comprising contacting the cell with (c) a second gRNA molecule.

20. The method of claim 19, wherein the second gRNA molecule comprises a second targeting domain which is complementary with a second target domain located in a BCL11A gene, wherein the second targeting domain is configured to provide a second cleavage event in a region of the BCL11A gene, and wherein the second targeting domain comprises a sequence that is the same as, or differs by no more than 3 nucleotides from, a sequence selected from the group consisting of SEQ ID NOs:16261 to 16279.

21. The method of claim 20, wherein the contacting step comprises contacting the cell with a nucleic acid that encodes at least one of (a) the first gRNA molecule, (b) the Cas9 molecule, and (c) the second gRNA molecule.

22. The method of claim 20, wherein the contacting step comprises contacting the cell with a nucleic acid that encodes (a) the first gRNA molecule, (b) the Cas9 molecule, and (c) the second gRNA molecule.

23. The method of claim 20, wherein contacting comprises delivering to the cell the Cas9 molecule of (b) and a nucleic acid which encodes (a) and (c).

24. The method of claim 20, wherein contacting comprises delivering to the cell the Cas9 molecule of (b), the first gRNA of (a) and the second gRNA of (c).

25. The method of claim 20, wherein contacting comprises delivering to the cell the first gRNA of (a), the second gRNA of (c) and a nucleic acid that encodes the Cas9 molecule of (b).

26. The method of claim 20, further comprising contacting the cell with a third gRNA molecule.

27. The method of claim 26, further comprising contacting the cell with a fourth gRNA molecule.

28. The method of claim 21, wherein the nucleic acid is an AAV vector.

* * * * *